United States Patent 7,745,391 (HUMAN THROMBOSPONDIN POLYPEPTIDE) - sequence listing, part 69

SEQ ID NO: 243804 - DNA, 525 bp, Homo sapiens
tataaaagaaacgagagtacctagatattaaagatattggcaaggcatagctcttgtaaaacaaaagctggttggccagatattctcattcgtttcaatctattctttgtcaaacaaaagtgatttcactttacaggaataggggttctcaaatgtgtacattttatcccaaactgctatgagacaaaaattaaagtatttgtctttccaatgaccatatttaaggagaaaaacgtcattcagccttatacaaaattttgaactagttcctaatacatacatcaagaggtgacaaaatatgattatacctataacattcctattctgtaaataattcatataaatcctcaggctcaagatgaccagttattataattcctaaacctatgcagtaaacattatgtgatttatatttcatattctgagtaaaatgaagttaagagagagatgagaattagaagaggagactaggaaagaattagcggaaaaaaaagtaaaaaggacagatagtggcaagaaaatagt

SEQ ID NO: 243805 - DNA, 420 bp, Homo sapiens
aaatggtagggtttatcttgaagagatttgtgagtttggcttttcttggaaaaagtatgtattagggttctctgcagaaacagaatcaacagagagagagagagaatgaatgagtgcgtgtgtgtgtgtgtgtgtatgtgtgtgtttaaaaatgtgtttattttaaggaattatctcttgcaattgtggaggcttggcaaatccagaatctgatggggtaagctggcaggctggagacccagggaagggttgcagtttgaatctaaaggccatgtctgctagcagaattccttcttgcttgggggaggtccatttttgttctattaaggccttcaactgattggatgagactcacccacactatggaagataatctgctttactcaaagtgtcgctattaaaatgtttacctcatcaaag

SEQ ID NO: 243806 - DNA, 479 bp, Homo sapiens
gtaaataaaatatcagactacagccatgcccattaatttacatattttacattaaacataatttacatttgtgtttcatctatggctgcttcacactaaaatggcagttgggtagttatagcagcaatcatatggcccacaagcctaaaatatttgttacttggccctttaagaaaaagtttgtcagctgggcatggtgactcactcctgtaatcctagcagtttggaaagctaaaatgaaagggtagcttgagcccaggagttcaagaacagtctgggcaacataatgagacttggtctctaaaaaaatttgttttaattagctgggtgtggtggcatgcacctatagccccagctacttaggaggctgaggcgggaggatcgctcgagctcaggagttcaaggatgcagtgagctgtgattgcaccagtgtactctaccctcggcaacagagtgagaccctgtcaaaaaaagaaaaa

SEQ ID NO: 243807 - DNA, 354 bp, Homo sapiens
acggggtgtccagaagctgctgcatggaccatgcatcgatcccggtcgcggggagaatgtgcccagctctccacacaacgcttctcaaatccactaaaatcaacacaataattgaaatattttcaagctgattacaccgcagcccgaggctagcctggttgctaagggtgagctccgcggttgctagggggagtaaatcatcttgcattatttgatttttgttatagatatgaaaccgctactcccgcgattaaatgtctctcagcctaacacctatgggacctggggagagggaagagaaaggctccaaccttgaccctgtcaaataaatatctctaactttttctgtcctca

SEQ ID NO: 243808 - DNA, 727 bp, Homo sapiens
acaggttgagttacttgcccaggattccagagctgggaggtaggcagcgaattgtggtggttaggaatatagacagtggagcagggtggctgtggtgaggattgaatgggttcgtacacaatgtgcttacaaagatgctgggcaattagcatccttgatggatgaaactcctgctttcacactcagttaacagtacaatatccttcaaagcaggctatccttttatgaagcgattgtttctgatgttagcctttcttatagtgaacagacatttccctctaacttccaccattcaattcaagtccacctttggcaaatgcaaaacaagccttattcttctttttataggtgatagcccccttctagaaatcagaaatactgatccttctctaatgactacttcttccttccagattttagaaatcttgagctgtgtcttcagtatgctgtctgtgaaataaggctatcattgcgtggcagccaagattttcaccagattgtgattcccttatgaccatttgccttcctgggtaggaagtgataaatggcctgataacgtgagtttttgccagtaataataataatgatgtgttaatatttcttgagcattcactattggtccagacactatttttagtgctttacatttatgagggtttaaaatcctcatgacaaccctgtgaggcaggtgctattgattcccattgaagagatgagaaaaccaagg

SEQ ID NO: 243809 - DNA, 673 bp, Homo sapiens
acaggttgagttacttgcccaggattccagagctgggaggtaggcagcgaattgtggtggttaggaatatagacagtggagcagggtggctgtggtgaggattgaatgggttcgtacacaatgtgcttacaaagatgctgggcaattagcatccttgatggatgaaactcctgctttcacactcagttaacagtacaatatccttcaaagcaggctatccttttatgaagcgattgtttctgatgttagcctttcttatagtgaacagacatttccctctaacttccaccattcaattcaagtccacctttggcaaatgcaatactgatccttctctaatgactacttcttccttccagattttagaaatcttgagctgtgtcttcagtatgctgtctgtgaaataaggctatcattgcgtggcagccaagattttcaccagattgtgattcccttatgaccatttgccttcctgggtaggaagtgataaatggcctgataacgtgagtttttgccagtaataataataatgatgtgttaatatttcttgagcattcactattggtccagacactatttttagtgctttacatttatgagggtttaaaatcctcatgacaaccctgtgaggcaggtgctattgattcccattgaagagatgagaaaaccaagg

SEQ ID NO: 243810 - DNA, 1093 bp, Homo sapiens
agtggaatctgagagatcacagtgtggggtttcattagagttgtctaggccattgtgaggaatctggattctattctttgtgaggtagaaagtcgctggagaagttaaaggagaccagaacatgatctgacttaaggttttataaaattaatctacctgatatgttaagaatacatgactataaaaaagtgacagaatgagttaacaagttgttgaagtaatccacgtggaaaatgatggtgtcaatcatcaaatggccaaataaaaagaggttcaaggatggggggttcatcagcaacctcacatcttggtaaagatttaggtagaagaaggactaattgatcctttaatttagcatcatggacaacttttggtgacatttataagagcaatttcaatggtggcgttagaggcccagtgtgttcaaggaaaaatgttatcaaggagccacagacaaagaacaaagactactctttttaggatcttttctgaaatggggaacagagaaatgggggagttgtttaaagagtatgcatgacttagagtaacagtgtttttaaattaagggaaattccagaacatttttattattctagaatgatttaagagagtaggaaaattatgtggaagacaatgctcataattattagagcagacaatgctcataattattacagcagacaatgctcataattattagagctacaccctgagcaagtaagcaaagcagtgagaaaagtgagcctcagatgagtggttgcccttcagcaggaacatggacagctcatccacagtaatgggagggggcagggggatgattgtcctgttgggaaatgtggaacttcttcctgacccatcctggtttactcattaaatgtgcctcaaggtcatcggatgaaagagaagattggaagaagctactgaaggtaaagcagaaatataagggataattcctcaactacagtggacagagctggaatctgagccaagcggagcagtcatgctgagttcaggaagcctcactgctaaatgccacctatcaaagtggcctcccctgaccatcctgtgtaaaataatccctccttcctctcta

SEQ ID NO: 243811 - DNA, 496 bp, Homo sapiens
aataagatattgaaggtgttctgtgatagaatctgcagaagatgataacagttcctcctatctttgtatgagcacggtgctcctctcatcaagagttggagtctatttccccttcccttgaatcatgtgacttgctttgacagaaagaatgtagcagaagtgacgtggcaccagtccaggcctgggccttaaaaggtaccttagtttctgcttttgctcttagaagtcagctcccatgtaaaggatctcaggctagattactgaattatgagaggccacatggaggacaaccaagcgtccccactgagagccagcaccatggccccggacacacgtggccaccttggaccctagagccccaatcaagcccaatcaacaccttgtagagtagaaacaaatcacccctggagagccctgcccaaattgtaaaatcgtgagcaaataaatagtggctgttgtttcaagccactaaattttgaagtggtttgctatataa

SEQ ID NO: 243812 - DNA, 442 bp, Homo sapiens
ttgagggcctttttactagctacttgcttcccaatttagggttgcctagcagggttaatttcaacataacgaaaggtgttaactggctggccgcatcattcactggtgacaggggcaagtttaatgagttttgtgctcagatcgctgggcctcctggctgctcttgtccatctctgcactttggtcctaagcattctgagactcagtcagttgagggtgaaagggacctaccagccagttgaggggcatgttgttaacaagaaatccatcaagtcatctaaagattccttcattttctgcagctgccccttgctagaagtggaggctgtcagacacttcctcaaaggaggcagcattgcagaacactgagtagatgtcgcctgccatcaccctcatatgcttggcctgaccttggatgttctgtggtcatcatggatgttgg

SEQ ID NO: 243813 - DNA, 283 bp, Homo sapiens
gaggctgaagactgagttcgcagggctggcctgagtcctggggctgcaggatttaggttggggtcagagtgagcttggaggttcagaccatgggtactggctagagtctggggctttgggagctgggttttactgaagtcggttctgtggtttgggtgtaaggcaaagtctggtgctcacttccttctcctttccccaagcatattgtatcttgctcaatgctgtgcttcctggagttggggaagatgacacagtgaaacttttcttcctgcccttttcaatg

SEQ ID NO: 243814 - DNA, 405 bp, Homo sapiens
ttttctaggcagtatcactctgagaggactatggaggatgaatcggagagaagtgaggctagtatcagggagttccatttaatagacaatttaatgaggccaggcagagatgatgaaggcctgagttaagaaaatgacaaaatggcctgaatcccaggactttggagccccaggtgggaggattgcttgaaaccaggagttcaagaccagcttgggcaacatagtgagaccctgtctctacaaaatagaaatttttaaaaagggaaaagaaaatgacaaaatgaagaggagggggtgggtttaggagatgtttgggagggaagatcaataggatgtgagaactgattggattggagtagaagagaaagaggaatatagggcatgtgtcaaggtttggtgaatgca

SEQ ID NO: 243815 - DNA, 540 bp, Homo sapiens
ttgtcaaataaaacaaattcagatttagggaagatttagatacacatgtaaccttaatattatatacctatttttgtaatactttatagtttataatgtgttttactggcaatctaagttgaaatctagtttacttttagctacaaataccctccaggaaggcaagttttataactacatatttttgttaagttgtatgtggtactataaggcacaacatgcctctactttgaaaagaatagccaccaagtcctgaatggaaatgcaagaattgtgaaagaattcagtcacctaatttgttgattggagaggatttcttttttttttttttttttgaaactccatctcaaaaacaaaacaaaacaaaacaaaacaaaactccttttgttgctttacaccttctctcacatggtatgatatactgataacacctacacttttttggaagtgttttcatatacttcctttggaccaataaaaatgaaccttctgagatgtggaggatatgggctattaccccaattttaaaggaaaaaaaaa

SEQ ID NO: 243816 - DNA, 486 bp, Homo sapiens
cattgtcaagattcagttaagattcagaaggctagcatcatcacaaggatcactgctgttgcttttttatagccacctcctcttcctgcctcttcaaactgtggcaaccactaatctgttctacatttctataagtttgtcatttccacgctgctatacaaatgaaatcatatagtatgtaacttttgaagattgaccttttcactcagcaccatactctggtgattaattctggttattgtgtgtaacaatagttcatcccttcttatttctgagcagtgtcgtggtataagaatatcacagtcgaaccactcacctgttgaggggagtctgggctgtttccactttttgatgactatgagaaaagccactataaatattcatgcacagattttaatgcaaacataagtctatttctctgggataaatgtacaggaccccaatcactgaaccatatagtaactgcctatttagttttggaccaaa

SEQ ID NO: 243817 - DNA, 444 bp, Homo sapiens
ccttcagcttgggctatcatgctgatctgtttgtacaaaagacagagaggggaactttccccacagtgtgcaaggcccactaggaggtacgacccaaacttctataaaatctgtcagaccaaggtcctgtcaaactcagttctccacactcacaaagaaggcctgctggccgggcatagtggctcacacctataatcccagcattttgggaggccaaggtgggcggatcacgaggtcaggagttcgagaccagcctggccaacatggtgaaaccccatctctactaaaatacaaaaattagctgggtgtggtgatgcgtgcctgtaatcccagctacttaggaggctgaggcagcagaatggcttgaacctgggaggtggaggttgcagagagccgagatcgtgccactgcactccagcctgggcaatagagtaagactctgtc

SEQ ID NO: 243818 - DNA, 448 bp, Homo sapiens
ccattggaatgaccgagaagcccatgtctcattctcagacgggggattttgattctaatgacagtcatggttgagagtccactgtgttaaagtctcttcatttgaagcatctgatgtgaattctattttctgcttaaaccccagacatagatgttaagtttcaaaattatgtcgtacattcactcccactacatactcattgaatgcttaccatgtacagactctgtgatagactatggaaatacatagaaagaaattccctgtttttaagaactttacctagtgtttagaaattgcatttaaaactgataattaaaatactatagaccttggcttaaaggatgcaccttgtaatctgtaatcatatttgtagttatatattgctttgaaaatacactgtagacagtaagacaaaaaaggaaataaaaagtacatgaattgcgaagga

SEQ ID NO: 243819 - DNA, 469 bp, Homo sapiens
agagtgtagtgtttcttttatttactaatttactgtagaggttctggaactggggactcagtatcacatctatcagtgtaattgttataactgcatttgtaacaacagttttggtcacagaatttattaatgggattgtatgtgtggtaaaatcatgccaagcttaagtggaacaatacataagatgctacatttaagaactccagtgccttggtcaaatccgtccaaggatttgaatgactaccacatgttcagtattcaaccagggtctttgggatattcaaaagatatacaaaagaagactggaattgaatgtaattgtaagtagaagtttagagaaggaagaggtaaatgtagactagagtgtttggggattttaaagtagtggttacaagttaaagaaaaataaaatgttcatcattttttacctctgtttcttgctattaaaaagttcacttgaaaagtaaaa

SEQ ID NO: 243820 - DNA, 496 bp, Homo sapiens
ttttttgcctttacttacaaagaaatacacacacagagagagaaagaagaagccctaaattaggataggaatgaaaaaaagtaaattttttagtaaggagtaaagctctactatttactgtaaacagcaactatgtaagaacaagtgaataacaattctcctgatttttgatgttttaaaattacaaaaaaaaaggcccatctgtaatatacgccaacatttagcatgtactgaaccagcattccttaactaaaacgacgtatcagaatcaacacggaaagtttttaaaaataggcctatcctctcacagacgtctttgaaggacttcaggggaaatgagagctacatattttggaaagaaaaaaaattccccaataattttgacgttgccccaccaattttgaaactcccctgaaggaagaaaagcaagatattccctctcaagtacttcatttcttcagaaaataaaatacagatgtgtccattaaaattataa

SEQ ID NO: 243821 - DNA, 251 bp, Homo sapiens
agctggcatcttgaccttggacttcccagcctccaggactgtaagaaaataaatatctattgtttaagccccctagtctgtgggattttgttatggcaacctgagcagactaatccacatgtctaatgtggaatctcaatgctctttttgccaattctgccccactgaggaactaggaaagcagtcccactcaaaattataaaagcacaagcatgaatgatgattacaaataaaaaagactgttttggaga

SEQ ID NO: 243822 - DNA, 388 bp, Homo sapiens
gagacacggtctcactctgttgcccaggctggagtgcattggcaccatctcagctcactgcaacctctgcctccccagttcaagcggttctcccacctcagcctcctgaccagctgagactacaggcacgtaccaccacacccaactaatttttgtattttttggtagagatggggtttcaccatgttgggcaggctggtctcgaactcctgtcaagtaatccacccgcctcagtctcccaaagtgctgggattacaggcatgagccaccgcgccaggccaattaagtgaccttttcaatatacaagatagtttattttttcattattctgtgggaatatataatcacctcagttttcagtaacaaaatgtgccaggcacattataga

SEQ ID NO: 243823 - DNA, 415 bp, Homo sapiens
ggtgatccaggagctcagattagacagtgccagcctctaccattctccatgtacagagagcattctgttcccagtgaagccacagtgcctgatccctgggaagctggcctggcctttgcccccttccagaatgaaggacggctcggaccaattgccagggccatctgaactgtgctttacagggcatggcactgccctctgataaggggcaggcatccagtaccccaggacagggtcagggcaggaatccagtgggcacattcagagaggctattttcccatgagtagattcaatcctgatacaccccaccctctccaacctcaaccttcgaaagcgaggtgaggcctttctcagaaaccaccctgcttgctgttggctccagcagatctgctttctggtccacatttaacaatc

SEQ ID NO: 243824 - DNA, 315 bp, Homo sapiens
aggcatgaagtttaaaataatgtaatgttaattttgtgctctgtaatgtatatcgtaagattgaggtcttaatgtttgtattaagtaagtgaaaatattcaaatgaaacttgtgtagaaaaggaactgcctgtgttcagaaagattctgaacaaaaacaagtgaattttcagaactgaactaacagttgccagagggtgtgggttctgacgatgtcctacctgaggcaggctttgtgactttggaaagccttggttttcttatttttaaagaggatctagtccaacactggtctactcagacttcctcatttgta

SEQ ID NO: 243825 - DNA, 460 bp, Homo sapiens
gagaaaattttcctgttgctgaaggaaaacctggtatgtggattgaagtagttcacattctataagaagcaacataaggaacaggcaccaacacctaggcataacctggagatgtaagacgtgtaaggacaaaggtgggacacccagattgcttaaaaggaaaagcactcgggctaggtctaatatctgtcagttcctgtgggccttagttcctgctattttctcttcctgtaactctccctcctgtcacatgccacctgattctcttggcttgatgaactcttgttcattttcccaaaattccaaggggatcttcctgattccatataccagttaagtgtcttctgtgcatttttctgtatcaccctctactaaccctctgctggcactcaccactgcataatgtctatttaatttaattattcttactattaaaatgtgcacattttgaaggcaaaga

SEQ ID NO: 243826 - DNA, 356 bp, Homo sapiens
tcttctcaactccagatacaggataagcaaacaaaccaccaaaagactccaacctggaaaatttcggccttcatcccaccatcccaacatagtgtgcattagaagaaggagctatgttcctcaatcctgaaatcttttctttttagcagtcaccctttgtgggattgtgtccagatacccaggactgcattttgagaccacagcactttctagaggaaaactccagactgctactagattccttgttgtactccatggccagcttcttttggagatgaagcatctaagctttaagtcaagtctgcaagtttgagcatgattcaaatgttgaataaaacctggagatgacaacttta

SEQ ID NO: 243827 - DNA, 405 bp, Homo sapiens
atatgcaaaatccctttctctagctctcctctctcccaaatcgtacccctactctctagttgagaagggaaacaacttcacctgccaccactggatgctggccactgggagtggaagtctaggttcctccctgggcctctactgacaccactttggcgggagaatcgagcactgtttcactgctgctggcctgagggtggaagttcatacttctcacttattccactggccccgccccagagagggaagcagaatgctgcctcacactgtctcactgcctccaagttgggggtggaagtacagactcttcattcaccccaacagacaccatgttatcagggaaaagtaaaaaaccatgttggtgctaccaggcagaggacagatattcaagttccctgcttagcc

SEQ ID NO: 243828 - DNA, 439 bp, Homo sapiens
ctgcgcctggctgtgccccgccctcctgggtccgtgtacccgtctgtcctgcaactccccatttgacccagaccctattcaggtatagcctctcttctgggtcagagctttccaccaggctttgattcctgtgattgggatttggagacagaagtgatagggggaggccgggcgcggtggctaacgcctgtaatcccagcattttgggaggctgaagcagacagatcgcttgaagtcaggagtttgagaccagcctggccaacatggtgaaacctcgtctgtactaaaaatacaaaaattagccaggcatggtggcaagtgcctgtaatcccagctactcaggaggctgaggcacgagaatcttttgaacccgggaggtggaggctgcagtgagccgagatgacaccagtgtactctagcctaggtgacagagcaagac

SEQ ID NO: 243829 - DNA, 407 bp, Homo sapiens
atttgggccagtgaagccaaatccttacagcaagcagcatgcagcatacctggctctttgctgattgcaaataggcatttaaagtatgaatttgagccgggcgcggcggctcacacctctaatcccagcactttgggaggctgagacaggtggatcccctgaggtcaggagttcaagaccagcctggccaacatggtaaaaccccatctctactaaaaatacaaaaatgagttaggtgtggtggtgtgtgcctgtaatcccagctacctgggaggttgaggctggagaatctctggaacctgggaggcagaggctgtagtgagctgagatcacgcaactgcattccagcccgggcgacagagtgagactctgtctcaaaataataataataataataaataataaag

SEQ ID NO: 243830 - DNA, 515 bp, Homo sapiens
  misc_feature (16)..(16): n is a, c, g, or t
cgcctactactactanatttcggccgcgtcgacctctgaccaaaaacagtttctgccctcacttgaatttaaaagcctgccagaattgcagtggggagcagaggcagaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctga

SEQ ID NO: 243831 - DNA, 351 bp, Homo sapiens
gcaagcgaaaccaattctctgttctcacagagcttttccctcaagtagagagcaagcgaatacgaaaataaccatgatcaccgtaaatagttgtataagctttgcggaaaataaaacacggcgcgacagaaatgcccagggccatgcagcttgggatggtctccgaaggggactctgtcaagatgatcttcggagactccataaacaggctgaacacacataaaccagccctgtagatgtttgaggagacattgttgccagtggagcaaacgctccacaaaaacggttgtttttcacttaagaagtcatatccatccttcacccacccagataaggatatttccatttaaa

SEQ ID NO: 243832 - DNA, 583 bp, Homo sapiens
tagatccctgaggaatcaccacactgacctccacaaggattgaactagtttacagtcccaccaacagtgtaaaagtgttcctatttctccacatcctctccagcacctgttgtttcctgactttttaatgattgccattctaactggtgtgagatggtatctcactgtgattttgatttgcatttctctgatggccagtgatggtgagcattttttcatgtgttttttggctgcataaatgtcttcttttgagaagtgtctgttcatgtccttcagtgtggttgcccttatttaaatctcactcatcatgggctaatctttcaaatttaaaatatctcatgtacccagtgttttataagcactaacatattgtgtaacataacattttgttgtcattacaaatacagaaattgataagattgtttggtatgtgtcaacagctatggtagtagaaaattccatgctattgtaagctttctgttaaaatatccaatttgtagcacaccacattatggtaataaaagcttcctaggcaacaagcatacttaccagtcatcaaccaaggtcatatcttgtacttccc

SEQ ID NO: 243833 - DNA, 189 bp, Homo sapiens
cccatcaaattgtaagtcactgcaatgtaaccccttatccccttgttgctaattatagataatccccaaacaatggcccaagaaccctccatattcgaatggtatgggttaggagcagatgttataggacgggaccccataagaatcttctctctgagtcggttgaaaacaataaagaaatccagaccc

SEQ ID NO: 243834 - DNA, 1104 bp, Homo sapiens
ggaaatacaggtttggtttttggggttttttgtttgtctgtttgttttgagacaagatctcactctgttgcaccagctggaatgtagtggcatcatcatagctcactgcagcctcttaactcctgggctcaaacaatcttcctgcctcggactccggagcagttggaactacaggcatgcaccaccacacctggctaatttttaaattttttaatgtagaaatggggtctcacgatgttgctcaggctggtctcaaactcctgacctcaagtgatcctcccacctcgacctcatgaagtgttgggattataggtgagccactgcacccggcctacaagtatttgtataccaatagcttaatattccatagtccacttaggtaaaataagataaaagacaattcagtttacatttctgaacttctaccaatatcttttactcaagacaatgtgctttaacttcaagcccccaattttttttttttttttttttaagcagagtctcactttgtcgcccaggctggagtgcaatggcttggctcattgcaagctccgcctcctgggttcacgccattctcctgcctcagcctcccaagtagctgggactacaggcgcccgccactacgcccggctaatttttcgtatttttagtacagacggggtttcaccctgtcaatcaggatggtctcgatctcctgaccttgtgatccgcccgcctcggcctcccaaagtgctgggattacagacgtgagccaccgcgcccagccccaaatttttaacttatgaaagtttttcataaaaccattttagcaaaaatactagcccagaaacagcatctctcttcacctcttataagagaccaaagagtcattcttactatctaaggtaaatacatctcaatttaagagatctattacttgatctaaaagaccatttgcttttgaatcatttagtagtatgtactgactattactggacttagctaagttgtaacacataccaataagtggctggatttcacatcacccctgccacaataaatgacaacttttcatcaatttaaaaacttgaaatttcaagtcaaaataaagaaatgattcttttt

SEQ ID NO: 243835 - DNA, 561 bp, Homo sapiens
gctaattatttatcttctttaagcctcagctacctcctttttcaaatggagaaattaattcattcagcaaatatcttactgtgcatctgtcatatagcaggtgctgtatgaacaaagtgtagattctctgctggtgaacaaaatacataatacctgccctcacagagcttccagtctagtgattgtacagcatcaacctcagagggtagtgtgggaattaataagagtatctggtacatagcaataccttaatacatttcagatgattttgattttattcataattttttttcagcgttgtatagctcagttctttttagttcatttatattaatgcctttgtctctgaaagtctgtcccatagggaagtcatctttttattccttgatggctctatgcaacatcctgaagagctgggagaatggaaaaatgcatatacaggattcttttttttttttcccaagacagagtttcactcttgttgcccagtctggagttgcagtgagccaagatcgtgccactgcactcaaacctgggcaacaagagcgaaactctgtctca

SEQ ID NO: 243836 - DNA, 641 bp, Homo sapiens
gaatgacagttcctctatcaaaatacatgtttctgtttgtcctgaacactcaggaacaaagggcagtagaacctactagcagcaaatgaaatcaagtaccaagaatgagattatgttttttaaagtggacttagatttgtagtccaagatagcacgctaaacacttgcctttatatctttgttcctttccagaaatttcattgaaatgatagtaaagatatgtaaaaagaataataaaacaggataggattctgtcagagaactagaaatttttaagaattcctggaagatggaaaatatatgaatggttacgtaaataagccaaaatagaaaaccaaacaaaatactaggagctagattcttacatgaagggagccattcttagcaaaatcctgatgaagcagatagcatagtcagcagattacaaagaagtggatttgcctcttgggtagtcgtcagagtaattagtcgaaggtcttgctctggcaggaagacaaagtcatgtgtcttcataaatcgagctggtgatataaatatgaatattttgaaggtgtgtgttagttgtgagtcctgtggagaaccaaaacaaacctcaactaaaaacattgaaattctgaattcaaaaaaaattttttaaaggt

SEQ ID NO: 243837 - DNA, 486 bp, Homo sapiens
agactattctgtttactgatcattatggtaaccatattcaccttgtctttggtggttaagtgcctcctcttggcccctgtcaccttaggatcaaatcatcccattgtgtttagggattccatctaagagggaagatccaccacagagctctggtgctggggctatcctcatgaattcgtcacagctgtagtctcctggtttggatgagcagattttacaccataaattatctttagcatttcaatcactcatagactttggagaagtccctctacagtatcctaagtaggttctgaagttttggcttcatttattgcaggccaatttgggtccctttttcagacaactagcctagcaaaatttagagccattcctaacccctcaagctaaattgaattcataatctctgcttaatgttcccgtatcaataaatctgacctggtccaactttatattttagcttgatcctacacctttaaaatccac

SEQ ID NO: 243838 - DNA, 355 bp, Homo sapiens
gcatggtaacacctcaaaatcaagcatccagcagctgaatccgaaaaacacaaggaacaaggtggtctcaaaaatttggagtgaagccagaggtgaagtgagactttctgaagctgcaacaatacctctactctacttaaagcaatttctggtgtcatcaccatgagaaggacataccaccccagaataaggagaggcaaatggattagacttgaaatgaacccagagcctggattcaagcacagccaaacccagcttggatctcataattcccagtcctgtgcagaagaaccgtgagacctacaatatatttccataccttctttcaagaaataaatgctcaattttgtaagac

SEQ ID NO: 243839 - DNA, 324 bp, Homo sapiens
gaagatgctttcatgatctacacatctgtcattgctgttgcttatcaccgttcctgggaatctggcacttcatcagccgtctttctttccatgtaatgaacactgttctccctgactcaggtgtcatcaccatgagaaggacataccaccccagaataaggagaggcaaatggattagacttgaaatgaacccagagcctggattcaagcacagccaaacccagcttggatctcataattcccagtcctgtgcagaagaaccgtgagacctacaatatatttccataccttctttcaagaaataaatgctcaattttgtaagac

SEQ ID NO: 243840 - DNA, 584 bp, Homo sapiens
  misc_feature (6)..(6): n is a, c, g, or t
  misc_feature (15)..(15): n is a, c, g, or t
tctgantcctttgcncctcctactactttgctgcgagaagacgacagaatgggattgatttacagttttaagaaataatattggctgggtgcagtggctcacacctgtgatcccaccacttgggagaccgaggtgggcaaatcattggagcccaggagtttgagaccagcctgggtaacatggtgagaccctatctctacaaaaaatacaaaaattaggcaggtgtggtggcacatacctgtagtcccagctacttgagaggctgaggtaggaggatcgcctgagcccacgaggtggaggttgcattgagccaagatcatgccactgcactcttgcctgggtgacagagcaagactctgtcttaaagaaaaaaaaaaaaagagagaagggaaggaaataatactgagagatccatatacccttccccaggcaatttcttggaatgataacatcctgttactattgtacaataacacaactaggaaattgacattgatacaatccagtgaccttactcagatttcatcagttttacacatactcgtgtgtgtgtgtgtgtgtgtgtgtgtgtatcatattctgta

SEQ ID NO: 243841 - DNA, 809 bp, Homo sapiens
agtgagcctaacagtacatagctttcttttcctatgttagtgagttacattatgtaaagcatattcatgaacttatatagattctgggtagttctgatgatatgaaactaaattttttaaataatttaactgaatattttgatattgcttgtatcaggaatttcttcactaaaagagcatatatgcaacagtgtgacctctttgggctcaatacaaaagtgatttgtacagtgattctgtgattttccaccataataaattgagaaaggcaggtcttggtaaaactttatagtcatgtatgaatacccatattcaggtcttcacctccaagagacattcattttaatttatgtcgttgtttatcatcaaggaagattttgaacttttgagaattggcctttatctgtcctaaacctctaacattccactgtatcttaatgaaacggaggttctgttctttctgcccagggcttctgataagtgtttgcagactatgtaaacttctgaataataactttcagtaaggcaggagtcttaaacctcttagtatcattttgtgcagtattattctgctctgtaagataatgtgttatcaatacttcataagataactttggccagagaatgaataaaatttatagtcactttcaaactgctccctttttttagggtgtgggtcatagatcatgcagctgtctgccaacagataatcttgatgagtaaaaagaagctaacagagaaaaaggtggcttagtctaaaacacttaggaaggacttaaaaaattatttcccaaagaattagggagtaa

SEQ ID NO: 243842 - DNA, 452 bp, Homo sapiens
tgctcagtcgccaggctggagtgcagcggcgtgatcttggctcactgcaagctccgcctcccaggttcacgccattctcctgcctcagcctcctgagtagctgggactacaggcgccaaccgccacgcccggctaattttttttgtatttttagtagagacggggtttcaccatgttagccagaatggtctctatcttctgacccgtgatccacccgccttggcctcccaaagtgctgggattacaggcgagagccaccacgcccggccaggcatacaactttgatgtcgctggggtcaaacttcagcagtttgcccagtttgtaatggggttgtttttttcttgtaaatttgttcaagtttcttacagatgctggatatcagacctttgttggatgcatagtttgcaaaaattttctcccattctgtaggttgtttattgatagtttcttt

SEQ ID NO: 243843 - DNA, 414 bp, Homo sapiens
ctttttattttcctacttctgaacatttgcagagttcctttctgttcaggaccttcaccctaaacatgtactctcctctgcctggaatgttcccttctccctctctacctagctgggtgctcatcagcttgcaggtatcaatttttgctgcctgctcctctgtaatactcctatgtacttgtctaaatattcataaaattagaaataagttctattaataatcataacacatatagaagcaagcaaattgccttgctcctagtagatgctcaaatatttattgaatacatgaatgttaaggaaggtcatcaattaggacagtgtttacatataagtaataaaaatgaattgtggcttaaacagtttactcttatcgcataaaaatgtctggggttaggcaatgctgtacacggt

SEQ ID NO: 243844 - DNA, 361 bp, Homo sapiens
tgtaaatttgcatgagcatatgcagatgaactgatttactacaaaatgttaatggtacttatctctaatttgcaacaaatgtgtataattttaaaattggggaaagtattttcagtttaaaaataagggagcaaaacctaatcattcactcaggcatagtaagataaagttaccacatatgtaaaaggtggtctgaaaggataatgcatagtgccatgtccaaaactatcttcttaacctgtacaatattaagctactaaagagttcagtgaagaaaaaaataaatgcattgcagtcaaaagacataaatgaggagcaaaacaatggaggaaactaataaattaatacatctgcggtgctg

SEQ ID NO: 243845 - DNA, 682 bp, Homo sapiens
gttccttagatcctgggatgaggaggtggaccagcagaaggtgggcttgtgaaggcagcccggggtccaaatcctcctggctcttcagcttagcgggttagttaacattcagaagccttcatctcccatctgcaaaatgggcatgtccaactcagaagctgccttgaagaaagggtctacccagcatggtgcgtggagcctaagcagtcagtacttcaggacttcacccggcccctttccaataactgctgctgtcgccctcacaggatgtcaccttcagcgtctgaaagctgggtttgatgcgtctggaaaggcgtccctgacaggcgtcgttgccaggagcccctagtgccaccagcagccagcaggggagggcgtcctctgcccgctcacttctgacccttctctcgttgcacccggaacatggtgcagctgggagcagcctgggctgcgcggaaggctcagatttggggacggcccttgccagtgactgtgagctggggtgtcttggaaactcccagtctcagcttctccatttataagatgagaatgatcataccagactcaggcaaggttgtttgtgcattagtgaaatcagacgtattaaataaagtaccacattgatcgtggagttgttgaataaccaagaacacgcctatctgtctccaaaaaataaatgttg

SEQ ID NO: 243846 - DNA, 512 bp, Homo sapiens
gttccttagatcctgggatgaggaggtggaccagcagaaggtgggcttgtgaaggcagcccggggtccaaatcctcctggctcttcagcttagcgggatgtcaccttcagcgtctgaaagctgggtttgatgcgtctggaaaggcgtccctgacaggcgtcgttgccaggagcccctagtgccaccagcagccagcaggggagggcgtcctctgcccgctcacttctgacccttctctcgttgcacccggaacatggtgcagctgggagcagcctgggctgcgcggaaggctcagatttggggacggcccttgccagtgactgtgagctggggtgtcttggaaactcccagtctcagcttctccatttataagatgagaatgatcataccagactcaggcaaggttgtttgtgcattagtgaaatcagacgtattaaataaagtaccacattgatcgtggagttgttgaataaccaagaacacgcctatctgtctccaaaaaataaatgttg

SEQ ID NO: 243847 - DNA, 631 bp, Homo sapiens
gttccttagatcctgggatgaggaggtggaccagcagaaggtgggcttgtgaaggcagcccggggtccaaatcctcctggctcttcagcttagcgggttagttaacattcagaagccttcatctcccatctgcaaaatgggcatgtccaactcagaagctgccttgaagaaagggtctacccagcatggtgcgtggagcctaagcagtcagtacttcaggacttcacccggcccctttccaataactgctgctgtcgccctcacaggatgtcaccttcagcgtctgaaagctgggtttgatgcgtctggaaaggcgtccctgacaggcgtcgttgccaggagcccctagtgccaccagcagccagcaggggagggcgtcctctgcccgctcacttctgacccttctctcgttgcacccggaacatggtgcagctgggagcagcctgggctgcgcggaaggctcagatttggggacggcccttgccagtgactgtgagctggggtgtcttggaaactcccagtctcagcttctccatttataagatgagaatgatcataccagactcaggcaaggttgtttgtgcattagtgaaatcagacgtattaaataaagtaccacattgatcgtgga

SEQ ID NO: 243848 - DNA, 157 bp, Homo sapiens
ctcatctgaaggatctttgatggaggaagaagacccagactcatctgaaggatcgtcagaggagggtgaggaagactaattaaacatggagaaaccaaattggacaaatcctcaccaccaacggtgatgattacaataaaatcaagtttgagaagct

SEQ ID NO: 243849 - DNA, 346 bp, Homo sapiens
ggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatata

SEQ ID NO: 243850 - DNA, 281 bp, Homo sapiens
gatatttaaaattacactcagcttgggagaaaagaacattgagtagtgggaaaaagtctcacccacagctgttatacaaatgtacagacaaatgtctggagaagatagcatgttttcaaatattttcgtctctttgtcagtctctgccaaatagaccctcaggggctctctctgtctcttggatgaacactctcctgagggcttggagacatccacagtatgagttaaccacccactgcagatttaataaatgttcaaataaatgagattgaatgaaaaat

SEQ ID NO: 243851 - DNA, 409 bp, Homo sapiens
ttttctttatatcttgaggataggaggagtgcctgttttgttcaccactgtttccttggcactctatatagtagttggcaaatagtaaatactcaactaatattcaattaatatacatataagttgtttttgttaagtccacatttatctaaactattgggatccaaatgttatttaatggatttttatttaggtaataattttgctcttcagtttaccatgggcctgtagggttatacattaaatttgataattctgtcatttaatatagctatattgctgtaaaataaaatgccaaaataagccactaggaagtaggtcaaatccaaaggtgataactcttatttttgctggtttatattcatggattcattgaataaatatttatcgatttctgataagtggtgtg

SEQ ID NO: 243852 - DNA, 821 bp, Homo sapiens
ctgccactctctgccatacctcttttctttcagaagtatatagtatccaaatcaggtgccttttcccaaaaggctccacagacacttcatccacagtacagaatatagtagctattaagttgcacagcaggtctctcaccagtaggtttataggagattcaggagaaatgaagaacacatgttcctcagtcaaaggacctatctctatgggaattacagaggaaaggggacaagtagaaggctgacccaaaatatccataacctgaattaacctgtcaccagatgggaaaagttactgacacattacagtccactagttctcacctttgtgattccctcaatttgtcaattttgaaccacttgacaagtatttcctagctgaaagttttgttctaggctctcctaattctcttatctttgcagtctctgcatcatccagagtgtccttctgcaatccctcttccaacaccctggcttattgcaataacaacatacagcctcccatctttctttcttccccttctggattggtcattgtaggattattcccttcagtaaagagttctaactaagcagagaacacagcaaactttaatctcttcttttctttttttgttcttagattatcccaaaactgagtagctgctgctaagatttgggtaatagtttgcctttgccatcctactaccttttccttaacttgggtttggatagtcagtgagagagctaaaataaaggtggttagagccagagggcaatttttatatgaccttggatccatgccaataaacttttagaatgtctgaacaagtcacgtcgac

SEQ ID NO: 243853 - DNA, 370 bp, Homo sapiens
ttccacactcagtatataattcttgaatgaaaaagagaaatgaatcaagggcctctgattccatgaagccctccccaactgcccaccacccatgacatacatcacttaagcagattgatcattcctctcctatcccattaacagtttacatttcttgggcaggcagtgtctaagacctttatatatgttgtctgatattatttgtcagggtctcacgagggtctttagaacatatattaaccatgcattcatgtaagcatttataaacagccttacaagtagaagaattccaagagtactcttttggaatttagacataaaacattataatgccttttggaacagctaaagtcaggtaacacccaattcc

SEQ ID NO: 243854 - DNA, 409 bp, Homo sapiens
cacaaatttttcatttaacacagttgaatatgatttcatgactaaggttctcattgctgagttatcattcttcagctggagaaggggagagggaaggtgcactgattcccaaagatcccctggcatattgtgaagcaagattgaaagatgtatcctggaaaaaattcattagtttgactctctttttaactgcattcctataaattgagactctactcatttaaggtggttatgagaattgagtggatataatgggatacagagggtggcacattgcaagctttgatgataaattatggatgttatgatatgtatgtactttcatttgtaagtaatgatttttataaaatattatgatacatttctaggctgaccttgaaggagaatactaacataactttggaaaacc

SEQ ID NO: 243855 - DNA, 593 bp, Homo sapiens
aagcaagtcaagatgttccaaacagaaggacctgccagaggcatggaggccaggaagcccagcatccattcgggaaggtcatctcaaatgtaaacacttagaataaggtaatgaggggaatgatgacagccagccctcccgtctccccagaacctccactccaggaaaagccagtcctccccatccgcaggctctgccgggcctggactcgactgtttgctgggcttctctctcaccagcacctcccacgagttggtcccagggagtccctccaaccgtcccctgcacaggcttcagaccgagagatgcagaatctctcagtaaccattagggctgcctgtgccctgccggtgctgcagggttggcattggaaaaaacaccttcctccggctgggtgcagtggctcacgcctgcaatcccagcactttgggaggccaaggtgggcggatcacgaggtcaggaaatccagtgtggacttgagcctgtagtcttagctacttgggaggcagaagtgggaggatcgtttgaggccaggaattagaatctgcactgagttatgatcttgccctcactccagcctggacaacaagcgg

SEQ ID NO: 243856 - DNA, 452 bp, Homo sapiens
aatagaatccccacaaacaatgttacaccacagaaaatgttaccttcagccatcctcaaataaaatgctctgtttatccactgtcctaaaatactctcagctgctaatatgcctctgcagaagtggctgattttgagaaattttttattatagaaaattcacgaggagctgaaaaactgacgtgaaataacctagaacagtatgattttggggtatatgtccttagataatttctcagtggagcaaactctattgatgacaacaaattctgctttttcatgcatcatttgggatattggcattgtatgtcccctggggaatatcaattacaccatcatattggcttaaggaaccaataccttcctcctacacaggcagaaggacaaacatgcattgtaccaagagcctaaaactgctattgcctgctaggtctgtgcatacaggaaggttgt

SEQ ID NO: 243857 - DNA, 426 bp, Homo sapiens
tgagaaaattcttttctattacttctttggctatttctttcctcccttttctctgttctgtttgtgataattttattagttggatattgaatctcttaaattgatcctgtattatatatttccctaaaaatcctctgtgctctgccaaccatctcttcctccccctaaccccctggcaactactgaactttttagtgtctccataattttatcttttccagaatgtcatatagctgtaatcatataataatttgtagccttttcagattggcttctttcacttagcaatatgcatttaagtttcctgcatgtcttctcacggtgtgttagcttacttcttttcaacactgaataatatgcaattgtctggatgtaccacagtttatttatccattcacttaataaaggacatgttggttgcttcca

SEQ ID NO: 243858 - DNA, 460 bp, Homo sapiens
ccagctggcatatccgaatgggctgagctaccggattaagagggacaccccaaagcccccattgctgggttattgctccagagccaatgttcttggggaaaggaagatatgccctttgtcaacattgccactgctggtctgtaaactcctagacggccagctggtggttcacaaaccaggactccttgctctggccctacccctacctaccagaatgaccgtgaacccttccccactcactcctacaaccaggtttccatctcctctctcagcttaggtttccctaactgtaaaataaaagggttggactaggttaaggacttcctgctatttctctctcccacactctaaggttccttaggaatgcttcagaaaacagcaggggttggggcaaggatgccacttgagtcccagagcaactccaatttcataggcacataaatttatgtgaaagtatata

SEQ ID NO: 243859 - DNA, 363 bp, Homo sapiens
cacaatctaaatgtatccacacacagaaaaagtacagtaaaaatatgatataatctcatgggaccactgtacattgtacaagcagtctgtcattgaaacttcattgtgcggtgaatgactaaacttgtgggcttaaatgtatacaataatgtaaacaactaaaatggcatgtaggtggagaacagggtaaaggaagttaaagtattctaagatgcagacattgtcagtactactttaagaaacccactaacaggactgtataactaacctccaaataactgaggagaaaacatgatttattttttaaaatgccccagtacaatgccacttcctttcaaagtaggaagaaataacttgtcaaaa

SEQ ID NO: 243860 - DNA, 412 bp, Homo sapiens
caaatattagaaagtagtggacatcattgctaagatttataaggatgtactgttaatgtattacccaccttagttttttttattatacttaaagtaagcctgatttaaatatcattaatatgtataatatgtatattagtatgcatgtgggatttctttagaatgtatcatctgtcgtattttaagccccacatgattgggaagatgaagtggagatatgctgtgataagcacacaaaaagtacatttttgcctattttcttctttcctctgttctttgtttctgtcttttcctttcctactctactcagagtagaaagagaattgcttgaacccgggaggcagaggttgcagtaagccgagattgcaccactgtactccagcctgggagacaagagtgagactctgtctca

SEQ ID NO: 243861 - DNA, 444 bp, Homo sapiens
ccccagtccttgttcctttaagtttagatctctttgtaagaatataaacttctaactctgcccatagctccccatgtacttttcaggtaattctatctttagtcatgaaagttgatgttcccttaggattcacgcttcttttctcagcagtatctttagccaaatctgaattaatctgttcagaatgaacaagcagaatagtctttggatttgatccaaatccctgaagcactttgggaatgagaatggctatgccagacagagagaccctggcgacttatgatactgcagaacacaacaggcacttcagattggtcccaggtaaggcttctccaccactgtgtcacacacttctctttattctttcacttgtctgacaaataacagttgaatccaatatctacccccaaagcccccttttaaggacagactaaacccgtatga

SEQ ID NO: 243862 - DNA, 606 bp, Homo sapiens
ccccagtccttgttcctttaagtttagatctctttgtaagaatataaacttctaactctgcccatagctccccatgtacttttcaggtaattctatctttagtcatgaaagttgatgttcccttaggattcacgcttcttttctcagcagtatctttagccaaatctgaattaatctgttcagaatgaacaagcagaatagtctttggatttgatccaaatccctgaagcactttgggaatgagaatggctatgccagacagagagaccctggcgacttatgatactgcagaacacaacaggcacttcagattggtcccaggcaaaagaaagcagtatagagatttattctcccactggcatgaaagctgtgattctgaccaccttctacatcactgtctaccacccctacaccagctcttagaagacagagtaactacaggatgctgtggtacctggagtgatgccagactgcagaggccacctggtgacatgaggagagattcaacttaacatggtgaggatggcagagtagagctaaagtggaaaaagcatttccctgatgaatttaagaagctactgaataaatatgtctggaagtacctaa

SEQ ID NO: 243863 - DNA, 390 bp, Homo sapiens
aaccccattttctgatgaccactagggttccaggtatcagcccataaagtgagctttttctgagaagaacgaaagatggcaggtagaaatgattgagctggtaaagaagactgaggcttattgttaaggtctggggcctaaaaatgtcagggttcaaagtgatcaatttggaaaataaagagatttggaccctcctctgaaatcagggagtagtgaatatgtggagtcagaaagtaactgcaaattctggagaaactgtggaagcagcattttgtaggagggtgggggaaacaacaccctcaactagtatttctaccttctggtaaatctattactttaactttacctctgccagtcaataaaactttttcatgttttggtacatttaaa

SEQ ID NO: 243864 - DNA, 629 bp, Homo sapiens
ggtgactttctttggtaactggaattgaagaaaatgagtggacttgtgtctgagcacttgggaactcagcaatccctgggtgttaccttgagaaggagccaaattccagacatacaagtggagacttgaaaatggaagctcaattccacacccaggctggtggagactatgacatataactcacatcttcaagaaagtagacacctcagaggtcactgggccactttaccttccactgtcaaaactatgtccatgatcagatacctctgttgctagggaatattcagtcagaatgggctagattaactgcagtaatgcagatctctcaacccatttatgacttacgcagcaaagttcctcgctcagactacctgtccactcccacgagcagagacttgctcatgggccctcctagacccaggctgaccgagtgtgttttatctaaatgcatctccacaatcactcaggtaggagtggctatgcattaggactgattgtgcattagttagagaagcacttaccaggaattgctataagaacttctatttacatttcatgggccaaagcaagtcatgtggcaacacttaatttcaaagaggacaggaaatgcaatattgttatgtccctga

SEQ ID NO: 243865 - DNA, 301 bp, Homo sapiens
acagagcgagactccagtaaaggcacaggctgggagtggtggctcattcttccagcactttgggaggctgaggcaggaggatcacttgagcccaggagtttgagaccagccgggacaacatcttgagaccctgtgttaaccaaaaataaaaaattagccagttatgatggtgcatgcctgtagtcccagctactcgggtggctgaggctggaggatcgcttaagctcaggaattcaaggctgcagtgagccatgattgtgccacttcactccagcctgggtgacagagtgagactgtctca

SEQ ID NO: 243866 - DNA, 650 bp, Homo sapiens
gggaccagtaacaaacactagcttattttattgccttctaattgaattaaacttcagcctttttgtcattgaaagtaagaacaaatataaaaataatattttcctgggatgttttaaatttctacctgaataatggaacctccagatgcaaaataggaaagagtggtgcaactgatattgacaaataattggatagttatttcttgttttgctaaaatatttttttcctgatctgtttaattaactagaaggttccctgtaagaagtaaataagacattactatttcaactgatagtcagtgagaactgaatttaattaagcagcttttgaatttgtagttgaatctttttccagagcccattattactttatgttaatggacactaatacttttagaatactagaaatttcccttgtagaaaagttatgaaatacattattattggcacttgcatagtctattgcatttccaaaccatctactatcataggtctcgtataaagaatggtaacagctatggttaccactggttttaagaatatgtttcgtagataagtgatattattttgaaaatatgagactaggtttaaaagtttaaaacttcaaatcttgaaagagttcggattttctcttagaagacatttgaaaa

SEQ ID NO: 243867 - DNA, 1010 bp, Homo sapiens
tggcacatctggcagtgtctacagacagttttggtggttgcaattgggaagatcttacaggcatctattgagtagaagttgaagatgctgcaaaatactctaggacagactcccttcctacccaaacaaaaaattacctggccccaaataccactattacagagtttgagaaatcctgctttataataaagctcacactttgcaagcctcactaaggcactcagaacttccattcagcttttaagtcccactcttatatatgagtagaccagcaaggattaccaagctgaggagagcctttaacacaatgtatagaggtcaaaacaaatagagcagcaaaagcagcttggaggaaactaactgcaaggagaataaaacttttaaaaagtgaacatatccgcagagagataggaagagatattgtaaccatgaaataatatcaggatgttattattttcaaagaaaggtattcttagcagaacaaaagagagctattggaattttaaagctattaccagaaatgaaaaacccagtagaagtgtcggaagataaaggtgaagaaatctctcagaaagaaaaacaaaaagaccaaggatggaaaattgaggagaaactaaaactagaggactagttcaaaaagccctctatcacacacactgttatatcatgcacactaatacaataatttcagaaagagtatagagaaaaatctgtcctttaaagtccttcaagatttggtctcttcctattatttgttcattcagagtttattgagtcctactatgtacttggtactattctgagtgctaaacaaaaaaggtatggtttgtgcctttgagaacttacagttgagtgagggaaaaccagatattgagttaatagtacacttgtgggccaagtgcagtggctcatacttgtaatcccagcactttgggggaccaaggcggcagagtcactgagctggggagattgagaccagcctgggtaatatagggagaccccatctctac

SEQ ID NO: 243868 - DNA, 369 bp, Homo sapiens
gaaattctaagaaccagtcaaaaagaaatgctagaatccaaaaacactttaacagaagtaaagaatgcctttgacagactccatagtagtctggacacagctaaggaaatagtctcttaacctgaggatacctcaacagaaatgtccaaaattgaaaagcaaagagaaaaaaaactggaaaaaaacagaacagagtatctgagaacagagagacaacaacaaaaggcgtacatgtaacaggaaaaccaggagaagagggaacagaaagaaatatttaaagcaataatgactgtgaatttcctctaaatcaatgtcggataccaaccacaaattcgagaagctaagaaaataccaagcagaataaatgct

SEQ ID NO: 243869 - DNA, 413 bp, Homo sapiens
tcggggcacggcgggcacgaggccggaggagctttcggtggcgcgaccccgctggcatgctcccggcctcggcctcggcctcggccttggcctccgggcctccagcgcacgcggggcgtccagggcctcatcttcccctggggaccgcccggccgtgtcccgctgccctcggcgcaggggtgggagttgcagagaggaagagtcgctaacccggagtgtttcttaaaacttggctgacctgtgacctgcggatttggaggctgaattctccgagcacctgtgcggtgtgcacttgcttcttgcaagacagcttttgtacctaaccacattcattttgatttggtttaattttggatggcactatggaaagtagctaaaataaacaggaagctactgcaggatataatctaaga

SEQ ID NO: 243870 - DNA, 351 bp, Homo sapiens
tcggggcacggcgggcacgaggccggaggagctttcggtggcgcgaccccgctggcatgctcccggcctcggcctcggcctcggccttggcctccgggcctccagcgcacgcggggcgtccagggcctcatcttcccctggggaccgcccggccgtgtcccgctgccctcggcgcaggggtgggagttgcagagaggaagagtcgctaacccggagtgtttcttaaaacttggctgacctgtgacctgcggatttggaggctgaattctccgagcacctgtgagtgacagcccgtgaatgggaaggtccttcggcaaacgccctttttgtgaataaaatacataaaagcca

SEQ ID NO: 243871 - DNA, 403 bp, Homo sapiens
gcccagggatctggggagaataaatctcaatgaaatgttttttatcagggttctgctgctctacaaggaagatgtgcaggttaagctggacaaatagcaggctgagtgcggctgggcttttcccagtctccagggaggactcaggattgagctgcagggcctggtgatcatcccagcctcaaggcaagggcacagctgcgatcctgcttgatctcaccctgctttgtctgcttcctgtggagagctcccgccttgagagtgggaaggaatgtgtgatcatccccattgtacagaagggaagagtgagacccacagtgactaagtgagtacagagagaatgaggaagcagaaaaggaattggattggggtctgggcttctggtccaggctccaccctaacctgc

SEQ ID NO: 243872 - DNA, 352 bp, Homo sapiens
ttcatatcaatcaatgaagaaaaagcatttgatgaaattcctactcatttatgataaaaactctcaaaatcaaagattaaagactgccggaaggaagcttatctaaagtttgttctctccataaggcacatcacatcacaatgttgtgctaaggaacaccagatggcacttcagtaatgtgcttagggtccagtttgaacagagaaatcaaaaacaaaaagcacaaatatgtggaaatgtggcactaaatagaccctggaaagcacacttgtttacattgagaactgaaacagggcagaccattgctttgttcaactttggttgggaaggtgtatgtcggatgactcaactt

SEQ ID NO: 243873 - DNA, 325 bp, Homo sapiens
tgtatttttattagagacagggtttcaccatgctggccaggctggtctcgaactcctgacctcgtaatctgcctgcctcggcctcccaaagtgctgggattacaggtatgagccaccatgcccggccagtagataacttttaaaaatgtttttttaaaaagactatgagatatttaattggaataaaactatcttgtgtaaaatgaatataattcgtgacacactgacctttatctttcataacacaaatgatttgaaacggtcatgtatttttcaccacgcctaaataaagcaatagattaacaaccatggttctctagcctac

SEQ ID NO: 243874 - DNA, 405 bp, Homo sapiens
aatagctgtcacaattaatactgagtatgtgctgttctatcatttttggcaaggattggtgtttcatcatttagacacatcaggtacttacattgcagtgtcatataatttaaattggcattgtttaaaatgatgaaaaaataacaaagtaccaatcagaaactaaattttagtacagtgggaaggattcatccattgaattggattgatagaagatgagacagcaatttaatagagttttgttcatcttttcctttcttggttgactaacactgacatttttgaggtcttttatttctacagaacgttctctgcagtctcctcttcaaatacggctcttggctatgcttgtgaattttgtgaatatacaattatttcaaattaaatactaactgaatgtggcta

SEQ ID NO: 243875 - DNA, 440 bp, Homo sapiens
tgttattaccattcaatcattttaaaaacattttatatttttagagccccatatgttatttatgggctcctccctgcattccacctcttaagactccattaactctcctgtgaatgcgaggacaaagagaggaggatgttgtttagtgtcacaaactggaaaaccactaagtctccaatctcatttgcattgcctggatgtttagcaatgccaaaataagcactggactgtaagacaaagacctggcttttagtgccagcagaactaattactaatcctttgactttcggcaagttattaacctaatgtgaagtgaggatagtaattatttgccctgcctgcttcacaggtagttgaacactaagagaaaatatatatgtgagattgttttgtaaactgtttaagcactttgcaagtataaggcatcatctaggactggt

SEQ ID NO: 243876 - DNA, 322 bp, Homo sapiens
tcatcatcatcatcatcctcttgcttgtatgcttttcttaagtaaagtaaaacctactcacaggcccatgttctgccagggctgtaagccttgtgagccaggatggtgcccagagccttgtggaagctgcttcctatcctgggctatctgcagcccgacttgggagttgtggttacttcaactgccataaggcatcctcctcaaagtgcagagcagaccctcttgcctctaaagttctttgacaccacattcacaaattcacaaaggaaagttgctcctgacacagaggcaaggctttggagtgacaagaaacctagagaca

SEQ ID NO: 243877 - DNA, 366 bp, Homo sapiens
gaagctgaggtggaagaatcacgagcccaggaggttgaggttgcagtgagctgagaagataccactgcattccagcttcggtgacagagtgagatcctgtcactcacacaaataagaaaattattgaaaacatatttgctaagcaatgtcctaatgtgctgggaaataaaatgatgaacaaaccctcagtccaggaggagaaaacttagaatccagaaggagaaaaaaacacattaaacaagaaaataattgcaagtgtgaaaggacagtacggggatctacattgaggctcccttattgggaatctctcaaagacagaactggtgttatattgaatccaaggatttttcttattcaccttatctc

SEQ ID NO: 243878 - DNA, 506 bp, Homo sapiens
ggagtgataaaaaatgttaattaatatttacagaataaatggaagactaattttcttcaggttaatatcttttaagaaagaaaaaggataaattatacaacgatcaaaagtatggatcaagaaacatagtttctgttttgttttaagtgaaatttcaccttcatttagccatcataattaattaatcctaacaaaatttatccacttaatcaaaacaaaataatttggtcactgcaattaattttaaaaaatcctctgttacataacactatttttctttgttgttgttgttcaaattagcacatttttttcacattaacatttgaaagaggcaaatctaaccaaaggaaataaaaatattcaccaaaattgctaatatcactgctgctttaaaaaaccacaacagtcattgaattattttcttctttttatcattgtttttttcaatataaaaagaatcactttagacaaaagacagagaccataaaggcaattcgtcttcaaaa

SEQ ID NO: 243879 - DNA, 847 bp, Homo sapiens
aaggcattgatgtcttcattcatgggaagaggatggtagacatcgagatgagtgaggatcagagatgatactctctaggacattttctagatgttgattcttccctcttctgtaggtgtagacgaggtcagccctgtggtcaggactgggggagaggacagttctaactgaccttggggggtttagaaggtcattctcgaagttaggctcactccttacacttgtgcaagaatgcaacagagatagagcacagaagtgagcaagagaccagcctgaccaagcaggaatactcactcattcagcacgtctattgagcacctactatgtgcaaacatcggtgaataaaacagacgtggttctctctcatggagcttcttctagtctaggactgagacaaaataattaaacaaactatcaggtagctattgctgtgtgacaatcaaccagaaaaatagagcaacattcagcaagtgttcattgttcatgcatgtggggtcatctgtgtggctctgtggatcttggctgggtccactcatctgtctaggagtgttgcagtggcctaggctgagatgagtgagatgagttttctctgcttcatgtacctctcttctcccagcagtcttgcctaggcagaatcccatgctgaagactgaattgcaagggagcaagtagaaacacacaaggcttcacatagtctcttctactttattttattggccaaagaaagtcataaagccagcctagattcaaggggcaaggaaatagactctacctctttagtgagagaaatttcaaagtctcatggcgaaagatggatgaaatttcaaagtctcgttgcaaaaaaaaa

SEQ ID NO: 243880 - DNA, 672 bp, Homo sapiens
ggcagcttctgcatgctgattatgaagagtcactgagtggcaagaatatgttcccccagccatcttttggacccaatccattcttaggcccagttcctattgcacctcctttctttcctcatgtttggcatgggtacccttttcagggattcatagaaaatccagtaatgaggcagaatattgtcctgccctctgatgagaaaggagaattggatctgtctctggaaaatctggatctgtctaaagattgtggttcagtttccacagtagatgagtttccagcagccaggagtgaacatgtacattctctccctgaagcaagtgtgagcagtaagccagacgaaggccggacagagcaatcttcccagacacgaaaggcagatatggcattggcttccatccctcctgtagcagagggaaaggctcaccctcccactcagattctaaacagagagagagagaaattgtgcctgttgaacttgaacctaaaaggaccattcaaagtctgaaagaaaaaacagaaaaagtaaaagatcctaagactgctgctgatgtggtcagccctggggccaactctgtggatagcagagtgcaaagaccaaaagaagagagttcagaaaatgaaaatgaagtgtcatattttgagaagtggtagatccaagcagttctata

SEQ ID NO: 243881 - DNA, 314 bp, Homo sapiens
ctgaccgggaaattgaaggagccagcagggtacctccacatgatggaactcttggaaacattcgaaaaaccccactcccattctcaagatgaaaaatacaccaacctggccccgcggtttccatacctagtgaggacacaccggggaggtggtcaggggactgcggtgattatccaccttcacacatacagaggaaatacggcctcagatgcaggccatatgcccctctccttcttgatgtaaatgtttttcattattcctttcaactacagtcacatcagtcagaattaaaatagccttcaaaagtttgaaaa

SEQ ID NO: 243882 - DNA, 434 bp, Homo sapiens
caaaaagatataattctagtaaaattattagactttaaagaaaattttggggggttctagagaaaaggaaccttgtgacttaaaggggaaagacaattagattattgtcagactcttcaatagtaaggattggtgcagaagaaaaaagaataacatgtttaaaatactccaggaaagaaagtgtgagccaaggatttataaccaggaaaattgactttgaagttcacacaaagacttatacacaaaaggttatagcagctttaatagccaaaaactggaaatagtccacatgtccatcaacaggtaaatgataagttgtgatatatccatactttggaaatactgcgagcaataaaaagaaatgactgcaataaaaagaaatgacttaacaaaataagatgaagaataaatttcaaaataattatgctgagtga

SEQ ID NO: 243883 - DNA, 388 bp, Homo sapiens
caaagttttctatatttcctcaaaaagtataattttaaagctcttaacacctaacttgcaaatctcaatacatttacatttggtttatatcacagttggttttattcattatcctattctggcttactagccttaacaccttgagagtagaacctattcttttttttttttttttaaatcccctctcacatctactaccatagagctttgtacatagtggccacccaataaacctttaataaaggatgactataaattatgagggcattttataagtattctccaaactctcataaattttctatccttctcttgagaacagagaggattttgtgtttccttttttccctttgtttttctcttttccttttctgacaactgctagcat

SEQ ID NO: 243884 - DNA, 224 bp, Homo sapiens
tcaaaaaaaaaaaaaaaaaaaattgcctgtggctttaaaaatagacacatattgtcttttttttttttaaaggggtgcatagcattctggtttttgtaactataagtttttttttccacaaatctcctattgaaggacgtttaaattgctttcagttctttgccattataaacatccgggtctttgttattacgaacaatactagtaaacatttttataaacat

SEQ ID NO: 243885 - DNA, 407 bp, Homo sapiens
cagtgatagaaagcagattagtgattgccagggagtaggaaaagaagtatgactggggatagcataagggagatcttcctggtgatgaaactaaaggcatcctgatatatatatatatatatgtgtgtgtgtatatatatatatatatatatatatatatatgtgtgtgtgtgtgtgtatatatatatatgtgtgtatatatatatgtatatatgtgtatatatatgtatcttatatatgttacatatatatgtaaaaattatataaaaatatgttaaaaatgtataaactgtacaccaaatttttaaaagtcagttttactgtataatgtttttagtttaaaaattagaaaaaatacttaaagaggaaaaggcatcaatggattaaattcacaaaatggaaacaaa

SEQ ID NO: 243886 - DNA, 430 bp, Homo sapiens
gagaactagtcacgtgcctctcctagattcaaggagagctgggaaaagcagtcagcctaggaagaaggagacagaggctctaaggcagttgtcaagaattactgcagcccagagaaaggacggggagaatgacagtgattcatcaagaagacttataagctgattgggcaactcatgatcaaagctgtttagctacccaaagggatagcaggataaattacagccagaagaattaacaattttgtaattggcatcttacattgtgaaggctcattccagtcacctgtcactgagcttttaaagtttaggggaaagcatttggcggtgcctgactctgtgtgttcatatcttgctttcaacaactgaaggatgggtttctgagaacaagggtgagatacgtatttataaatgaaatcttttccatgggttc

SEQ ID NO: 243887 - DNA, 928 bp, Homo sapiens
tattgaatggcaatatcaaaaatgagatcagcagcaagatgataaggcagaataaaagttgctgagagcctaaaatgattattcagttctgttgcagggttttaacctgcccaaaggatggaaaaagaagaacataagcataatttctgaatgcatcacggcaaagatgcatgtactcatgaagcataaaattaaaaatatgatacattcactacatgaaaatatgatatacggtttttcttcagtatccgcgggagattggctcgaggaaccccatggataccaacatccttgaatgctcaagtcccttatataaaacggcatagtatttgcataaaacctataccattctcctgtatactctaagtcatctctgcgttacttataatacctaatacagtgtaaacgctgtgtaaacagttgttatactatattggttttttaatttgcattacttttgtattgttgtattattttattgtttttccccaaatagttttgatccgcagatgtagaacccacagatatgataaatcaactgtatctagtacccaaaacagatgagtaacttagaaattaatatgtaatacatacagctaatgttatagctacttaaggaattcctttcactgaaaagaaactcttacaaatcaatgagtcaacaacccaatggaaaaatggccaaaagacatgaatagaagttcacagaaaagaatgaaaatgaccagtaaataatgaaaagatgttctaagacactcttaattaaataaattcacaataaaataatcatacttttatctatctaccagattagcaaatgttaaaatattaaaatgttagtggtcatcaaaatgtagggttacaggttcacccatacactgttaatagatgtataaactggtcaaaactttttgatccatagcacagt

SEQ ID NO: 243888 - DNA, 1138 bp, Homo sapiens
gtggaatgaaaaaactaaagagacaactgacttaccacacaaatggactatggtagaagctgctgtcccttagtattgaatatctctattttcttttaatcatagaattcactgatattttagcagataatgtggccgtccaggcaggcatgagatttctcagccttacttcaacttgattatgaccatgtgacccaattctgacatttgcctaaaggaaaatttacctaaaaaggcgttttcttgctatggcagtgtaacctgtactaataaatatagtgctagtcctgcatgcaacaaaaatgatggttttaacctgcccaaaggatggaaaaagaagaacataagcataatttctgaatgcatcacggcaaagatgcatgtactcatgaagcataaaattaaaaatatgatacattcactacatgaaaatatgatatacggtttttcttcagtatccgcgggagattggctcgaggaaccccatggataccaacatccttgaatgctcaagtcccttatataaaacggcatagtatttgcataaaacctataccattctcctgtatactctaagtcatctctgcgttacttataatacctaatacagtgtaaacgctgtgtaaacagttgttatactatattggttttttaatttgcattacttttgtattgttgtattattttattgtttttccccaaatagttttgatccgcagatgtagaacccacagatatgataaatcaactgtatctagtacccaaaacagatgagtaacttagaaattaatatgtaatacatacagctaatgttatagctacttaaggaattcctttcactgaaaagaaactcttacaaatcaatgagtcaacaacccaatggaaaaatggccaaaagacatgaatagaagttcacagaaaagaatgaaaatgaccagtaaataatgaaaagatgttctaagacactcttaattaaataaattcacaataaaataatcatacttttatctatctaccagattagcaaatgttaaaatattaaaatgttagtggtcatcaaaatgtagggttacaggttcacccatacactgttaatagatgtataaactggtcaaaactttttgatccatagcacagt

SEQ ID NO: 243889 - DNA, 303 bp, Homo sapiens
gtttggtgcccgccgttttaagcattggctctcatttccgtccgcaagctatttcgctgaacttaacgctctgggttgttgaaacggcctatgaggcagaggagggaggggaatcagtgctctcaccacagtccgcggaagcactagcctgggcattgtggtatttagctgggtgtcggcagtctctaggttagatctcattttacccattttctggtagtagtcgtcagttctcttcatttagcgcctactgtatgctctcctaatactacctgctcttcccaaagctcactgattcaatag

SEQ ID NO: 243890 - DNA, 927 bp, Homo sapiens
taaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatacgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaa

SEQ ID NO: 243891 - DNA, 219 bp, Homo sapiens
tgaagaacaaaaattaccaattttgatgaagtgtaaactttagttagtaacatattggctcaccaattctgatcatcatcatatatgatatattggttcatcaattatatgatatatatgatatcatatttacgtactttgggaggccaggatgggagaatcacttgagccaggagttagagatcagcctggacaacatagtgagacccccatctacca

SEQ ID NO: 243892 - DNA, 273 bp, Homo sapiens
attcccctacctccagctaatatgagttatcactgacaactctagtcccactgtaatcttcctgccttatagataaaaattaccaagagatccagtcaccaggttgcctccacttcctgacagcactcaatcaaaaccagtccctttaggccaggcatggtggctcacacctgtaattccagcactttgggaggctgaggtgggtgaatttcttgaggccaagggttccagaccagcctggccaacatggcaaaaccccatctctgcttaaaa

SEQ ID NO: 243893 - DNA, 470 bp, Homo sapiens
atttttaattgtcactgcctatggagctttgtggtgtaagggggaagaatcaaagcagataagcacaacaaaccccaagcgttaaagtatgtaattgttgcatgttcaagttattcacattttgtgaataacattatcaagaataatgagagcaatccatatcaaagaacacaaggaaccagagagcttaaaacatgcccaggttctacttcttaggtataaggatataataaacctagtataaagcctagattatatgtaatcctgtatgagacccactagtctatattgtaaagcttcaatgtttttagcaccctctgtgtggaggaaaataatgcagattattctaattagtgtaatatctaaccacattaaaatatattacatagtaaactacactccataattttataaatttgactccccagggtaataaactagtctctagtctgctcaccttcaactgtaca

SEQ ID NO: 243894 - DNA, 748 bp, Homo sapiens
catatgtctgatgacagaaggagctatgtgaaagcctattcagagttctacagagtgaactaacttcctgtgacattctaaaccatgttactatttcaagtgacatggaagaggttctatgcaaatgaaaaataaaatttgccaaaatgtttctttaaaatttataaagtgttgctttatgaagtaaactagtacacatcttttaaattctataatcttctgatggaattgcagaagctgttggcagagacaagcctctgaccttaggcacacattacaaaagcatgttcctgattctgcttcccagctgtcataaaaatactacttcctcacccaaaatgtagtatagaatttttatcttggaatttttgttaataggatgtcttaaactaatacttcagtatctgttctagacctctctccttggcttgtagatgattgccttcttcctctctctcttccccaggtctcttcacattgtcttctctgtgcatgtctgtctttgtgtccagatttcaccttataaggatttcagtcatcttggattaaggcccaccctaatgaccttatttgaatttgattacctctttgaagaccatgtcttcaaataaagtcacattctgaggtacagaaggttaggacttcaacatttgaattttggtggggggggacacagttcagctcataacaccaggtgctaggacagtgcctagcacacagtgggcacccagaaatgttcagtgtggct

SEQ ID NO: 243895 - DNA, 349 bp, Homo sapiens
tgagaaatctttctctcccacctactctgtctgttgaattccattcctcccaatatgtatttaagtctctatcatcttaaacataaaagccctcttcttacatgatgccttatccttgcctcttttcacacagaagtttcttgacaaatagtctttattgtctcagtttcctcaacatctgtttagtttttatactctataatctaactttgagctaagtaattttattgaaactgcactgtccaagttaccactgagtttttaattgtcaaattctgagattctccttttcatttcatatcttaattgatctctggtcatgtatatgtttaatgtggttggtgactcc

SEQ ID NO: 243896 - DNA, 286 bp, Homo sapiens
gcatatgtaagagttttgtgaagataaatagtagaattgctgggctgtaaaatgtacatatcttaagctttactagatattattaggttgccttcctaagtgttataacagcttatttcctctcccccagccagggtaggtgtctgtttctattgtcattatatgtgcttttgtcagactttaagttttgccagtctttcagaaaaatttttcctgtgcaatttttctgcttaaatttttttattggtttctcgttacttataaaatgaattcttgcttatgatga

SEQ ID NO: 243897 - DNA, 591 bp, Homo sapiens
tgttttgagactactagtctataagtcatcattctttgggggctgagctacattgctggtgggattatagtgatctcctcccagaggccagcactgccaaatgcagcttgtttcatgcctttctctgatttattcaccatccgcggtgttggttgggagcagcccggaggagatgccgattgcccttggcttgttgtcctgaagagtctttagttaacggcctggcagtgatgcttagggctgataagaatgctgactcagctcgaggcggccttgccacatattctggctccaggctctctccaggagagatggatgataaaagaaggtgaggttcgaggccacatctatgggtgaagaaatgtttgatgccagactttggcaagtggtcagaagggctttacttcaaatcaagaaataaccatctgagaatgtattaaagtaccatcatatttgaaatatgcctacttcaaaatatttgcatttatgaaacttgaagtcatgagaaaataagccgaaatgcctgctgacaacctatagcaagttttagataacaactgagctaaattaaaaaaaggacaagctttaaaa

SEQ ID NO: 243898 - DNA, 859 bp, Homo sapiens
ctctgtcgcccaggctgaagtgcagtggcatgactcagcttactgcaacctccgcctaccaggttcaagagattctcctatctcagcctcctaagtagctgggattacaggcacgtgccaccacacctggctaatttttgtattttttagtagagacggggtttcaccatgttggtcaggctggtctcaaactcctgacctcgtgatccacctgccccagcctcccaaagtgctgggattataggcgtgagccaccccacctggacgatttctaaggatttttaagacattaaagtcaatgtctctttagtaacactggaaatagaatcccacccttttcatttgcctttacgttttctttatggtgtttttgatgtgtagaaaaatttgattccttaatgtatacacatctatcagacattttcttcatgctttctcgctctagtgatatgcttagaaatatcctccctatgttgaaatttaaatactcatttttattttattttagtaattttaactaaactactttttagttgttacattaataaaattatatattatatattaatgaaatctttatttaaataaatatttaataaaatatatatccaatgtatatttttatataaggtttaaagaaagaatctaactttatattattttcccaaacgatagctgttgctttcaacaccatttattgaataatcatcccttttctcattgaataaaatgctacttcagtcacacacacacacacacacacacaaatacataaatgagtcttatttgaaatctatagtctatccaaatcaactttatctaattcttcatttgagccaccgtcctaattcttacaata

SEQ ID NO: 243899 - DNA, 386 bp, Homo sapiens
tgttcttactttttttaagataaggtcttgctctatccttcacctcccaccctcaagcgatcctcccacctcagcctcctgagtagctgggactacctgtgtgctgccacacctggctcatttcattcattttttgtagagacgaggtcttactatgttgcccaggctagtcttgagctcgtgggctcaagggatcctcctacctcagcctcccaaagtgctgagattataggcatgaggcactgtatttgtcttcttgttatagttaaaaaaaattaaaacagccaggcatggtggctcacacagtttgcaaggctgaggcagggggattgcttgagaccaggagttcaagaccatcctggccaacacagtgaaaccctatctcc

SEQ ID NO: 243900 - DNA, 686 bp, Homo sapiens
ccacctaacttggactggacgtcctcttccagggaatccagccagggccaattagaaatgtgtcttaaattggtgtcagggtcaccaaaaacaaaaacaggatccatgggggcctgtgaaacttcgagtgccattcatgctcggttcagtcatctgacttgtcaggatgaccagcagtgctccctgtaactcgccattatctgaccaattactggagctactttataatgaggcttctggagctactttataatgaggcttctgtttgctgtcatggtggggagtttggaattgtggcttcttgcctaacaccaatgagaggactttgggacaaacccccagagccaggagtgttttgaggcctagtggggttgggaacaaagggtcaagtgtcgagggagtggggaaattatgggttggggacaggtgtgaacagtgggcttgggggtggcccaagagtactagaccagagaggtccagtgccacccgcagcctgcagtgatactagacagggggcggctgtgtggaaccacagatgacatcccttctcctcttgatggaagtggaggctgcatctgagagcttcccagcctagattctggtggctgcatctgagagcttcccagcctagattctggtgggattggatctgggagggggaagaccccaaaaagcaaaaaaaaaaa

SEQ ID NO: 243901 - DNA, 400 bp, Homo sapiens
taattttggtgacaattttctctccaggaagcaaatgtcctcaaggaccttcatgtctcaggaggaaacaggtgtacccagatacaaagctgcaaaggaaggcctggctgtatggttagctgcaaacagcaatagagaacaaactgtgccaagatatttattagtagagttgtttttatcagggctctacttaaaaacttcttaatgttttgagtggtctgcccttgaccctattttttccataaaacttgtgatgtatgattttgctgaacatgagattttttaaaaatagaaaattgtgccaggcgaggtggttcacacctataatcctagcactttgggaggctgaggcaggcagatcacgaggtcaggagatcgagaccatcctggttaacacggt

SEQ ID NO: 243902 - DNA, 308 bp, Homo sapiens
tatagaaatcaaagctaaggagaatttccagaaagggtagtatcatttaatatcatagaagtttaggagcccaagatggaaaaaaggcctctgggtaactgacattgaggcagtctttggggaagctccatttccgatagagaagtagactgaaagtcagcttgaagcagggactaggtgaagaagctgttggctggtcgcatggggaaataaataagggatggcatatgccgtatttctggatttctttctttcttgcccagcctctatatatgcacagagtttggcgaaaacttacaaaaaataaa

SEQ ID NO: 243903 - DNA, 1656 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243904 - DNA, 691 bp, Homo sapiens
atgaagggagctgggacagatcaatctcactcctggaaaccatgactctgatgagggtatcctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243905 - DNA, 564 bp, Homo sapiens
gcctactactactaaattcgcggccgcgtcgacggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243906 - DNA, 164 bp, Homo sapiens
ttcaagcttctaacgatgtgcggggatttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243907 - DNA, 710 bp, Homo sapiens
agtgaagttcacaatttcaaggctaagcttctgattaaagtatcatggttacaaatgtaatataaatggtttaatcagaagcttagccttgaaattgtgaactcttggaaatgttattagtgaagttcgcaactaaactaaacctgtaaaattatgatgattgtattcaaaagattaatgaaaaataaacatttctgtccccctgaaaaaaaaaaaaaaaaaaaaaaaaaaaaaaaaaaaaaaaaaaaaaaagagaggggggggcgccgcccaaaaaatattctccccgcggggggcgcccccattctagcgccgcgccccccgagtttttgttggaaaaagggggcgcccccaatataggggggcggcgtattataaaaagcagaggccgcgcgggcgcgcgcgggttttaaaacagcgcgggagagagcggagaacacaacagcggcgaccctggaggcgatcatcttgggagagaagaaagcacccatcatccccgcggtgggcggggccacacccatatggtggcgaccacacacctccctagcagaggagatattaaaaccgccccaccaggaggaacaaacttaacaacatcacagggtgtcactacggggtcgaaccaacgcgtaatacccgctgcccatagaagaattgccaccacgggctaactttgagacacatttttccgagcctcctatactacccaa

SEQ ID NO: 243908 - DNA, 540 bp, Homo sapiens
ggcacgagcggcacgaggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatgctcaagcctgaaagatgacgtggtgggggatggagcacccataaggatcctctagatcacccca

SEQ ID NO: 243909 - DNA, 1571 bp, Homo sapiens
ctccgggctgtctgagcgccgccgggtccccgcggacctgcgcttggggagggcacgagttgcaaatggcgcgctaagcccgaggtttcttctcttttgcagtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243910 - DNA, 1628 bp, Homo sapiens
tctgcatagtacgacccggtttaatcggccgagggatagtccctctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243911 - DNA, 1617 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattc

SEQ ID NO: 243912 - DNA, 1844 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaaaaaaaacaatataacacaagacaaccacaccacgcaacagacagaaacaacaagcacacactccaacaaaacacacaaaaatacgacggaggcgacagacacatcaaacaccacgagggggcaaaccaaagacacaacgagtcttacaaacgaggcgcagccttgtaggtagcttaaagaaaaagacg

SEQ ID NO: 243913 - DNA, 1701 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaaaaaaaccagaaccatcaaggggcgccccggaacccggcaaggccg

SEQ ID NO: 243914 - DNA, 2301 bp, Homo sapiens
  misc_feature (2297)..(2297): n is a, c, g, or t
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaaaaaaaaaaaaaaaaaaaaaaaaaaaaaaaaaaaaaaaaaaaaaaaaaaaaaaaaaaaaaaaaaaaaaaaaaaaaaaaagaaaaagaaaaaaaaaaaaaaaaaaaaaaaagaaaacacatgacaaatcaaacaacagaacaaagagacggagaaaggcgaggggcggccgccgcctccctcatgtcctctttcacgcggcggcggcgacccgaactatctcgcctctcctttattttttttgtgtgggtaggcgctcctctgttctgtttatcatttttctaccgacggcggcgcgtctcactttcttaaacatacaacaacaaggtgtggacccaaaaaaagccaacagcgcactactacacattagtatctccagacgcacaaccactacacctacatgacggagcagggcgagaaaaacagaagcggagccgagcaccacaaacaccacgcacacaccatgcacgaagcagccgcaacgcagacaacaaacaaaaccaacgcgcggcctgcatgagaccgcacagccgacgataaaacacacgacacaagacacagcagcgaagccaacagagtcacacacccgcaaaggcatgaacgaaaaacacaacacccgacacgcgagagaacagaacacaagngaac

SEQ ID NO: 243915 - DNA, 2731 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaaggtagtagaacctttctttaaattacgtttgggaatccaaagcagactggtatgttgcatgaaagacaaggataagagaacctgattcttgtgttaagtttaaaattttagtgacacgattagagcaatgagttaaaaagcttagcataatgtttcctgaagtagagatgatggctcccaagtgaaagcatgggtattgatgtggctgaggctcttggtgaactcagaagcattatttagtagtggtaacagatgactcaacaaaccaaaccccttgcctatgataataatgtgttctttctgtcttttatcaattccagctgtctttattagtccttcttttatttcatatcagcttttcctttctttatcgtctgttatcaccttatctctgatgctggtttctaattcaggaaagagccaaccaggtcatattgggagtaaagagcccctaggtattagtatcatttttgttctttttaaaacaaggtgctctgtggcctataattacatttagcttaaagtcttttgacttttttttttttttttccagtaaaggttaatgtggaccatgtgcaaagcaagatttcaattgagcagaagcttttagtttagcatgtttgtggtttggctggcccaaaggacactagagagtttacccatgcacttttagcttgaaacattaatttatcatgcatgtctgcatgtgagacaagcagatgcaaagcatgttctgcccttctgtctcggagggagagccatgacagccctgcagccccagcactgcccgtgttagctgatatataccaagtgatagaaactattctgtctagaaggcttgatttgactatagttgttaaagttgcctggttctttgtgttaccagagggaatactgagtgtctgaggttacattggtaggaaactccctgcataacattcctgatgtgaaagtcacagagattacccacttgggagaagagtcttatgaataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243916 - DNA, 2919 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaaggtagtagaacctttctttaaattacgtttgggaatccaaagcagactggtatgttgcatgaaagacaaggataagagaacctgattcttgtgttaagtttaaaattttagtgacacgattagagcaatgagttaaaaagcttagcataatgtttcctgaagtagagatgatggctcccaagtgaaagcatgggtattgatgtggctgaggctcttggtgaactcagaagcattatttagtagtggtaacagatgactcaacaaaccaaaccccttgcctatgataataatgtgttctttctgtcttttatcaattccagctgtctttattagtccttcttttatttcatatcagcttttcctttctttatcgtctgttatcaccttatctctgatgctggtttctaattcaggaaagagccaaccaggtcatattgggagtaaagagcccctaggtattagtatcatttttgttctttttaaaacaaggtgctctgtggcctataattacatttagcttaaagtcttttgacttttttttttttttttccagtaaaggttaatgtggaccatgtgcaaagcaagatttcaattgagcagaagcttttagtttagcatgtttgtggtttggctggcccaaaggacactagagagtttacccatgcacttttagcttgaaacattaatttatcatgcatgtctgcatgtgagacaagcagatgcaaagcatgttctgcccttctgtctcggagggagagccatgacagccctgcagccccagcactgcccgtgttagctgatatataccaagtgatagaaactattctgtctagaaggcttgatttgactatagttgttaaagttgcctggttctttgtgttaccagagggaatactgagtgtctgaggttacattggtaggaaactccctgcataacattcctgatgtgaaagtcacagagattacccacttgggagaagagtcttatgaataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaaaaaaaacaatataacacaagacaaccacaccacgcaacagacagaaacaacaagcacacactccaacaaaacacacaaaaatacgacggaggcgacagacacatcaaacaccacgagggggcaaaccaaagacacaacgagtcttacaaacgaggcgcagccttgtaggtagcttaaagaaaaagacg

SEQ ID NO: 243917 - DNA, 1579 bp, Homo sapiens
aatcccttccagagcggctctagcgactcactccgagacagattcagcaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243918 - DNA, 1573 bp, Homo sapiens
cggcgcctcatgattgtcatttactgtggcgtagcgtttacaaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243919 - DNA, 1249 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctatcaagcctggtaccggctcgattctatag

SEQ ID NO: 243920 - DNA, 1655 bp, Homo sapiens
tgtcgactgcttcggatggggaaggaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243921 - DNA, 1344 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggtgacttaaaagtgtgtagcacctccccattccctttctcttgatcctttcgacataggacgtgcctgctcccccttcaccttctaccatgattgtaagtgtcctgaagcctccctagaagctgagtagctggcatcatgctttctgtagaacctgcagaaccatgaggcaattaaacctctttttctttataaattatccagtct

SEQ ID NO: 243922 - DNA, 1419 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaaggtagtagaacctttctttaaattacgtttgggaatccaaagcagactggtatgttgcatgaaagacaaggataagagaacctgattcttgtgttaagtttaaaattttagtgacacgattagagcaatgagttaaaaagcttagcataatgtttcctgatgggacgaagatgcgccatcagtgatgccccacccagccacggaaacgacatggtttatatatgtggtgtcctggtattcggcatagatgccttcggtgtagttagccagtctttctgttgccattattccacag

SEQ ID NO: 243923 - DNA, 1575 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243924 - DNA, 1171 bp, Homo sapiens
aaggctagtacgaggctggtgtggaatcggccgagggaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243925 - DNA, 1132 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaaccgattattaggggaactagtcagttgccaaagcccaacccggtcagcccctctactggatatatactcaaaggaatacaagtaattctaccataaagacacatgcatgcatatgttcactgcagtactattcataatatcaaaggacg

SEQ ID NO: 243926 - DNA, 1602 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243927 - DNA, 2120 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggtattgcgtggagattaattacagtttgattaaaaagcctgaagttggactgggctgaatctagttaagtaaggtcacttaaaattcttttaataatttgtggtacttgctgattcttactgcgatgattctgactgtatgttgcctgtgcttgtttgtgtttcagaatatctggtctaaattcttaacagctaactcatacatgttttagatagtagtatcttgttcctttcatagaatgatagcggtatcttgttctttcatagaatttaaaatcagtagggtcattattggttttggacagtgctgggtgatgataacgtgaaatagtgcaggattgatcttaataaaagcatattattcctagagaaagagtgttattgaataaccatcaggtggaaccatttttccttttgaatgagaatgctctatagttcagtaatgtgacatattacctctcataggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243928 - DNA, 1574 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggattcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243929 - DNA, 1043 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgccatctattcgatgtacaccggcatacacggcagccccgctctattactatgttctgaagggataaacggccgcccgttaatactctttcctgagtat

SEQ ID NO: 243930 - DNA, 1534 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggagctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243931 - DNA, 1010 bp, Homo sapiens
tagccggtccagacttctgtcaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243932 - DNA, 1481 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243933 - DNA, 1040 bp, Homo sapiens
gcgagtgatgctgaggtgactctagttgatccccgttctccccgtggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243934 - DNA, 943 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgccctgacccgacgacgattccgcacgcccgacgattccggtccgc

SEQ ID NO: 243935 - DNA, 943 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgtgcgcggtaattccggggtaccgaggctcgaaaaccgtacatcat

SEQ ID NO: 243936 - DNA, 1174 bp, Homo sapiens
  misc_feature (189)..(189): n is a, c, g, or t
gcggccgccgggcccggcgggcgcgacgctgcctcctcacctgcgcaagctaggagggggcggactgagtgccatagcccagcctgggctggagcgcacggtctgacctactagaaacatgagcaaccatcgccgtccccagtgacaacactcctcacatactatctggtggaggtgggggatggggantaatgtgacatattacctctcataggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243937 - DNA, 1050 bp, Homo sapiens
tcataggttcgcagggtttgttataatttttatttttatgggctttggtgagggaggtaggtggtagtttgtgtttaatatttttagttggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243938 - DNA, 1481 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgtgtttgacaagtacatgactatatcaggatttcaaattgaggaaaccattgaccgcgagacttctggcaatttagagcaactactccttgctgttggtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243939 - DNA, 687 bp, Homo sapiens
ttcatagcataatagagggtctctgcaaggtagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243940 - DNA, 870 bp, Homo sapiens
  misc_feature (807)..(807): n is a, c, g, or t
  misc_feature (867)..(868): n is a, c, g, or t
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttaatttcaaggctgggagaaactttaaattggggggaacaagattgaaanaaaaagttttaatcaaccaatccttttggggaacaacgaaagtggtggtccccaattttnnag

SEQ ID NO: 243941 - DNA, 844 bp, Homo sapiens
  misc_feature (772)..(772): n is a, c, g, or t
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttattttaagctgggngaccttaaatgggggacagataaaagccaggcccactatttcaggatttaattggggaccatgaccgcagaa

SEQ ID NO: 243942 - DNA, 754 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttggggcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaa

SEQ ID NO: 243943 - DNA, 815 bp, Homo sapiens
  misc_feature (743)..(743): n is a, c, g, or t
  misc_feature (752)..(752): n is a, c, g, or t
  misc_feature (770)..(770): n is a, c, g, or t
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcagctaacagagaccctggatgcctgggaatttggaatggaaaaaaaggnccctttccnaaaaaaggggtttttttnggggaaaaaaaaccccaaaaaggggaaaaattggggcccttttcc

SEQ ID NO: 243944 - DNA, 934 bp, Homo sapiens
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatgggtcaggccggaagataacgggtgggggggcaacctcacgggacaaccgcggaagtgcgggggaccctcagggaacagaacctagtcgggattgggaacccacgttgccgagccagggtaatcaggccgacaccacgggcgccacaaagtctccccttggacccgggtctccaaagggttcacaccatagtactagacaccaccacaccacacacccgcgggacccgacccctagggggcacacacccggatagggcacccacgaaccttgtctaattatattttgaatcagcacactcaacacgaagctgc

SEQ ID NO: 243945 - DNA, 604 bp, Homo sapiens
  misc_feature (601)..(601): n is a, c, g, or t
tgctgcgtctatctagaggatcccggtttcgcatgttcccggggcgctggcgtttccgttgcttggatcagtctaggtgcagctgccggatccttcagcgtctgcatctcggcgtcgccccgcgtaccgtcgcccggctctccgccgctctcccggggtttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaccaagtttatgaagaagaatatggctcaagcctgggatgacgtggtgggggacacttcnggt

SEQ ID NO: 243946 - DNA, 377 bp, Homo sapiens
atagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaa

SEQ ID NO: 243947 - DNA, 436 bp, Homo sapiens
aaccatctgtccctgttccttctgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagagatggagtctccctgtttcccaggctggtcattgactgctggatcatgtgattcttctgtctccatctccccaagttctgggattacagacatgagccaccacaattggctactacttttttaaaaaatcaccttgagtcctatggggccaatatgtttttgaaaactgaatttcctgcccagtaaagaacaaagtcagcatcactattccaat

SEQ ID NO: 243948 - DNA, 418 bp, Homo sapiens
  misc_feature (4)..(4): n is a, c, g, or t
  misc_feature (10)..(10): n is a, c, g, or t
  misc_feature (19)..(19): n is a, c, g, or t
  misc_feature (51)..(51): n is a, c, g, or t
tgcnccttgnggctaattngccgcgcccactactacttatgcgagagcccnacagaaggggaagcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggtaagaatgacaatattacttcccagtgaattagagaac

SEQ ID NO: 243949 - DNA, 2314 bp, Homo sapiens
  misc_feature (4)..(4): n is a, c, g, or t
  misc_feature (10)..(10): n is a, c, g, or t
  misc_feature (19)..(19): n is a, c, g, or t
  misc_feature (51)..(51): n is a, c, g, or t
tgcnccttgnggctaattngccgcgcccactactacttatgcgagagcccnacagaaggggaagcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaata

SEQ ID NO: 243950 - DNA, 2438 bp, Homo sapiens
  misc_feature (4)..(4): n is a, c, g, or t
  misc_feature (10)..(10): n is a, c, g, or t
  misc_feature (19)..(19): n is a, c, g, or t
  misc_feature (51)..(51): n is a, c, g, or t
tgcnccttgnggctaattngccgcgcccactactacttatgcgagagcccnacagaaggggaagcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaatactcactgatgcccaactcttctatagattgagttggtttaagaggtctactttgtattgcaagcattgttgtttctacggattagcgagcctgttcttgattaaaccaactagatgggagcttg

SEQ ID NO: 243951 - DNA, 2147 bp, Homo sapiens
agacagatgagggcagcacaccttgcagggcaacacagagtggggggaacatccaggatgcacattcaaccagcagatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaata

SEQ ID NO: 243952 - DNA, 2726 bp, Homo sapiens
  misc_feature (4)..(4): n is a, c, g, or t
  misc_feature (10)..(10): n is a, c, g, or t
  misc_feature (19)..(19): n is a, c, g, or t
  misc_feature (51)..(51): n is a, c, g, or t
tgcnccttgnggctaattngccgcgcccactactacttatgcgagagcccnacagaaggggaagcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaataaaaaaaaaaaaaaaaaaaaaaaaaaaaaaaaaaaaaaaaaaaaaaaaaaaaaaaaaaaaaaaaaaaaaaaaaaaaaaaaaaaaaagaaaagaaagaaaaaaaaagaaaagaaaaaagaataaaaaggagagtaaaaaaatggtgaaaagtactggaatggaacaacaagaaaacgaaacagaaagacaaaagagaagggagcccgggacaccataaagcaaaacaaaacagagaggaaaacagaagacacgccaacccacaccgacacgagagacgcggcagagaccagacgagaacaaaaagagaaaacgcgaggggcgagctaggaaaagagtaacacaaagcagaaaaataaagcgaggacaaaagaagagaaaacacgcacgggaaagtgaaacagaaacaaaagaaa

SEQ ID NO: 243953 - DNA, 655 bp, Homo sapiens
  misc_feature (4)..(4): n is a, c, g, or t
  misc_feature (10)..(10): n is a, c, g, or t
  misc_feature (19)..(19): n is a, c, g, or t
  misc_feature (51)..(51): n is a, c, g, or t
tgcnccttgnggctaattngccgcgcccactactacttatgcgagagcccnacagaaggggaagcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagagatggagtctccctgtttcccaggctggtcattgactgctggatcatgtgattcttctgtctccatctccccaagttctgggattacagacatgagccaccacaattggctactacttttttaaaaaatcaccttgagtcctatggggccaatatgtttttgaaaactgaatttcctgcccagtaaagaacaaagtcagcatcactattccaat

SEQ ID NO: 243954 - DNA, 279 bp, Homo sapiens
cacaataaatatgaagtaaatatatatgtatataactattttctcttctgagagagccatatgtttgctgccagttgatgtatgatttgggggcatggtggaaaaatacttgttttagtgctaatatatgtttgcacaacatgagtctttcagtcattgaatgtttgaaactaggtttccttaaaattaatttgaattacatgtgattactctttctttactgaagaattctactccttttttatttgtaaaaatagaagatcattgtggtaaagtttg

SEQ ID NO: 243955 - DNA, 636 bp, Homo sapiens
  misc_feature (1)..(1): n is a, c, g, or t
naaattgacacagatccccccgtggaaaaattataccggtgtttcctcgttgaaatattcaaggcggtatttgggattaataccgggcgcccaaaaaattaaaaagtcctctaccaattgtagcgggcccccattttcccccagaacacacctatgcccttgtttccgccaagctccaagttttggacgagctttttttttttttctcgggaagcgcgccattgttttggtcccggaaattcgcccattatggccggggtgcacacaaatcacttacatgtaggttaatacctaattatataaagcaaacattaatttctaaaaaataaaatatgtaacttttttataaactcagaatacagaatggttttttaaatgaaatataaaattacagaacttgagtaaaacagttgataaattggtctacattagtattttaaaacatcatgttctactgagaccctgtctctaccaaaaatttagaaattagccaggaatcgtagaacacatctgtagtcctggctactcaaaaggctgaaaagggaaaggttgcttgagcccaggagtttgaggctgcagtgagctataatcacaccattgcactctgcctgggtgacagagagagagtctatctct

SEQ ID NO: 243956 - DNA, 737 bp, Homo sapiens
gcagattcgcgcaaacccggaagcggatcgcatggagtgatggtcccaccgcagcggtgagttttgctctgtgttgtgttaagtctgcgcttcccaagtccccggcgcttctgtacctgggacgtggggtccccatagacctggaaattctcacccgtgttccttcacctagagcaaatttagacgtcctcgtcagagtccaggggtcgcttccttttgggtttaaagtcgccctgaggatggtcccttcccgaatctttctgctatagggcaatgtatacacttcccatcgcgtagtttccctgctcaaaacctttttctgactcctcccgacccgcactttttaaagtccttaccgcgaggcggattcccgcccttggcgcctcccagtcttgtcttaaggcgccgtcgccccccacctccctcctcgttccaggcccttatgctccccaggtctccccaccgcagtcaccgcttaccctgagcccgcgttggggaggtgcccggggctgtcctatgacaccgggtgttcttgcctgccctgcaccagcccctggaaaatgcgctcctccgggatgcaggcgtcttactccaaagccctcctgtgattgtgttggccaaagggatcaggagactgagagagagagcagtagaaaacctgagacagagaaaagaagaatgagaaagaccataacagatggcaaagtagaggatgagtgagggatttgccaagagag

SEQ ID NO: 243957 - DNA, 376 bp, Homo sapiens
gtcctccccctctctctcctcccctctcctcccctcggccctatcctcccctcccctctcctctcttccctcccttcctcccttctttccttcctctatcctcccttctctcgctctctctctagctcattttttttttcttctgcccggaagaaatactggcattctccaaggctcttttctcagccttcttttttaggttcttattctaaaatctctcttcagtgctctctcattgatttccaaggatttctttataagtggactgagattgagtactgggtccccaaggctgagcacaggtccctcctatccccaaggaggtgctctgaacccactccccatggctgtggatggctccccaaccttctgcatg

SEQ ID NO: 243958 - DNA, 357 bp, Homo sapiens
tttactcccctaagtatcccttctactctatttactcatccttccctctctccctgagaacccctggcaactactgaccattttactgactgtccccaaagttttgcctttttaaaaaatgttatatagttagaattatatatgtagctttttctggttgacttatttcactttgcaatacgcatttaagtttgttccatgtctgtttgtgacttggtagcttatttctttttatcactgaataatattccattttgtggtactatagtttgttcattcacctactgaagtacatcttggttgctatcaagttttggcaattttgaataaagctgctataaaagtttatgtgtgtaa

SEQ ID NO: 243959 - DNA, 996 bp, Homo sapiens
cgagacttcgtttcataaaaacaaagaaacaaacaaacagaaaaaaacaacaaaacaaacaaacagaaaaaaccaacaaaacaaaaaacaagaggcaagaagttcagtgtgcagaatctctgagaaaaacccatggttgttaaccccaggtctgccccttttgagcagggtgacattaggcaactgatttgatttctcttagatgaaatttcctcactccctgcctattcaaccacagtactgaggacatttggagctggattatctctctggtggcagctgtcctgggcattttagggtgtttactagcatccctggcctccccccactagataccagtagcactcccaccccacactggttgcaacaaccagaaatgtctccaagacacttccacgtgacccccggggggtcagaatttctccccttccccctgtgttttcctatggaggtggaacgtgtttatttctttgctcaccgttttgcaatctctcttcccccgccacaaggcagggactcttctatctccgtcaccatcccatcctcccacagtggagacagctctggggactctcctgagcagcagattcttgggtgccacattctgttccattcctggggaatttatctctttactgagtgatgggtacatgagaactttctgtgtcacccttgcatcttttctgttttgtttttacaaaagaaaaaaaagaaggccgggtgcggtggcttacgcctgtaatcccagcactttgggaggccaaggcgggtggatcacgaggtcaggagatcgagaccatcctggctaacacggtgaaaccccgtctctactaaaaatacaaaaaattagccaggtgtggtggcgggctcctgtagtcccacctacttgggaggctgaggcaggagaatggcgtgaacctgggaggcggagcttgcggtgagccaagatcgtgcccactgcactccagcctggcagacagagcgagactccgtctc

SEQ ID NO: 243960 - DNA, 263 bp, Homo sapiens
gccccgcagctgcgccccccgtcagggcatcgaccgctacggggtcccgggcccggccgaaggcgggcagtcgcgggtggcgcgacgctgtgcagacgcccgcctctagctcctcccggccagtggcgcgcgctgcgcctcacagcggttgcgggggcctgggagctcggcggccgggctctgccgctcggactgcagttgcggcatcctccccgccccccgcgacctccgaaaagaaaataaagaaaaaaagagaaaaaaaa

SEQ ID NO: 243961 - DNA, 342 bp, Homo sapiens
agaattcctctgggcatatagcttttgctatttaattatttccttaagataaattcccagccgggcgcagtggctcacgcctgtaatcccagcactttgggagatcaaggcaggcagatcacgaggtcaggagatcgagaccatcgtggctcacacagtgaaaccccgtgtctactaaaaatacaaaaaattagccgggcgtggtggcggtcgcctgtagtcccagctactcgggaggctgaggcaggagaatggcgtgaacccgggaggcggagcttgcagtgagcctagatcgcgccactggcactccagcctgggcgacagagcaagactctgtctcaa

SEQ ID NO: 243962 - DNA, 639 bp, Homo sapiens
tactgacttatttgtggtgtcagaaccccattttcaagaacttcccattctgtttgatgggaacgagggcactttttatagactccaactcacctttaaactttgtgaaatctctgtttgtaaaccacaaaatttatcagcacaactgagtttcccattcctagcttttgtgaacataaggatgacataagaatttcctcttacaatgcctctcacttccacttccccaatcagttcctccccgtgaatcggaagtaagttgagaatagcagctccacccacagctttctgatccttctgagggctgaatctgcccacaagttaggtcaagtgtgtgtcagaaatggtttttatcacagagacactatgagaatatgtgcggacagctgagtctgccacctgtctttctgcctgatttctgcagcaggaatgaatcactcacttcctgcgttgatggtggctgtggcatcctgtcatcacagtagcccttttattctattcctccattcatctccattatcttctaatatgaaaaccattatgtaggtgcatagatttatttgtccttgacttaacagagaccagttaacacttttcaagattttagacttgaccaagcttatcgatgcggcccgaatt

SEQ ID NO: 243963 - DNA, 426 bp, Homo sapiens
agttccccaaattaatacttttataatttcttacgcctgtctttactgcaatctctgaatataaattgtgaagatttcatggacacttatcacttccccagtcaatactcttgtgatttcctatgcctgtctttgctttaacctcttaattccgtcattttcataagctgaggacgtatgtcaccttaggaccctgtgatgattgcattaactgcacaaattgtttaaacaatttgaaatctgggcatcttgaaaaaagaacagggtaagagcgatgttcagggaacaagggaggtaaccttaaagtctggctgcctgtgggctgggtgggacagagccatatttctcttattactgaaaacgggtaagagaaatatcgctgaattctttccccagtgaggaatattaataattaacagccctggg

SEQ ID NO: 243964 - DNA, 434 bp, Homo sapiens
ccgtttacaaagtactttcacttatgttattactttatgtaaactactcaataatcatataaggtagaaggagatagatatctccttgttgtagacaaggaatctaaagttctgagagggtagttgactgattaatcaagtaagaagctagaggggccaacacgtgagcctcgcacttcagttctggactgtactctagctgcaacaacctcttcctctcaaaacaggtgctggagttttccacaggactctgtgtgttgggcacttacccataggaccagcccctttcagtggtctacaataactattggccgggcgcggtggctcacacctgtaatcccagcactttgggaggccgaggcgggcggatccacgaggtcaggagatcgagaccatcctggctaacacggtgaaaccccgtctctactaaaaaa

SEQ ID NO: 243965 - DNA, 490 bp, Homo sapiens
gtgtacttatgaatgattaaaaggtaaatgttatgatatgtatattttacacattaaaattttttttaaaagaatacatgttacaacatggataaaccttgaaaacattatgctaaatgaaaaaagccagacacaaaaagccacatattatatgactgcatttacatgaaatgtctagaacctgcaaagccacagagctggaaggtgaatggatgcttcccagatgctggaggaggggagaactgaaaatatttttgaactagataggggtagtggttgcacaacactgtgaatatatgaaaagccactgaagtgtacgtacactttaaaatggtaaattttgtgttatgtgaatttcatctaaattaaaaataatgtaatacatcgaactcttgtagagcgtttctcagtttccttctaacgccatgtccgtgattgtcttacatggtccttctctttgctcctctctgcttggtgtatgtgagtctat

SEQ ID NO: 243966 - DNA, 537 bp, Homo sapiens
agaaattggagcatgtcatcgtaataccattgttgacattcaagtacacgcagacctcattttattgtatttcacagtgtggtgttataatatgtattatgtttctgtttgcaggtcctggttcataactcccatatcccttgttacagttttttggtttaatggtgggtatgttaggccttaggggcaggcctcagaaaacagaatgtctctgatctccttctgctctccttttacctgccccaaggtagggctctaatcaccaccccctacctttctgactgtaggtcttatgagcaatcagagggtccttcccccctctaccctggaggaaggaatgctgatgtcgcggagcttccacaaaaacctaagaggactgggttagcagagcttccaaatagctgaacaaatggaggttccaggagagtcatgccccagggaggtcaaagaagcttcccctccttccttcatagatcgctctacgtatctcttcatctgtttcctttgcaacatgccttgtaataaatcagtaaatat

SEQ ID NO: 243967 - DNA, 366 bp, Homo sapiens
gctcttgggggttgtggggcaaaactgccaccagtcaaaaaccactggctaaagtatatggaaggagtagtgcactgaggtgtccaaagccaagttacaaggtaggaaagataaatatctttgaggaagaccaagagcaagggaagagggacttaactatagaagtctgtacatctatcccccaggggtctccaagagcagtggttctcaccccagagcatcagcatctcctgggaacttgtcaaaaatgcaaattctcgagcctctcccaagacctactgaatcagaaactctggagggtggggcccagccctctgttgtcttgacaagccctctgggggattctgaagctccctgaagtttgag

SEQ ID NO: 243968 - DNA, 598 bp, Homo sapiens
tggagtgtcagtctatcacccaggctggagtgcagtggtgtgatctcggttcactgcaatctccacctcccgggttcaagcaatcctcccacctcagcctcccaggtagctaggactacaggcttgtgctaccacgcctggctaatttgttttgtattttcagtagagatggcgtttcaccatgttggccaggctggtcttgaactcctggtctcaagtgatccgcccacctcagcctctgaaagtgctgggattacaggtgttagccactgcgcccggtcaaaatcagctcttctaggagtctaacgcaactcacacataaacaaacacacacgcattcttctaaataaaaaatctctcattcctcatcatgttccctttaattctaacatctacaaaagtcctgaaaatgaacttaaaaatagttaagaagtcaattttacctctttgccaagaggtaaaatcagacggctcaaacagctgcattgcatggcaggttccacaagatgcaatgcaccgtatataaaacaccacacccaagtacatgactccacccataagaattctacaagataacccctatacatcattgttgttt

SEQ ID NO: 243969 - DNA, 607 bp, Homo sapiens
cacgaaacacagcatggccttagcgagtcgcacaggtttgacgtcagcggttgtcatggtaacaggggcaaagatgctgatgccagtgtcagtcaggactgagctcctccctccagtctgattcctgccagtgcttaaggatgtatggaggggagaagcgtcttccaagcaaaatcttcatcctctgttctctatcacgtgcagtgcgtcaccagatcctcgccagtgctgagggtggggatacgggggaatctctgacttgcaagattaaattatcattggagagggaacgtgtcagccttgttcaccgcagtgtcgccaatgctgctagctcagttcctgcccctgcccaccattgggagaatcatgagccaactctctctgtctctcctctctctctctctgtctcgtcccttggccttagctgtcaccaatacactgactctgactcccaaatctttccctgagacctgttttcctgagtctcatacgcagttcctcctccacactaggcagctccactcagtgttctgatatcaagcttgagattctccttccgcctagaaacctagaattctccagctaataacctccgttgtcttcaccc

SEQ ID NO: 243970 - DNA, 828 bp, Homo sapiens
aaacaggttgctggttgcaaggtagttttccaacctctacgtgattctcagactttaggttgcatcataatcacctggagggcttgttcaaacgcagattgctgggccccacccccagaatttttgattcagccagtctggggtggggctgatatttgtatttctaccaactttccaggtgaggctggctgatgatggtctggaaaccactttgaaaacctctgaagcttttctcaactcccttctttgtgtacctaaaacactttatccctactgtagatgtagcattagcgtgttatattagtttagtgattggtgtgtgggtctctgggagcctttctgaatcacctccctagcctagtgcctgacaatagcaatttgctccccattcattgactgaactgaaaccggagggtcatggtcatcatcattgttccaagccatagatagaagatgaagtcaccacccctgatctcagagctcatcagagtagagcttgggctggaccctgcccttctctgcagtgagcagttttctctgtggagctctgtgcaacctggagccagtcctgcctggggtaagaggaaaaaagactccttccccccagccccacagcctgtacgcaaacacaccgggagacatgacctgctcagaggagacctggaaccaagggaataaaatgagagtgggttgggggcttggctgttagttattttttgcttgtaagtggacaatttgtggtgtggtgtgtgaatttggggtcttaaatccagatagctgtttgctgtggacagcccctgtttttgaattacagggcatttcaagtga

SEQ ID NO: 243971 - DNA, 433 bp, Homo sapiens
accaaaatcaatgtggggagcaaggatactgttcttgtgagtttcagaatgtgcagcatgtgcaggctgagatccacttgaagaagacatttataggtgaatcactagacatgctgaaaatgtgttcaaatggcaaaacaaaatggggaacatgcacaaatatacggacttgaggccaggactgcttgctcctgcagaactcattccctgggatttagcagcagtcttaaagttaggtccataactggattgggatgtgatcattgatactgatagccaccattttttcaatgcctgatgagttgattttctacattaatgctaatccttgaaacaactgtgtgaagttaacattatcctgtttttaagtaggataactgacttgcccaaggttgttcagcgaataagcagtacagctgggattcaaacttgg

SEQ ID NO: 243972 - DNA, 475 bp, Homo sapiens
tgtgatgaagggtctgggaaactaaatgcattcaaccgggatcactgcggtcctccttggttcatccatgtatgtatttactccatatttacttcatccatgtaggaaaatatgttccaggttacctgattagacacttagaatagactggtgaagaaacatagtgggtaaacatgatgacagaacagctgttgagggccgggtgcggtggatcacgcctgtaatcccagcactttgggaggccgaggcaggcaggtcacaaggtcaggagttcgagaccagcctggccaatatggtaaaaccccatctctactaaaaatataaaaattagccaggcgtgctggcgggtgcctgtagtcccagctactcaggaggctgaagcaggagaatagcttgaacccgggaagcagaggttgcagtgagccaagatcgtgccactgcactccagcctgggtgacagagcgagactccaggg

SEQ ID NO: 243973 - DNA, 348 bp, Homo sapiens
gactttcatcatgggtgatctctctcacttgttccaagggaagtcaagtgtatgttgtaaagtaccctctggataggcctacatggcaaggatttgaagaaagcctctggttagcagctagtgaggaactgagatgctgtttccaatagcctgcaaagaactgaatcttgccaacaagcatgtgagtgggcttagaagcagaatcaaactcagtcatgcttcatataagaccacagcttccaacaattccccaactgcaacttcatgagaaaccttgatccagaagctcccagctataccaacccccaatttctaaccaacagaaaatgtgaaataacttgtttgatg

SEQ ID NO: 243974 - DNA, 423 bp, Homo sapiens
cgtttaagtgatttaacatgtgtagagtgcttagactgtggtgtgtgtgtgttaaataaaaactgtccatgtcgcaggccccccactttccacattcgtctttctctttccgtgtaattacctttaacagaagtagaaagaataaggccactttgttcttccaggtaactcaaagtcattctgattttgcagcttctgatatcatttgtttatgtattaagagaaataggtagtagtatgatttttctcaaccctatttcacgtcttacataaaaactctaagaagccagtataggccaggcgcagtggctcacacctgtaaccccagcactttgggaggccgaggccggtggatcacgaggtcaggagatcgagaccatcctggctaacatgttgaaaccccgtctctactaaaaatacaaa

SEQ ID NO: 243975 - DNA, 590 bp, Homo sapiens
cacacttgtgttggcagctctggggcaggcagctttgtggttgatggtgagggtagggagagatgaagtgcttgagacacagagtttctgctgcaggaactgggttgttaggaaggcactggggctgcaggttacgtgtttggacctatcagtcatttgactgtgggagagtaacttgcttaagccccagaatcatcttctgtgaaatagggatattaacaatgcttaatgagtaggtttttgaacagagtggataagtcaacaaaaggttaacatcctacctggtgtgtgggaagcactccataaacagcagctgctgtgtttctatctctgttattacttcccacataaagcacaggtgatgaccaagagggtgtcaacctatgtcaactttgttatccttccgttggagtctgtaattgaggctgatgtatattaacatggaaataaggtctcaggaagcaagagggtgcagctgacaggcagcgctgcaggcagacagctcataattttctcctcctttctgggtgggtcacagttgggactagtctctggattaaaaacagtgctaatgccctcaatgtctgcat

SEQ ID NO: 243976 - DNA, 480 bp, Homo sapiens
taaaagatacgtctgtttctgtttggcatggatattcagcttcattatgtaaagaaatttttttacagtttcacatgcatgatatttatttgataaaaattttaggtatattcaaaagtcaccattatttcttttatgaaacataggtgcagaatttttattataaaggtatattttaaaacagaatagattacacatattacatgcattttgtgtacatatgtctataggaatcaatttacaattttccaaaaacatcttgctttagtttgtggatattcactgctttcattctatttttaattaaatagttttgctattttctctatgcatgtttgagaaaccaaaacagttaagcacaagcattttgatttattgatatataataacaaatgtgtgattgaatcccatgactaagagtacattaatatatttcttgtgcacatgatcagtttatctttgttattccatatgagttaa

SEQ ID NO: 243977 - DNA, 451 bp, Homo sapiens
accaagcctcctctgtcccgctaaccttctcagctttcatggtgaaccaagcctcctctgtcccgctaaccattctcagctttcatggtgaaccaagcctcctctgtcccactaaccttctcagctttcatagtaaaccaagccttctctgtctgatgggccctttcttagatggtgttaacacatctgacaaagttaatcctatctcatgctgtccagtgtgccatcctgcctcttgctggtaactttgtatttctctaatcaatagtttgatgctaagtttcaggaggcattctttttctcctttctaaagtgtggaaatcccctatgcctttctgttgagtcctctaaatttcttgtgtattcatgcatatttcgttttcggtagcaaggctatctagatttttatcagaatttaaagcagtctgtcaggatcttacctgccaccaaa

SEQ ID NO: 243978 - DNA, 201 bp, Homo sapiens
tttttgtctaaatgtgttcactatattacacatcaaaatgcaaataactgatttaattatccaacattctggattgcctataacattcttcctaagattcaactgtagatattactgatccaaattatgaacaagaattattctaaaaaatcactgaggaaactaaaaagcgtaacaaaatgacaaatttatgtattaaaa

SEQ ID NO: 243979 - DNA, 596 bp, Homo sapiens
tctgggatacatgggcagaacacacaggtttgttacataggtatacatgtgccatggtggtttgctgcacctattaacccaatttttatatttttagtagagacggggtttcaccatgttggccaggctggtcttgaacttctggcctcaagtgatctgcccgatttggctgcgttttgtcaatatcatccacaacatttccataaccacaaacaccacttctaaaacaagagctagaaagtcaagtaaaagggaaatataagaggaatgcggacaaatttgttactactagtaaaataaaaatgtccagcacatgtgattttgatgatgaaatagtagcatcgccttcatgtattagagagagcatgtaaattacttgctttgcggcacagacaggtctgaaatcgtctgcttagaagtggtggtattttttaatagagtacagcaaaataaaaaactgctcttaaaatccatcaatggagttccccaaatgtaaacataattatagaatccctctaaaaccggagttacacattacttttttgattttccagtgtacagagtagaaagtaagttttcaatgaaggaataaatac

SEQ ID NO: 243980 - DNA, 502 bp, Homo sapiens
catcttgcccagactggtcttgaactcctgggctcaagcagttttcccacctcagccttgctaaatgctgggattaaattttaataattaaggaaacctgaatatgggcaaagctttcaataaacaattaggatttagtcacgttcccttttacagaatacttaagtacctatagagatagtcacatagctgttttgttttctagattagaaaacctacagttttatgttctgatatctttattctgatctctttagctgtttttaataaagcaaacttaaaaaaacacaaatcttatttgtaatgtaactgtgaactagaacatttgtaatagagaaaaattgaaaataatctaaatgtttatcagcagaaaaaggggtaaataaattataatatggtcatacaatgtgatgctatattgcagtttaaatgaatcaactagagctatacatgtcaacatggatacatttgttggccaaagtgttcattccccacctggaaa

SEQ ID NO: 243981 - DNA, 448 bp, Homo sapiens
ccaggctggtcttgaactcctgggctcaagagatcttcctgcctcagcctcacagactgctgggattacaggcatgagccaccacacccagcctgggtgacagagcgagactgtctcaaaaaaaaaaaacaaaaatattcaactatgagctggggaaaaaagcttcagcggtcactgaaagtgcttacaggtacagctagtatggggatggaatatgccccattagccaggccaacagatctcatataggagaatctgttttatgtttgttggacagtgggtgagttatcgcagagttatgccttttttttctgtcactattttatgtcccttatcactgtgcctttaacctactgaaatgcagttgaggccgggtgcggtggctcacaccaagatggcgccactacactccagcctgggcaacagagggagactccatctcaaaaaa

SEQ ID NO: 243982 - DNA, 542 bp, Homo sapiens
tgggaagtgtgttgggcagaataatgactcccaaagatgttcatatcctaatcctcagaacctgtaagtatgttaccttaaatggcaaaaagggatgtggcagatgtgattaaattaaggctcttggaatgaggagtttatcttggtttatctgggtgggccccatgtattcttgagggtccttatgaggcagcagcaggagagtcagagtaggaagagatgtgataatggaagtagacgggaggctcgggggagaaagagacaatgagagagagagacttgaagaagctgtctggctggcttgaaggtaaaggaagggccaccagccaaggaatgcaggccatccctagaaaccagaatagacaaggaaacagatttccccctagagcctccagaaggaacacagacctgctgatgccccgatgagggaccctttcaaacatctaacctgcagaactgtaagataataaattgggttgtcttaagccaccatgtctgtggtcatttgttagagcagcaataggaaaccaacacaggaagca

SEQ ID NO: 243983 - DNA, 451 bp, Homo sapiens
tcaaatatgccgaccgggccaaggagatcaggctctcggtgcgtgccagccagggccggcttgggcgtggggcagctccagccggggagcaggaaagggtgggacccaggcagctccaatagatccctgggccaagtgtccccaaggcagaggaaggaagttcctctggcctggacatggtggctcatgcctgtaatcccagcactttgggagaccaaggtgggcagatcaccagaggtcaggagttcgagaccagcctgggcagcatgatgaaaccccatctctactaaaaatacaaaaatctgctgggcatggtggtgggcacctgtaatcccagctactctggaggctgaggcagaagaatcgcttgaacccaggagatgaaggttgcagtgagctgagataatgccactgcactccagcctgggcgacagagctagactctgtctca

SEQ ID NO: 243984 - DNA, 868 bp, Homo sapiens
gttctgccatatgctaactattgcttttagacttgttttctgtaatgagcattctttaaaatgtcttgtatgttgaaaacctagatgagacttgttacctagctctgttttcttctcattcttctgtttgctaatatttttgcacctatgggggttttcttgtttgtttccgttgttggttttttggtggtttttgccattttaggatatgttctttagcttttgcctccctcataatgtattaggccatcttgcccccttcccagtctttttctctgaagatcactgtgatgttcttacatccagaggaaattacactacttcttttgtacgaaaaacaaattaggattgtaaatccagtgttacctgctctttaacagaaaaatgttcaaagtctaaagagcgttcctgtttcctttcttgtctaagtttttttctttttgcacttatttatgaaatagtcttgcattacttaattaagtatggatattgtgagttccaaatatatttgagcttttattggatcttggatgtattttctttaagcatgaggctggttttgaagatgtatgtcacattttgtgataggttactgattcatttaaaatggaacttctggcactggcaaaacccaagaatttagagtagacgaactagatggaaactacctggcatcctatgtgacttccttcttccaccgatgtctatagtatattctgagctggggcacaacttgtgggacttggtgtgatttttctctgatgaaactaagtagggactacattgctaccttaactatctgaaagctatggtttcattagctgttgaaagagtttattatttatgggcttcgtagctggaaaaatat

SEQ ID NO: 243985 - DNA, 774 bp, Homo sapiens
tgtttccctttgtctgaactccctcactggcttagaatccattgtaatgattacattgtaatcctgttcttgctaacatctccaactctaccaaaccatctggcaagacctcaagccccaggctggagtgcagtggtgcaatctcagctcactgcaacctccgcctcccgggttcaagcgattctccttcctcagcctcccaagtagctgggactacaggctagcaccaccatgcccagctaatttttgtattttcagtagagacggagtttcaccatgttggccaggatggtctcaatctcttgacatcgtgatctgcccgcctgagcctcccaaagtgctgggattacaggcatgagccactgtgcccggccagggcaaaggttcttaatccagggttcctgaattttttgtgtaagtccattctattttctgggagaaagtgttcaagtttttatcagattgtcaaagggattcttaactgccaaaagattaagaattggttaactggccaggcgcgatggctcacgccttaatcccaccactttgggaagccgaggcaggcagattgcttgagttcaggagttcgagaccagcctgggcaacgtgatgaaatcctgtctttaccgaaaatacaaaaattagccaggtgttggccgggcacagtgactcacaaccgtaatcccagcactttggaaggccgaggcaggcagatcactgaggtcaggagttcgagaccagcctggccaacgtagtgaaaccctgtctctacta

SEQ ID NO: 243986 - DNA, 461 bp, Homo sapiens
tgtcatcagtcctaatcatgctccctttggtttggatctcttgtagcaccaaggggtggagggtaccttcagaggtcaagaaaatggactggcatggcaggcacatgcccgccagaggactttgtcaaatggccaaggcattcccatcaatgccaggtgtcagcatactgcagggatgcaccgagatacacggctgccagtgaaaagaagatgccctctgacttgccaccatgagcagtcaaaacgaaacttgtcttggattaggctgttttcgtgtcaggagaaacacagtgtagctgctgacttcattgtgccccctcaccatcctaaggcaattcaaaaagagttttcgggttgtatgcaaataattttatttctaaatgaatactgttttagggtaggatttgggagaacttaagccacagtatattttccccaaaataaaagttataggctacaaa

SEQ ID NO: 243987 - DNA, 673 bp, Homo sapiens
ttacagacaacatgaagtgaggtcttgttttttaatctaatctgataatctctgacatttaatcagactgtttatagcacttatatttaatgtgatttttgataagggaagttttactcctgtcatcttgctttttgtgtttatctcatcttgttttagttccatttctcctctttttttgccttctttatgaccacacctttatctccactatcagcttgttagctacacctctttgttctgtttgtttggttttgtttggtttttgttactggttgttctggggtttacagaatacgtctttaacttaccttcaaataatatttataccactttacagaaaaaaatttttttaataatagtattatacgactttacatataagaatcttaaacaagattcttatatttcttcctcctgtcctttgtgctgtggttctacatgttacttggtggttctttcatcttgggtagtttcctcatatgcatgtgcagtactcagccacactcaagggaaccctctgcagatacctggagctttttctgtgtagccctctcccctccgtagtgtttgcatgatattttgccatgcaaattctggtcacatcggcctccctgaactccaaatgctgtctcctcaattcagcaagtcagctaggctctgtttgagtggc

SEQ ID NO: 243988 - DNA, 581 bp, Homo sapiens
tgttgagatatcagttgtccctaaaatgagctatggattcaatacaaatccaattcaataattttttgtagaaattaatacactgattctaaaatgtgtatcaaaagacaacagaactaggaaagtgaaaataattttgaaaacgaacaacaaagttgcaagacccacctacttgatttcaagattttaaaagttacacaatcaagactattctgtattggtgaaagaatagatgtataggtcaataaacagaacagagattccagaaatagacccttacatatacatacatatagtgaactgatatttgacaaatatacaaagacagttaagtagataaaggagaatccttaaaatgaacctccatccatacctcaaattctatataaaaattaactcaaaatggatcataggcctaaatgtaaaacctaaaactataaaacttttagtaaaaaacaggagaaaatatttgtaaccttggattaagcaaagatttcttagatatgacatcaaaagcacagtcaattaaaaaaatgaactttttttcttcaaaaggccctatgaaaaggatgaaaaagagg

SEQ ID NO: 243989 - DNA, 326 bp, Homo sapiens
tctcctacttccctgtaaggcagacattatagatccaccttgattttacaggggaggaaactgaagttaaatcactcatccaaggtcacactgctagtaggtgcaggggcccaggattcaaccccaggcatgcctgactccaaggcctgtgtttgttctatcattaatcctacacacattgggcttcacacaggtttattctggagatactgacatattctgttcatgtctggggggtagttacacaagtatgtgtaaacttatgatctgtgcacttttctgtgtttatgttataacatcaataaagtttcctttttttaatgttt

SEQ ID NO: 243990 - DNA, 5142 bp, Homo sapiens
  misc_feature (3815)..(3815): n is a, c, g, or t
  misc_feature (4471)..(4471): n is a, c, g, or t
caaaagagaaacataaaaaggatggggtaacagttatagacagcttaggctagtcttggattatagtaatctgcagatacatggtgtgtgaatgacatctgaaggtgttatcttacactgtaaatcatttttatgactacacatatactatttcatgaagatgaaaatgcatttctagtgaatttctaaacttgtttgtaaacagtaacttcttttaaattagctaactctaaatgatctgttctaattaattttcaacttgcataacgtgaaaaagaagtaattttcaacttgtaactttactgaaaaatttcaaatatgcttttccataatatttaccagggttactagtaacagaaacttaccagttaatggaatatttctttcctcactacctctcaaatatatatgtcccttggaagagatcgaagtgagaaattaaaaacatgagaactagaaaggaaacaagagcataggagtttttatgaggataataaacccacatgggaagagccagatcacagaataaacttttttattttttaacaaaacacattttaatgtaatccatgtttaactgcagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaaggttagctatcttttttccttcggcgttcagatttctgatagaattcttgtatgttatttggtaaaatagttacttaattgtcttgtgtatggtaagtaaaagtaataattacctgtgttaataaagagaggagacagaaattttaccgttatttttaagtctctggagctctcattgataagagattactcctttgttaactttatttaataaatgtaaccaaactgacacattttaaatttttttaaaaactgcatttaagttagattttaaccaaaggtttactttgatgtgctttgtcttactaattgattttagtttgtctggggttcacttttaatgggtttagtgtgcctggggtcacttttaaagtttttctgcgtcatctcaggttttctacctgtcatcatatgtgaatgattggtgtccaaacactaaccacccatggatgtttattatttaaaaggacccaaggtgaatacttttatatgttatataaacctgcaacacttgattaatctgttctttaagttaaaagttttgtgattttcttatatgagtacatctgtaattgctattgcacttaatagtgttttaatcccaattttagtaaaatgtgtctattgctatgcaatagcacagtggttttgaaatagttaaatcaaataaatatttgaatttttaaagtaaagctcacataagttttgtctctctacctggccataactttagtaattgatgactaagatggcaatggtatctagagtccttcaatagcaaatgtgaccaaacagaatcagttctattcttaataccccaaattccatgtaaagctgcacatggacatctcccctggacatgtaacaggaaccttttagttcaaccgtgtggtttcactcagagtaagagtctatttctggggatttcaaaatggatccaaaaatgacgagctgtatcaactatagagttggtaaggaaaaaaaaaacaaaacgtagttcaactatgcttgacccagattaaggtatttgtctaacatttgtccatttttcaactgagggaaaattacaaaaactgggcacagtggcacacacctgtagtcccagctgctcctgaggctgaggcaggaagatcacttgaacccaggagttcaaatctgcagtgcgcaatgattattcctgtgagtagctacggcactgcagcattccaatctgggcaacatagcaagattctgtctcttnaaaaaattacaaaatccataaaacatttgtttgaacaacaatagataaatagttttctttgtgtatattgttgtttttaaaattttcaatcgatgcacattggcttatagttttgatgtttttatgatctccttagcgcacagaaaagtagcgcaggcccacatggaatgaacctcaaccttgttgtgtttacctggctatttcgtgtcctaacaaatcatagaagagcaaatctaaggtttcttagatagcattgtggccaaatagcttaaaagggaatgcattaaatgattgttttaatacatagattacaagagcccagctagctgatatttttaatcatattgttcgcttaggttttatttttctgaaaaaaatgagatgatcagcgtccaaatgcctcagtcatgaaattgtaccactgggtactaatgggaaatgaatgttaaatacgtctgtaaatggttaagcaagatgcaaatataatgttctcattagtactatgaacccccaaaatttgagacaagtctcaattaatttagaaagtttattttgccgaggttgaggacacacatccatgacacagcctcaggaagtcctgatgacatgtgtccaaggtggttggggcacagcttggttttatacattttaggggnagacatgagacatcaatcaatatatttaagaagtacattggttcactctggaaaggcgggacaatttgaagcaaagggaggaagactggtagcggggagggggcttccaggtcacagataggtgagagacaaacagttgcactcttttgagtttctgattagcttttccaaaggagacagtcagatctgcatttatcttagtgagcagagaggtaactttgaatagaatgggaggcaggtttgccctaagcagtttccagcctgagttttccttttagcttagtgattttggaggcccaagatattttcctttcacagtacttaccagaaaaacaaggtaatgtatcattttacaagatagtgctgagagagtataaaaagcagatgtaggccgggcactgtagctcacacctgtaatcccagcactttgggaggccgaggcgagtgggtcacttgaggtcaggaattcaagaccagcctggacaacatggtgaaaccctgtctctgctaaaaatacaaaaattagcctggcatggtggcgggcgcctataatcctagctacttgggaggctgaggcaggagaatcgcttgaacccaggaggcagaggttgcagtgagccaagattgtgccactgcactgcagcccaggtgacagagcaagactccatctc

SEQ ID NO: 243991 - DNA, 2881 bp, Homo sapiens
caaaagagaaacataaaaaggatggggtaacagttatagacagcttaggctagtcttggattatagtaatctgcagatacatggtgtgtgaatgacatctgaaggtgttatcttacactgtaaatcatttttatgactacacatatactatttcatgaagatgaaaatgcatttctagtgaatttctaaacttgtttgtaaacagtaacttcttttaaattagctaactctaaatgatctgttctaattaattttcaacttgcataacgtgaaaaagaagtaattttcaacttgtaactttactgaaaaatttcaaatatgcttttccataatatttaccagggttactagtaacagaaacttaccagttaatggaatatttctttcctcactacctctcaaatatatatgtcccttggaagagatcgaagtgagaaattaaaaacatgagaactagaaaggaaacaagagcataggagtttttatgaggataataaacccacatgggaagagccagatcacagaataaacttttttattttttaacaaaacacattttaatgtaatccatgtttaactgcagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagatgctgggattacaagcgtgagctaccacacccagcgaggaagccaagtttaacgtgtgtgctccactcctccaacctggccaaagggcagtcatcatcactggccactactgaccacagcctttagaaactccccttgaacgtgctgggctgaccttcctct

SEQ ID NO: 243992 - DNA, 2823 bp, Homo sapiens
caaaagagaaacataaaaaggatggggtaacagttatagacagcttaggctagtcttggattatagtaatctgcagatacatggtgtgtgaatgacatctgaaggtgttatcttacactgtaaatcatttttatgactacacatatactatttcatgaagatgaaaatgcatttctagtgaatttctaaacttgtttgtaaacagtaacttcttttaaattagctaactctaaatgatctgttctaattaattttcaacttgcataacgtgaaaaagaagtaattttcaacttgtaactttactgaaaaatttcaaatatgcttttccataatatttaccagggttactagtaacagaaacttaccagttaatggaatatttctttcctcactacctctcaaatatatatgtcccttggaagagatcgaagtgagaaattaaaaacatgagaactagaaaggaaacaagagcataggagtttttatgaggataataaacccacatgggaagagccagatcacagaataaacttttttattttttaacaaaacacattttaatgtaatccatgtttaactgcagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctggttgtgcaggagagaaacgatgcccagaagcaactttctgaagaacaggatgccagaatattacaagatcagattctgacgagtaaacaaaaggaactagaaatggctcgaaagaaaatgaattctgagatttctcataggcatcagaaagaaaaggatctctttcatgaagattgcatgttgcaggaagaaattgccttgctgagactggaaatagatacaataaaaaatcagaacaagcaaaaggaaaagaaatattttgaggacattgaggctgtgaaagaaaagaatgataaccttcaaaaaattataaaactaaatgaggaaacattaacagaaacaatactccagtacagtggacagctgaacaatctgacagctgagaacaaaatactcaattctgaactggagaatgggaaacagaaccaagaaagactagaaatagaaatggaatcataccgttgtagactagctgctgctgtacgtgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaattgaacaaagcaaactgaagaaatacattgccaagcaggaatctgtagaggagagattatctcaactacaaagtgaaaatatgttgcttcgacagcaactggatgatgctcacaagaaagctaacagtcaagaaaagacaagcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaaagctgaatggcataaactgttgattgaagaaagagcaaggaaggagatagaagaaaaattaaacgaagccattctcaccttgcagaaacaagcagcagtatctcatgaacagttagtacagttaagggaggataatactacttcaataaaaactcagatggaactcacaatcaaagatctggaatctgaaatctccagaataaaaacttcgcaagccgactttaataaaaccgaattggaaagatataaggaactctacctagaagaagtgaaagttagagaatccttgtcaaatgaactcagtagaactaatgagatgatagcagaggtcagtacgcaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagatgcagcagaagttgcaaaatgatctaactgcagaagtagcagctgctactaaatatgaacctggatcctatatagcttctcctctaggatttacacacaaggaaaatctgaatcaagatccagttttggaagtaacaaaagaatatgcacagattttaagaagaaaatacatactctgaaagataaggcaattttatttgggctattcacatgatattttgtttcccattaaatatatgatgtgaa

SEQ ID NO: 243993 - DNA, 320 bp, Homo sapiens
gcttgcatcttctctagtttccttataataccaaacccagcacagtgtgtcaacagtggttatgctctcttgtttttttttatgtgtattactttttgttttgttttcaaatattttcgatctgcggttggttgaatccatggatgtagagggccaactgtaataaaaatctgtttttaaaaattagatgaaagtggccaggcgcagtggcgcatgccggtaatcccagcactttgggaggccaaggcaggtggatcacgaggtcaggagatcaagaccatcctgcctaacacggtgaaacccgtctctactaaaaatac

SEQ ID NO: 243994 - DNA, 346 bp, Homo sapiens
ttctttctgagagctcctccctgagggatgtcatctgtaaacaagatagcctgttgtgggcctggcccataatggctcacgcctgtaatctcagcattttgggaggctgaggtaggtggatcacctgaggttcaggagtttgagaccagcctggccaaaatggtgaaactctgtctctactaaaagtacaaaaattagctgggtgtggtggtgggtgcttgtaatcccagctactcagtaggctgaggcaggaggatcgcttgaacccggaaggtggaggttgcagtaattcaaaatggcgccattgcattccagcctgggctacagagagagattccatctcaaa

SEQ ID NO: 243995 - DNA, 497 bp, Homo sapiens
caggtttgtaataataaatttataatggaaatggctctttttattttctccccctcctacctcactggtacctcatttttccaaaccccagtcccatgaaggctttgcagcacagctgctatcagttggtggagtgccaggagttttccattgtcttgtaacagtgatttgttcccagcacattcaactctcttcctcattttggatattctggttaatggaattgtaatatgtaccaaacttggcttaccaatcttcacaggaccataaaacaaaaatatttatattaaaatagtagtgaatgtaatttaattttttaatcatccctttagaaattggatacccccgagcccttgtgaaggggctgcatgaagcatcagttataaatatggtgataaaatagcagcacttgctagttaacagagatctggttgaccgaatgctagataacagaatttgataaaaatagatgaaaaaaacaggttgcataattgcta

SEQ ID NO: 243996 - DNA, 665 bp, Homo sapiens
ccacagcaggaggcacacgtgtctggttgttcctctttgagtcatgctaagatcgatccctggcttcaggtggtgacagcctggtcctggcagtgtcaagtcctggatcagccttccagccgcttttttcacccattgcttttcatggtttgaatcaggtgtttgatgaggagaatgcacatattagctggttgtttctttgtcttgaaagagagttcatagaggaaataggatagatgcttctctccatttaattaccaatttttagggtaaaaagttgggcccctagttaattccaattttgttcagtgccttgggtctctccatctctctgcctgcctgtctgtctctttcttccccattctctacagtcattatgagctcctggggtttgtatattgaatgcgtctcactcaattgcctttcttattccttttgatgctcagttgcatgattggctctgtgttcctttggcacggccctcttgctttctggcataacaggatgtcccaggctcattttgtaagtgctactctggctttgaacccagccattcctccaaggaccccttgcctcttggtggggagaggatttaagggaaggggctgtaggtgtgctcattgctatcgcttcttattgcttccaggtctttttggtgataacta

SEQ ID NO: 243997 - DNA, 913 bp, Homo sapiens
ccatgtttgtgtttgttcttagagacggaggtcgcactctgtggcccaggctgtcctcgaactccctgggctcaagcgctcttactgccttggcctcccgagtagcgtagctgggactcaggtgcaagccaccgtgcctcacttttatttccaaaaagcatcctgttccctcctgctggagaaactgggctgcccctgggctcttggcctccactttgctccgtgccacccagacttatcctgcaggtctcagctcaaaggtcctttcctcaggaacagctatcctccctccccagaacagatcccgccgcccggtccctattatgcccatacggccgccttctgtagaatgacttgttcgtcatctgccacaagacccaggcttttttacttgctcgccaccattcgcccagaagcagagacttcgctaaaagcacctcaatgaataaatgaataaatggtttgtagacaggcctttgaggttcctgcttctgtgaccagcaccagaatgggtgtcccttctgcacagcctgagtgaggcctaccccggctcctacttcaccgggcccagctcctcaagagcttccttctgcggctgctgctgagtcttcttccgattcatttccaaacccacacgttacgcaaggcgccctctgcaagtagtatctgcaaagaggaactcgccatgccgtccttcctatttctcaaaaataatagctaagcaaatgtcgggagtgcagcgaagtgtctgcatgaacaccctcagccagccctgcgactaaactacaaccaagcccaggttctgcaaaacgattccagaaataagccaccggcctgccgcggcctccggagccctctcccgctcggcgccccgaggccccaccccgaagcacgcgcgcacccacgcggccgc

SEQ ID NO: 243998 - DNA, 632 bp, Homo sapiens
ccatgtttgtgtttgttcttagagacggaggtcgcactctgtggcccaggctgtcctcgaactccctgggctcaagcgctcttactgccttggcctcccgagtagcgtagctgggactcaggtgcaagccaccgtgcctcacttttatttccaaaaagcatcctgttccctcctgctggagaaactgggctgcccctgggctcttggcctccactttgctccgtgccacccagacttatcctgcaggtctcagctcaaaggtcctttcctcaggaacagctatcctccctccccagaacagatcccgccgcccggtccctattatgcccatacggccgccttctgtagaatgacttgttcgtcatctgccacaagacccaggcttttttacttgctcgccaccattcgcccagaagcagagacttcgctaaaagcacctcaatgaataaatgaataaatggtttgtagacaggcctttgaggttcctgcttctgtgaccagcaccagaatgggtgtcccttctgcacagcctgagtgaggcctaccccggctcctacttcaccgggtttcgctcagcaaacagctactcccagctgcgactatcgagctcggtagacgtgtttctgccgcta

SEQ ID NO: 243999 - DNA, 466 bp, Homo sapiens
aaaaatcaagctgcaaatatgcaagctggaacctggcataggtgaatgccggcagctggaccaataggaaagggctacctgggagccaggtgtgttcaatatggagtctctatctccccttttctttgtcaccatgtgtacagtaaaaaagcaggcagcatggcactggcgaggcagagaacccacctgcataataaaatataagggtgagtggccagcttcttcacacactatgcaaatgacacacccagtcttaatcagttcttcgcatgctatgcaaattgcacacctggtctgaccaatcttttatgccctatgtaaatcagagaccaccttctcaggcttatctataaaacctcctgcacttcaccacggggctggaggaccggctcgggaccccctctctctgcaggagagagcttttctctttctttcgcctattaaacctccactcttaacctcactc

SEQ ID NO: 244000 - DNA, 288 bp, Homo sapiens
tttctgtgtgttttttctgaggtaccagcatcttccttctgtctttctgtgtggcatatcttttttcattgcctgcttgatgaaatgatagggcatagagatgtttaatttagttagagggaggtatcgataggttttggggatgggaaaggggcatgggagtgaatatgttcatggttatttctgcaaagtatgaaactctattttttcttacttctcttgatctgttttatgcccttgctattgatgacttttctttcttttcttcccttctgccacctactattt

SEQ ID NO: 244001 - DNA, 409 bp, Homo sapiens
gcagatgaaccatgtcagtggcaagttctgatgtcaagcaagcttatctgatgccacatagtttccttagaaccaatgttaagcttccttggcagcagctgtttattctaacccaatatgagactcagtctgtcagttaaggctacataaatgttagcagagcaaccttgctcaccagatccccatttatgaagataccatgactaagcttctaatgtgcaaacacttcatcctccccctcaactcaagattcttctggccaggcgcagtggctcacgcctgtaatcccagcactttgggaggctgaggcaggagaattgcttgaacccgggaggcagaggttgcagtgagccaagatcacgccattgcactccaacctgggtgacaagagcgaaaccctgtctcaaaa

SEQ ID NO: 244002 - DNA, 540 bp, Homo sapiens
gctgttcaccattgttgagtgaagtcgtgggtgtgggtgagttcatctggtggttctgtttcaggggctgtgagtggggcattcgtcagtgtttgtggtggggagttggagggtgtctgggagaagggatggctacatgcagcatctcaccatgctgcactgcgtggcacttagaagaacagaaagcgcaactttataatagtgccgagagaagattgtgagaacctgaaaaatacagaaaaacaataccacatgtgcagcctgtccacaaagctgtatattttgtgagaatgccgatggaaaaaaggatacctagtaaacatgaggatggctgcttaatggagaaagaagtatggaatgagaagagggaaattagagaaacagcatatcagaaaagtgagggtaaggccgggtgcggtggctcacgcctaaaatcccagtatgttgggaggctgaggcaggtggatcacttgaggtcaggagttcgaggccaatgtgggcaacttggtgaaaccccttctctcctaaaaatacaagaat

SEQ ID NO: 244003 - DNA, 497 bp, Homo sapiens
ctgggcacatcctccattgctcctgtctgtcacagtgggagccacagcagttttagcacccagaggtgacccagctgagtccatgaaacccaaactttcttagcagctgcttggagtgtttgggaaacacagctcagaagtgcaaactttaaccattgcaagagagagttgatgacagattcctcactcctcattccctctctgtgccactggactcatgcactggttctgtcagcctctgttgacatcctgccacagctctgtttcctgtgaagttgtggccagcccagtaatgacatgccatctttgattttgtctcctccttctcttcctcactttcccttttctctcactcttaatgccccgggattcctctcccctcaaaccttgaacatgcaaactttgcctcgggctctgctttgaaaggaactacaattaagaccttcttccctcataccaaaataaatcatagatgggttagagcattacaatataaa

SEQ ID NO: 244004 - DNA, 470 bp, Homo sapiens
atgtttctgttattgattgtgcttttcttgtcatatttaagaaatctttgcttaactcaaagtcacaaaagatttcttctatgttttcttttgaaattctatagtgttagattttacatttatgtctacagtccattttgaattaatttttatatggtgtgaagttatgaattgaagttcattttattgcatatggctaactgttccagtaccatttgctgaaaagattatattttgtaccttgtgggaaatcacttgaccatacatgtgtgagtctattcctagactctctattctgaactactgacttgtctatctttatagcaatactacactgttttgattattctccaagtctggaagtcagggagagtgaagtcttcaaactgttcttttttgaagttgtgattactctaagtcctttgtatttccacatgaattttagaataaacttgtcaacttctactaaa

SEQ ID NO: 244005 - DNA, 1283 bp, Homo sapiens
ggaaatgtcctgtgtctctcactatgctggttagacaactgtatacatttaccaaaattcatccaaatgtactctttggatgaattttattgtacataaatactatctcagtgcctaaatatcattaaaaataggttcagggtattaaagatactgaatatatcactgactttcaactcttgaactaatcacttgaaatcaaagaaatgatttttgcttgttatttgtgtcacaaagatatgtcacaaagatatgtgattattttcaaaacttcacttgactatctttcccctaaaaagcaagcatacatttaagttgaaaacctatgtattttactttccataaatttctttgcacaatattctgaaaggatatactgttagtggctatgagttaacgacatttcagtatttttgctaccaccaaaaaatgcaaaccaagataaggaggctactgcccaatggctgatgtttgtgaatgaagctgtatgcagatgggcaaaaaagggggtatgtgtatcaacaattcctcaccaaaggaaccagatctctttagaaaaatggattccattgttagagcaggaaaaggacaagatgaatttagaacatcttgtaacagaatttaagaggtgctcataaaaagcctgggacatgtcaaaaggacacaggaggtggcctgaaaggggcttccactgaccaaatatgaaacattaacagaaaacttattgcatagaataagaatcctgacttcaaactgatacaggaaagggacaggtcttcctcaaagtataaagctaactaaaaaatacagaagaaaaaaaggggttaagaaattaccattttccatctatcagagcaactgatttaggcaagaaactatcactgatactaaaactaaaatggatcaaagtttgataagatgtttatacagcctcaaagtatctccccacaaataacttatttattataaaggggaaaatagtaatatttcagtggagaaacctggcagacatcaactcaccaagtgatcaaagttaacatcacacatacacacacaaaaataaaataaaataaaataagtaaaaacaaagttaacatcacctgattaaactggcattgtatgcttcatgatatgatgcataaaggaggatatatcacttatttaataatttatcacttatttaatattatgaacttaatcataaagaaacatcagaaaaacctaaattaagagaaattctacaaaataaatgttccatcctattaaaaaatgtcattgtcatt

SEQ ID NO: 244006 - DNA, 305 bp, Homo sapiens
tgtggttcttgtcatcttgccaaagggtcacagtcatttttaaaaatcttttcatttacatctcagaatgagagtgtgaaatatgatgtgaaaaatctgaggccccacaaaatgtttttttgtttttacaaatagaccatttagttgagttcttttcttggctgaatgtctctgccacaggcttgggtccttcttaaggagagagactgagtcatatatttctgaaatccaaaagtacctcaaatataacaggtgcttaacagatctatgtcgaataaaggaacaaatctttagaaaatctaaca

SEQ ID NO: 244007 - DNA, 483 bp, Homo sapiens
tgtagggggactggaatagaaacaggaatcaaagtgaggaggctgtggtaggtgtccaggcaagagactgtgtctgttcacagtacggaagacaaattcaagttatattttggaggtgaaatcaaccaattgctgatggctcagatgtgtggggcgagggaaagaagagtcaagatggaatcccaggttttcatcctgagcaactgggaggatagtggtggtgtttcctgagatggagaggaatcggaggagcacctggggccagatcatgggggtgctgtgaacatcagctgaggggtctggaccagaccccgcagacaatggggagcttgggaaggcttctgagcaacagcagaatattcattcagtcattcaacaaacatttgtggtaaaagcttgtccatattctattctctcacagacggcaaagctccccacaagcagccgtgggttatgggccacaaacatccttcctgggcctat

SEQ ID NO: 244008 - DNA, 257 bp, Homo sapiens
ggagaggccacaatagtacctggtcctgccatgcatagggacgcggctgctctcctggaatggtaacagggagatcatagccagccagcggggagctaggcagcaggaacgaacaggccctgcagggggcagcagctgcagctggagcaatggtgggcgggcaggcaccaaaacctctgcactgtcacaggcccagccacctggcacctcctagctgccatggaaatacagtgagaaaaccagtcggaattcttatt

SEQ ID NO: 244009 - DNA, 376 bp, Homo sapiens
cttctaggggcgcggacccttcggcacccacaggagtggacactaagaacacgtgagacgacaggggcagagatggggtgtcccgggcaggtagcctgggtccagcacggcagccagaaagacgaggaaaacggagctggccctgggcaggcacgagcctctgagcctagagagtgaaggtaaagggcgcggggagaggaagcaaagccacgaggagggcgggtctccctgggcgcgggggcacgcgctgggcaaacgcgacaggacccggggagccgggaccccgacatgcaggaggagatcgcagccctaccccaggacgcagggaacgagaaaaggccgcgggaggccctgtgacccgcggcctccctaagcc

SEQ ID NO: 244010 - DNA, 410 bp, Homo sapiens
tattgagaaacggaacacagccagacgtatgttaacaagaagatactgggcccaggctaccccagaaagaagagcgggctccgaaggcctggcgggccgcttgccatctccccttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctactgtgacaagtcaatgaactcttgtctatcaagactattgtgtttttgaaggaaaattgagactttcctagctttcaattgtatgtcgtcaattac

SEQ ID NO: 244011 - DNA, 570 bp, Homo sapiens
taggaatcctggcaagatccccagatctactgtgttgttgtccagaggcaagcatgagcagctgagcctcagagagagcttacagtctaccaggcttaaatcctgtcagcaggaatgccaaaggccaaaccatgagaatctccagaggaagaacagcttcgttatcacagtaatctgcagtctcttaagtggggtgtatatgtttttggttttgagatggaagaagagctttttgtcctgctaaaagttgccatataggagaaaaactttgagttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctactgtgacaagtcaatgaactcttgtctatcaagactattgtgtttttgaaggaaaattgagactttcctagctttcaattgtatgtcgtcaattac

SEQ ID NO: 244012 - DNA, 369 bp, Homo sapiens
cacccactgtctaaccagtcccaatgagatgagctgggtacctcagttggaaatgcagaaatcacctgccttctgtgttgatctcgcttagagctgcagaccggagctgttcttatttggccatcttgccagccaccgtctaatggcttttcagagtacgtgcttcagttatctccacatgtatataaaagtttattcattacctcatagacacactgagcttgactgctgaaactggttagaagaaaccacaatgtttatagtacatacagtaaatacaaggctaaccacagcatgatgatgcaagaaaggatttaccaaagcagagaaggggaaaatgaggctttttttattccagtggacacaggg

SEQ ID NO: 244013 - DNA, 189 bp, Homo sapiens
cagagatgtaagccatgttgcaaaagtgtcacagcagcctttagttctcgcttctgtaagcctgcttcacgtagttcctgcctcaaaatgcttaaaagggactcgttttctttgttctgggctcagcctttaggacacatgtccactgggcctgtgtacaccttaaaataaacaccctcctgcactcca

SEQ ID NO: 244014 - DNA, 603 bp, Homo sapiens
taaactgaaggcccggtgcggtggctcccacctgtaatcccagcactttgggaggccgaggtgggtggatcacctgaggtcagcagttcgagaccagcctgaccaacatggtgaaaccctgtctctactaaaatacaaaattagctgggtgtggtggtgcatgcctataattccaactactcgggaggccgaggcaggagaatcagttgaacctgggaggtggaggttgcagtgagctgagattgcgccattgcactctagcctgggcaacaagagcgaaactccgtctcaataaataaataaataaataaataaaataaactgaatagccgtcctttgtgtgtatccaccaccttttgttcatccactcatctgttgatggacacttgggttgcttccagctcttggctgttgggaatagtgctgcaataaatatgggtgggccggctgcggtggctcacatctgtaaccttggtgctttgggaggctgcagcaggaggatcacttgagcccaggaggtcaagaccagcctgggcaacatagtgagaccctatctctattaaaaaatgttttaaaattaaaaataaaatgggtgtactaata

SEQ ID NO: 244015 - DNA, 283 bp, Homo sapiens
caaaaatgttaaaaagaaagagggggcagctagtgctgtgaaaaagatagctagtcattctattagacataagataagactagttcagatcacaatcaggtcagtctcatgatagaatagttagaggacctcccacatcagactgatagcagttttggaaagagcaaaagcaatgttttagatgtgctacttttaatttgcatactgaaatgttgaataaaaagctgtccaattttttttctgtcatactatatgtcactaatataaatttctgtatgaaaca

SEQ ID NO: 244016 - DNA, 464 bp, Homo sapiens
gaattttacttacacagtttggtaagacttctatttaaagaaagaagacgttttggaagtccacaccattgaactaaatcactatatacgactcagcactgggatttggatggaggctaagactggcttgggggaatcaatcccaattctaggaagcttttcctggcttaatcaggtcaagtccacccgctgaagtgatttcacctctttctgaccaggagtaacctaatgctaaactaaacatgccagagatgctccaaaatggaatagatccattacagtcttaattcagagcttttctccttatgtcaagggcaaaaacgggtttgtttgtttttttaaaaaaaggaactacttttcttacgtttcagggacttaaaatttttcaacctaatgtattccattctcagggttcacaataaaccccattttgcaatttcttctatccagaatatgctatctgg

SEQ ID NO: 244017 - DNA, 473 bp, Homo sapiens
gatcaggagccactgctgtcacatcaggaaaaagttccagttttgctctaccatccaacacctagccagactcgatttgcagctcagttgactgaagcaaaatacaacagctcaaagaataagccttatacaacatctgcctgaagggatttatgaccctggaagagatagatcagatcagaaacaaagatctgggagtatgtgatctgtatgatggactttgtttatggggacctgattcagtttctgccatgcatgcacatttatcatgaggattatatagataactggttgatgagatccttcacgtgtccctcctgcatggagccagttgatgcagcactgcttacatcctataagattaattgagccaggctctctcatctgacttccagtgaaccacatttttggtggttttgattgtttgtcactgagcccaaagaggcagggattaggaattaaaataatgcaaa

SEQ ID NO: 244018 - DNA, 328 bp, Homo sapiens
actttagctctgatgcctgcctctgtcttaatctgtcccttgggtattgatttgcatctctccctagctcttttgagctccttttagcaaatttcaggtgagcacactttcataaagtgctgtaaaataagtattgtaatttagtagtagatgaaatgatttaatgtatagaatgtgttattacagttatttattatttatatcttgtctgcttcccaaaggatatggcttataatacatagacacaattttttttttttttttgagatggagtcttgctctgttgccaagctggagtgcagtggcacgatctcggctcactgcaacc

SEQ ID NO: 244019 - DNA, 194 bp, Homo sapiens
aactggattaaaaatcatattttctatttttaaaattgtttgattggccttcctgggacatattattatgatatttcatcactttcacagggtgattaatgaaatgaaagtccaaatattttgaagtaaattttacatagttagcatttttgtattgttcttccttaactcatagattgaccttacacttgttt

SEQ ID NO: 244020 - DNA, 181 bp, Homo sapiens
ttagcaaaatgcagaaaatgatgctttttttttaaggttgcagttagagtcagaactaatattttaagtactggcacggtatgtagtatttccatagaatgtaaatggtagctatttttattttctttggatttcaatgtctttctcaaggtggcaaattagggctatatttatatgcttt

SEQ ID NO: 244021 - DNA, 433 bp, Homo sapiens
  misc_feature (179)..(179): n is a, c, g, or t
cagacaaaggagggacctgctgaacagacggtgcggaggccaaggccagatccacacacaaaagtacaggacctcagccttggcaggcaaaggagggacttgctgaacagacggtgcggaggccaaggccagatccacgcacaaaggatgtcacttgtgggtcctaccccaggtggtanttgcttgcaaaaagcagggctcctcctggccctctgcagtctgagtctcagtgaggataaacccagcagaaagctctgcctcaggctgtgctcgaatcacaggaaatgaatcttacaggggaactttggggtctgcactgggactattagtggtacgtaaaatgctttgtggaagaaaggttaaaattggaccctttgaaggttaaaaaggtgtatctggaagtagaatagaagccttcacttgagtgaacatg

SEQ ID NO: 244022 - DNA, 346 bp, Homo sapiens
gctgctgctttgggatgggggtgtgcttcagacagtcagagaagaaaccctgagtaatgctgacattgatgggccacgcagactatgatcagctccgggaatgtctgtgaaggagcagccaggggacagggctggcctggggggatctgcatccacacttcctgcagtcgtagtaattctcagtgatttctgcatatagattggtctagaaagtctaaaaatagtctttaccgtcaaaactaactctctgcatgtttataccttggcttgggtgaactcgtttcagtttacctgtttcaacgcctagcacaatgcccagcatatagtaaaccctatacacttgttg

SEQ ID NO: 244023 - DNA, 490 bp, Homo sapiens
agggtaaatatattattttgtaaagcaaaagaagaggaaaggaaaatccaaagttccactattatttaactagttaaataggttgagatgtctaaacaaatcatttcttatatattttgctattaattggcctcttaacagtaatccctttgcttatcactgagtttagtgatgaccttaagggagcactgtggtaaaagttaggggcagccctttccagtcttggtgtcggcatattttgattttgaagagaagactggtggagtgaaaactagttaggaggccatttccgcttaatggctagatgcactttgcagagactttaaagtctttaaacggcttttatccactgcttgaagtggtctccttaggcagatgttcatggtcttttagcactaatccagctagatgtgtataaagttataccaacaatacataattgaatgtaaataaacctagcatattgcctgcttccacttttcctccagta

SEQ ID NO: 244024 - DNA, 463 bp, Homo sapiens
aatcatgagggaggaatgtggcttttttatctttgtagctatgttatttaggagtaaaatgggaggcaggattgcgtagttcccagcttgacttttccctccggcttagtgattttggggtcctgagatttattttcctttcacactctacataagaatagtttctaaagtctgaaacccaaggttcaccacaaacccctgaggagagagaatgtggctgtccccgctggggcgggggaggagagctggatgggaaatgctgtgggaaagtgcctttcccatgtcagattcttcgtgctgcgctccctttaaggtttggtgtaaatgacagaaacgattcctcattcactgggtgaggattatcctggagggtggacattcctggacaacagcagagatgacagtccttgacatcgtctccccccgtgataaatcgtcaccatgatgatgaatccaggagtca

SEQ ID NO: 244025 - DNA, 548 bp, Homo sapiens
atattgggtctcattatgttgtctaggctaagctcaaactcctggaatcaagccatcctcccaccttagcctcctgaaaacacctgcaaattcaatccaatactatagtaattcttaagccttttggtcttagaacccctctgtaccttaaaactgaggccacttagctttcatttatgtaggatatatcaactgatatttactgtatttgcaattaaaactcagaaattttaaaaacattttctcaggagaaaccagtggaggaaaaaagaaattttaagaatacaatcatatacaagcacacatgccattaagccattacggtgatgacatcacctcaggcacctgacctctggaaacctccattgtacccttgtgagagaattgagtgtcatgtcttagcatgattatgaaaataattttgagggccaggtgctccgaacttgctcaaatcaatagcaaagcagagagaagctcaacaacttcagaactcagtaacttcaagcactaatagaataaaagaaaacttggggccgaatttcttgcgg

SEQ ID NO: 244026 - DNA, 489 bp, Homo sapiens
tctcttgtctgtggagcctccttcaaacccagggaaataaaaccacctgccacgggttgtggttcttctaggatcttctatcaatgttctctgaggtccccaggagccatgaagctggggctgactcccagggcaatgggactgcagtgtccttgttctttcttgttctatgcatccatgctctgctccacccctgccccttcactctgcccacacacatccctctagactggccttgtggtcagagcctggagtgcatgggctgctgggggcctgtgggctgcactgggccagaacccctggcaccttcaagactggcctggagccagcaggtaggtgacctttccagggcctgcctatcccagctttctcctccaatccctcccctctcttgcctgggtcaattagagagagcttgtctgttggctgcctggcagggtggagttcaggggcaggtcaggagcccagtgacagctcggaaaaaaaaaa

SEQ ID NO: 244027 - DNA, 452 bp, Homo sapiens
ggaagctactgtatccgtcaggcaaaaggcagtgaggcctgaaccacatagtagaagtaagaaagaagtcaaatgcaaaacgtcctatggtattcaccgtctaagactagctctcaaaattcttctttaaaacaccttttgaaatatatatccttttggctgggtgcagtggctcatgcctgtaaccccagcactttgggaggctgaggtgggaagatcgcttgagcccaggaattcaagaccagcctgggcaacgcaggaacacagggacacccaatgtctacaaaataaaaattaaaattaaaaataaaccctagccgatcatggtggcacacacctgtggtcccagctactcaggaagctgaggtaggagcatggcttgagcctggcgggtcaaggctgcacgatcacaccactgcaccccagcctgggtaacagagcaaaaccctgtt

SEQ ID NO: 244028 - DNA, 373 bp, Homo sapiens
ttcaatgactgtgcagtcctcagaagagattaggctgatctttaccaattgacgtgaaaagatgatgatattaagtgaaaaaaaaacaggttgctggctgggcatggtggcttatgcctataatcctaacactttgggaggccaaggtaggaggatcgcttgagcctaggagtttgaggctatcctgggtaacaaagtgagacccatctctacaaaaaaaatcaagaaattatctggatgtggtggcacatggtcccagctacactggaggctgaggcaggagaatcacttgagcccaggaggtggagtctccagtgattcatgtttgtgttattgcactccagcctgagcaacacagtgagaccctgtctta

SEQ ID NO: 244029 - DNA, 421 bp, Homo sapiens
ttgaagtcctgtactctatttttagaagctcttttttacgtttccgtggttcagggcatcagtcataaacatatttattattcagcacaaaaatgttgttcagtgtcttaaggctgtttaaactttacggaaataataaaccagtggcacttcagtggatgtaatatatgagcactactgaacaaatttaagggcggagaattttgcggtccttcacagattgctgctctgtctgcgccgccatgaacggtattttgaagaatcctttcctattttacactgagagggttccgtctccatgcttctcacacgttttgattttctgcctcccactgaaagaaacgcttttgtagcccttcaagaaacttcctacatgtctcccctccttctctcctgcctcattattactcctttaaagaaa

SEQ ID NO: 244030 - DNA, 526 bp, Homo sapiens
gcttcagttccaggacaagggtgaaccagtgtggcacacagggtacaaaagttaaggaggcactcactcttagggtcatgcatgaccctagtcccagccctgcccatctgaaaaatcactgatgctcagaagcctttctcctttctgtctccctcagcccataatttatatttctattatttctcatctttagtacagtggttacttgggctctatcacttactagctcactacatatttttatgtagaaatgtctagcatgcaataaaatatggcatgcacagagataagacaatgtgattaacaagaagaaactaagcgaagaaagactcagaggattcagataatgtggtaatcagacatgaactttaaagtaacaatgcttaatctgttcagtaagaaaccagataaaaaatttcaatagataaatgaaatctataataaaaaaagaaatggaaattctatagctgaaaatttagtcactggaaagaagaacttagtgaataggttttaaaaaagaggcagg

SEQ ID NO: 244031 - DNA, 296 bp, Homo sapiens
cagggcatctgagttctagaggctggtggtgagagaagagagcagaagaacagaaattagcccaaaagaggctggaattcaagaacaagatttcatctgctggtagaacaccaaaagcagagcccgcctgacagtgctggaccaggagatgttgaaacagagcttcctctatgcattcctatttaagaactgaatcaacctctcagatttaaaaccatcagaaataactaagtactcacaatatgaagatgagtagttataccttgataacaaataaaatccaaacacttgattaa

SEQ ID NO: 244032 - DNA, 460 bp, Homo sapiens
ttagcctggcgtggtggcgggcgcctgtagtcccagctacttgggaggctaaggcaggagaatggtgtgaacctgggaggcagagcttgcagtgagctgagattgtgggcactccagcctgggtgacagggtgagactgtctcaagaaaaaaaaaaaaagacacaaggctgggtgcagtggcccatgcctgtaatcccagcatttgggaggccaaggcaggaggatctcttgagccagcttgagcaacatagggagaccctatctctacaaaaaaaattaaaaaatttgccaagaatggtggcatgtggaggcaaatggaggctgaggcagtaggatcacttgagcctggaaggccaaggctgcagtgagccctgattgtgccattgtcctccagcctgggtgacagagtgaatactgtttctaaaaagaaaaaagaaaggaaatatataatcagaggag

SEQ ID NO: 244033 - DNA, 449 bp, Homo sapiens
cggggctgccaggagtggtcttgggacgccagggaccctgtgtgtgtggtaggggggccactgctgacaccaacacagacagggttaggctcgaggacaaaccgtattcgccgccgccgcacctgccacgcacatcggaagcgttagcacagttttccctgcgtggggctgggtctcctacccaggctgagtttctcccctctaagaggaaacaccgccagccttctttctcctacggcctttggattctgaaaactcgctgtggggagggacgtgaggcttcggcaccaggaacccctgcgggctaagacggtgttggccaatcacatccagtcactctcctgggaaagtcacttttatggagacagccccccaagggggtctcaagatatattgaagttttggttagttatgtatgctgactaaatttacaagtaaacttgtttatc

SEQ ID NO: 244034 - DNA, 463 bp, Homo sapiens
ttgagacggagtcttgctcttgttgcctaggctggagtgcagcagggcgatctcagctgaattcaacctccacctcctgggctcaagcagttctcctgcctcagcctcctgagtaaggcacctgccaccatgcccagctaatttttgtatttttagtagagacggggtttcaccatgttggccaggctggtctcaaactcctgacctcaggtgatctacctgcctcggcctcccaaagtgctgggattaaaggcgtgagccactgtgcccagccagaagtgcctgctcttgttagggaagtgtagtacatatgcgtgtggtagtggtggggcatatcactttatatttatatacctggttgtttttcacctgctgttctgctcacattatgctatgtgtgaggattgaacatttatttgcttggtgaagtctaagtgttcaatgtatgtttgctgctattgtt

SEQ ID NO: 244035 - DNA, 229 bp, Homo sapiens
tgcccagcctcctgctggacaggaaacagaacccacctgaattccgacatcattctgctaaggacatatccagggacagcttgccctctccactccagcctctttaacaaccaggactggtgtgtcatctactttggaagggctcgttcaccttgctgatatcctctccctgcccccatactctggatatgagtgttgtttgttcccaacaatattctcctttgggaga

SEQ ID NO: 244036 - DNA, 516 bp, Homo sapiens
tgtaaatttcttgcgcaaattccttttacgtgatgttaaagcacattcccgaactgctataattatgtaatttatcaatgtgaaaagtggactttgagatgtagtagtccagagctaatatggtgagcagtaagggaatgcagtgtgtttagcgaggagctatttccgtgggaaataaatcttttgagaaagactcgtggatccctgggcttcactgtgagctgtgcatccaggtgataagaactggatcccaagttcagctctgacatgaaacactaggtgcaacagacaagtcccttaacctctttgagacttagcattcttatctgtgaattgaagtcagactagttgcatggttaccggactttggagtatcagtgaccagtaagatatttaaaattttggaataattttaggttcacaggaaagttacaaagatagataacttcccctaatgttatccttcacccagatttcctcactgttaacatcttaagtgacaatagtgcatttgct

SEQ ID NO: 244037 - DNA, 501 bp, Homo sapiens
agacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctca

SEQ ID NO: 244038 - DNA, 481 bp, Homo sapiens
tttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaatatgacttttaaaggacataaatttcctatataaggtgcaggggtgggaaaatataatttggttaattatcccatatatattctattagtgactggaattatgattaaccatgtgccaggcatcagggtgaatactaacatacataatctaatttaataacactaacaataataataaaatgat

SEQ ID NO: 244039 - DNA, 455 bp, Homo sapiens
atattttcttagtttcctagacataccgtgtcctctctcatagtatttttcttatgtttatcttgacctttgcatagcaaattcccccttattcctgctcaaaagttatcctatagaatctttcctagccagcctctgtcagctgtggtagatgaagccttccctttactaccagagtactctgttcttacctctctcatatttttttctctttcatagtattttcatatcgcataattctcttttaaatgagttctaagagggcggagatttgctctaggacttgacatatataaaataatgtttgccgtgagagagattggttgatttgcctttactgactgaatcactacagagggctttacaggtcagatgaagaatttagaatcagtgctatacaatgttatatgttaattccatctaaataaactcagattgcaaactgaattgccaaa

SEQ ID NO: 244040 - DNA, 747 bp, Homo sapiens
ctgcatttctgttgaaaaagctctgattccaaaacatttttttgatctgaatatgtgactctttactaatttcctttttgcgttgaaagagcaaaggaagttaagtcaattaagattgatgttctagaagaaatttcatatatcactgtttatgatttgttgctataatgttaaacagttacaattcattgtatctgagatgtttgctacctggagctgacatttaggcaaaaattatcaggtgtttatagattctgagaacagctggaaagactaatttcatatcttcattgaaatcattagtattccgggtaagggaaatggcactattaccatttccagtggaaagtggtttttctcttccaacttgctgccacattccaaactgtgagcacttttattttgtaccctgatctaccacgagagggtaaggaaaacacagaaaaagaaaaggggtaggccgggtgtggtggctcacacctgtaatcccagcactttgggaggcagaggcgggtggatcacgaggtcaggagatcgagaccatcctggctaacacagtgaaaccccgtctctactaaaaatacaacaacaacaacaaaaaaaaaattagccaggcatggtggtagtcccagctactcaggaggctgaggcaggaaaatggcatgaacccaggaagcggagcttgcagtgagccgagattgtgccactgcactccagcctgggtgacagagcgagactccgtctcca

SEQ ID NO: 244041 - DNA, 453 bp, Homo sapiens
accacatatttttcttctactttgtctatacactccaaccatttatatagctttccttctgtccctttttcatttaaaacaaaattacctaactccctaccaccttctcatttttctgtatatataaatgtttgtgtcaaacgtctgaaatttctggcttgtttgtatcacaacgtggcctcatctaaaccaaatacaatgatgtagtctaaaaacagaaaatgacatgtgttttagacctgcaagacactatctgttcaatggctgaggtgagggtctggactacagattttttataaagtatatgcagaaaaattacaaatcactaggaattctttcagttgtgaagaatgtctgacataagatttgaagtgctacctttccagcttatatattaatttgcttatatatttgatatgaataaatgctttttttctcatgggtccttgcgag

SEQ ID NO: 244042 - DNA, 456 bp, Homo sapiens
aagcttatcagctattgttaatgttagtgtattttatgtgtggcccaagacaattcttcttccaatgtggcccagggatgccaaaatattggacaccactgctctagtggaaaaagctcagaactggtgacaggttctagtctgtcaccaattatcatgtggccttctgtctgaccattatttcatctatatgatgaagaaactgaaatagttgattagctctcaatctggcaccttgaaaccttccagagtcctcaaagttggtaagagtggggatgagctacgtttaacataccagaaaacttactgtaaataatctattcacctgggctaggtacaagccaacaaaaatgccaagccacggtaatgttcactatctcacatagatggcctttttttttttttttttttgcaatttttttttttctaacattaacaatagctgataagcttaga

SEQ ID NO: 244043 - DNA, 581 bp, Homo sapiens
atttgggggcattgagttcataacaaacctaggttccagactgattctggcccttcagctatgggacttttggtatattatttagcctgtcttaacttcagtctccacctctgcgaagggagaaaatagtagtgcctgacataacatatgtaaagcaccgggcaccatgcctggctcatgggaacccttagcataagctgttgttagaaatgagaagctgctatggatcttactctgtcctgagtgctagggatttaacagactgaacatgtggcccataccttgcattatgttgctactactgacatcttggaatccctatcttctcatctctgctgtagcctcacttctctggttcttaccctgattttgcctcaataacgattggcttgctgaatacctactgtgtgccaagctctggatatataagttaaatttacgtctcaacagccccaagagttaattattattatatccaccattttcccttcccatatttttgtttggttggttggtttcagagaaatgaaccagaaactctcacagctaagtagcagagctaagatttgaacccacagttt

SEQ ID NO: 244044 - DNA, 378 bp, Homo sapiens
ctcactcccttcagtcatactcattagaccaaacccaactggaatcagtgcagccatccaccttctccccccaccttgacccactgtgtgctggtggagacaatcacacctccagagtttgctgcttggagctcacaaggctactgctatttcagacacagctgatgatctcacctcctgcattagagtgaggatgagccctctgagaggaactcctcaacttctaggctcccacctgagattccattctgtcgcactagtgtgttaaatccagttcttactggcttgcaagagtggattgttaaatgttcaggaattttatgagccagttgttaaacaccgttattactaaaaattaaatgaagactgggtgcagtg

SEQ ID NO: 244045 - DNA, 396 bp, Homo sapiens
caggtgtgagccacctgcccagcctgagatcagttttgtctggaatgttcttcatgtaaaacattaagattgccaatctgtaatttgcagcatcctctttcttccttctttaaatgaaactgagactcttccctgactttgatcatctgatccttttccctttttcatgagccatcaaaggctattataagctttcatggatctcatcacagatcctgtcaatatccttgggtgtaattgtggcgagataatattttgagatattacctgagaaatccttctctgaattttttactctttgccttttattcatttagtcaatgcattcattgcctcagggaaagactgttaccgcagaaaaccaaagaaagagcttctaaaatttctgaagcttat

SEQ ID NO: 244046 - DNA, 350 bp, Homo sapiens
atggaaaaaatagaaaatctcagttaagaagtagaagccgtaaagaagacacaaatagaaatttaacaactgataaatataataatcaaaataaacagaagggagctccacaacagaatggaggaaacagaggaatgaattggtgaatgtgaagataagacaattgaaactgcccaagctgaaaaacagaaaaaaatactgaagaaaaagtaaaattgaacagtgcctcaggggacctatgaatcagtaacaaaagatctaacattggagtcccagaaagaaaagaaaaagagggtgaggtggaaaaagtgcttgaagaaataatggtggaggcatccaaattggaaagg

SEQ ID NO: 244047 - DNA, 497 bp, Homo sapiens
tctgttattgtggccatgggaaatgaacacaaggacccctcaggcaggggttgccgcttctcagctcttcctgagaagctcctgagccagagagctcaggctggtttctgaggagctcatcctaacccactacacaaaccccatccagccgctcagcagatgcctcccctgcccctcaaccctccactcccattatagctgctccatctatgggaggatggcctgaagccagcgatgaggggatgggacaacggccaggctgtgcacacattccccctgcctgctgcctctccacccctagaatatccccctctatggctgcaggaatgcaaacttcctctgccttcttttctcagtgttccacacacatgttctcttgactttattgactaaacacattttagagcaaatactgatgctcagactggctctaatgcaacagagaatgcgaaaccacattctgtcattttcataaagttctgattgcaaacaacaat

SEQ ID NO: 244048 - DNA, 227 bp, Homo sapiens
  misc_feature (196)..(196): n is a, c, g, or t
  misc_feature (200)..(201): n is a, c, g, or t
  misc_feature (215)..(215): n is a, c, g, or t
  misc_feature (218)..(218): n is a, c, g, or t
catatttgcaatacacctttagcacagattaaattcccaaatacactcggctgttcctgagatcactccagtgccttcctccttggctgatctccttttgggctgccatcttcctccttccactgcagaatctttacagagtgctttcatatctcccagagaagtccccctatcctacttccccttcctaattccncagnngctcaataaagtanaanagcttaaaa

SEQ ID NO: 244049 - DNA, 291 bp, Homo sapiens
cgcggtgtacacaccaggccctctgtctggaaggcgcttcacaacctttctgccttttcccgcgaggctgtaggtctagcttagttgtagctttctccaggaagcccttctgaaatgctgcacacacctccttcacagcacatatgaccccgcaacaggaggctagtctgcagcgcctcgagggaagagactgggcccatccacatttctatcctgaagaccagcccagagccagcatctaggaagcacccagtaaaggtgtggccaatgaattaaagactggatgaatga

SEQ ID NO: 244050 - DNA, 386 bp, Homo sapiens
gcggccgcgttccggcgtgatccctggaagctgccagcaggtgctgctcaaggaaggaacagcttcagccataggtgacagtggcacacatctcactgaagacagagaaggacaagttgaaaacatggatttttgtgttgtaccatgtcttatgatggtatcattcaacaatttttaaaattagattttggaaaacatttttttatcttctacctcattgtattctttcaaccgccaagtgaagccagtactttaagcctcactgccaatttacagagcacagaataaaacagaagagaataaaatgatatgggttgcagcttcccagttgtaacgagcaaaaggataggagcctcagactcttagttctgaaccctgcctgggtt

SEQ ID NO: 244051 - DNA, 478 bp, Homo sapiens
catttaacgttttggaaaaatgtattgccctggtttgattctccaagaatgttgatggttacaggctcctcagaggagaccatcagtctcaggactaggacttaacagcttgatcatgatgtcagtaatagatgtttactgagcccactggtacacaccgtgctattactgagtctctttaactatagccatttctgacaaggaatttaccatctgcctcctcaaagtggatagtttgggtttgttcgtgtgtttacattgtgaaattatgtttatcaagatctctgtaccctaactaatcaccaattttttgagtgatcaaaaagacacagccaaaacaagtcacagcagtttctctacccggctgagctgactacctacaagagagaattgtggtaaattatgtggtcagtgactcagagaaaggtttgtagacaccactcgtgaaagcttgcattaaaataacacatgcaagagt

SEQ ID NO: 244052 - DNA, 272 bp, Homo sapiens
cttcaaattagagtccccctcgtcctgacatcctgtgtggtcggcctcggccagacacagaccatgtgtccagctttgggcttctcagccgagggagggtaggcgcgggagggagggaaaggctgagggcaaggcatccaaatggacacgtagttgggaaaactaaaaagaacatgggtaagaagaagagtggcccttcctttctttcttgcctagaaggaatttttgtagctaaggcataatttacatacaataaaaatgcagtgtacatt

SEQ ID NO: 244053 - DNA, 487 bp, Homo sapiens
cagcccaaattttcgctaagtcccaactgccatgtacaacattcagtatctttactaaggctaatgataccaaaaataggcaacatggactatttattgagtctttacattattagctcatttaatcctcatagttaatttatgaggtaggtcttgttatcccattaaacagatgaagttactaaatagttcctccttttttcacaaggataaatttccacaagggtaattaagtgatctctgctactgagacctccagaaattcacgtcttccattgctgcatatatcatattgagtaacatttcagtaccacccttttttctaagataaattttttactcttgatgacagcattaagaatagtgtgatagactttttttaaggagtgttaataatctaaaacgttgagaaagaaaatgcaaggcatgcaaaacctacccaattaacatgcaagaggaaaaaacattatcttaatgatttccaagt

SEQ ID NO: 244054 - DNA, 427 bp, Homo sapiens
ctagactttaatttattgcattttctccctttagacaggaagccacgtgaggtcaggagcttgtatctcctcatggagtgtgtgtcatgtgtcctgagtgtggagcaagcgtgcggtgcatggtaggccacataaaggtcaactccctgacgagaaaagctccagttactatgcagagtaagctgaactggcaggacggccaacaggcacgcagctcgtgaaacgtagtccccccaacgcaaatacgtgttccagcatgagaggaagggacattcctaggagccagaagcaaagacacgactcaaaacaacaacccgggcagctgcagccctgaggcctacagaggcaggtgacagggacgccagatggtacaagcttccagtcaggaaaggtcctgaggcccctgcatagagccaggtgctgatgg

SEQ ID NO: 244055 - DNA, 283 bp, Homo sapiens
ctgcactccagcctgggcaacagagcgcaagaccctgtctcaaaaaaaaaaaaagtcaaaaagttctgcctttttaagccaaataatgaaaatgtagtttgtaattataacatatgtagaagtgaagtggcatgacagcagtatcacagacgccaggagtggggatatgaaagtataccattaaaagatttttacacattatgcaaagtgatataatacttgaagacagactatgataagtaaaggcatatactgtatgttatatgccctagagcaaccacca

SEQ ID NO: 244056 - DNA, 991 bp, Homo sapiens
acccgacagcgcttatgtcagtgtctttgtcatgtttcatagaattgttagactttaaaagaacctcctgaaagtctgcctctgaacatttgtatggttctgccaatgtctgatgagaagaatgcttccctgtttgaggagtgtgttcactgatgagaggggacgggagaagcctggttgtgatttcaggaataattctcaaaggagattatactcttattgcaaaatggggtctgctatatattgttcatgtcactttattgcaagtgacatgaattatatgacattaaaaataatatgccttgaatcacactgattagacccagaaggatcattgagtttttggtggttttaaagatccaagaaagacctatctagcccaagtgtatgaatgagaagactgaagcccacagaagtgaactcagcaccagtgtctcaagaaccccagtactctggtttttttcttttttgagacggagtctcgctctgtcgcccaggctggagtgcagtggcgcgatctcggctcactgcaagctccgcctcccgggttcatgccattctcctgtctcagcctctcgagtagctgggactacaggcgcccgccaccatgcccggctaattttttgtatctttagtagagacggggtttcaccatgttagccaggatggtctcgatctcctgacctcgtgatccgcccgcctcggcctcccaaagtgctgggattacaggagtgagccaaggcgcccagcccagctgtacgttttaaaagtcaagcacttctgtttagcagcccatgtaagcttgtcaatcattctgaattgaaatgtaatttattctgtaatttcttcaatgcattatatttccccttttctttaaatgtatgtaacattgtgttctacagttttgctgccatgattccttggcaccgtgaattcttactaagcaatgtttgttaacagtatacaggctcgatactaggcaggaagagct

SEQ ID NO: 244057 - DNA, 523 bp, Homo sapiens
agttgatgcaggaaagggtttggagtattcaaagaacagaagggaagccactcaaggttagagaaaatagcaagggctggagcaaatagaacatcattagtcatggtttagagcttggattctgtcactagctagtctgtaagaatggtttgaaggggcaagagtgaaagaagagactaattgggagactcctccagaagttaaggagagaggtgatggagacttgaaaaagagtgggcagtggatgtggcaagagctggattaatttgaggtaatcgtagaggtagaatcaatgggaattgggtataggggatgaagaagtagaaagcatcggggctatctaggtttggagcttgagcagctagatagatgatggtgtcattttactgtaattagaaagaccgggccaggcgcggtggctcacgcctgtaatcccagcactttgggaggccgaggcgggcggatcacgaggtcaggagatcgagaccatcccggctaaaacagtgaaaccccgtctctacta

SEQ ID NO: 244058 - DNA, 941 bp, Homo sapiens
ctgcctctgatagttatgagggatccctttcaaacagaggaactgcttcaactgtttgttagggctaacccaaatgttcagaccccttcagggacaccttccaagaaaaagcatcatttttttttccaagcagcaattccacacagaggactcttcggaagtgttgattgcaagaagagggcttgggaaaccatatcctcagggagtgtttttctgcaggctctgatgaaaggaataagcattgtcagattttttaaatgttctcttacactaaaatacattaaaataactaaatatgtaccccaggaaacctgggagaacaccaagtaaagtgcactgaggataacgcaagaactaaagcctagctctggttccttcattcgtgcaatttatatttttttgagcaccgctcatgtgccagccctgtttagtgtcttggtgaggacaaagttgacatgagccttctctcagagttcggtattgtgggcacataaacaacaaaaaacctctctctcactagtaatcaggggaggttgcaaattaaaactgcggtgagggagaatttcttgcccatcagattggcaaaaattttaaagttggacaatgtcaaatgttggcaaggataggaagcaatatgagcctcatccatgctggtgggagtataatgtgatccacattatttggaacagtgtcacttttcctaggaaagttgaacatgtgtatataacctatgctccagaaatttcagtgagataaatacatggaggcctgcccactctcgtgcaccaggagacacatacaagcgtgttccgaggagcaccatccgtaataccggaaacaagactgtcgaccaactaaagagagcataaataaattactgcatatttatacaatggaacactatggtgatgaaaataaatgaagcaagaagcaagttgcag

SEQ ID NO: 244059 - DNA, 681 bp, Homo sapiens
cggtttataaggctcacagtatagataaagggggcgagagggatccaccagactatataaagaatggtgtggtaatgggcccccccacaaaaatattagcaagagagatgtaagcgaacaggcggttaagagatggagatggaatctcactctgtggagtgcagtggtgcaatctcggctcactgcaacctcagccccccaggttctagcgattctcctggcacagcctcccaagtagctgggattacaggcacaacctaccatgcctgactaattttgcatttttagtagagacagggtttcgccatgttggccaggctggtcttgaactcctgacctcaggtgatccacccgcctcggcctcccaaagtgctgggattacagacgtgagccaccgcgcctggctcagagggccttttctaactggagaattcctgccagtctccctgccgcttggcctcttctcctcatgatgaatgaatagaggagggaggctcttaattctcctggagtcagctccagacagacagggtattggcatgccaatttccagcctcagtggtaaaggtcgacacgctaatcaccctcctccatgaaacgtgacaaaaattacctgaagaaagccacagccaagctccaggcccctgccccacaaatccccttccccatgcctctctcaag

SEQ ID NO: 244060 - DNA, 772 bp, Homo sapiens
aaatcatttgaccataatttatagctggttccattttaacacgtttgcttccatatatctcatggcaatgggaactgcaagagtaatgtgcatattgcatttacctcttcagtgacctttattccagtggcttgggaacaaaagttaacttcagaacttatcttccacaggacaatgcaatgtagttgtaggtagatggcacagggtcagtgctttccttttaatgttgtaaaatatatacatttatattggcttatgtttacaatagaagtcttctgtttaactaactttgcacaggtttaatttgattcagtgacttagtctactaattaatgaattgtaggaaagttaaatatattagaatgaacttgtgaaggcgataactataggaaaaaatcttttgaggcactgtaattattgtaaaaattaatctgtgacggctaaataaaatgctgcactcagaaaaaaaaatccccgaattgaattaaaaatgattagcatttatcatttacttttaacatagtgcttccaggcaaagggggaaagttggtggtaaatagaagtttggattttttttccttctccttgggagtgtgtgttagttactgttttttagttttgatctatggaaacaatgcttatttaggtcccaaatgcttcccctctctttttaataaactttttggtgatcattttaacatagttaatattattaactagggatttgttttttgtggttgtgtgtcgtaagaaaagtaaaattcatatttgg

SEQ ID NO: 244061 - DNA, 538 bp, Homo sapiens
ctttattgaggtataactcatatgtatcaaattcagcaattttatgtgcacagctcaatgagttttgacagacagtactacaactacctaaacgagtaagtcatagactctttccatcactccccaggttcctgcatggctctttgcagtcaatcccctcctcccactcccgaaccctgccagtctgccttctgtcactaaagttttgacttttctagaatttcatatcagtatcatcataaagcatatggtctgtgtctgatttctctcctttagcctaatgtttctgatggctatgccatagtttgtttattcactcacccattcatgaacatggaactgtttccagttttgggctattaagaataaagctcctgtgaaaatttatgttcaattctttatctgggtgtggattttctttttaggtaattatttaaattgacaaagaaaaattgtgtaaatttatcatgtaccacgttttgaaatatgtatacattgtggaatgactacgttgaaataattaaactgacatacttat

SEQ ID NO: 244062 - DNA, 393 bp, Homo sapiens
ctttattgaggtataactcatatgtatcaaattcagcaattttatgtgcacagctcaatgagttttgacagacagtactacaactacctaaacgagtaagtcatagactctttccatcactccccaggttcctgcatggctctttgcagtcaatcccctcctcccactcccgaaccctgccagtctgccttctgtcactaaagttttgacttttctagaatttcatatcagtatcatcataaagcatatggtctgtgtctgatttctctcctttagcctaatgtttctgatggctatgccatagtttgtttattcactcacccattcatgaacatggaactgtttccagttttgggctattaagaataaagctcctgtgaaaatttatgttca

SEQ ID NO: 244063 - DNA, 454 bp, Homo sapiens
gcaggattgggcagaagaagttgggctgtgattcagccacaacgagacctctgccaaccccacagggagctctgaagctaagactgcccttcaaagttatcctgagttggaactagggtacctggggcaggtaccttcatacctcctgcctccctcatctaccagtcgttggatgcaggctactcacaggaagagagacatgaccttgagcaaggtggctcttcttagatccaggaaattcccagaaggactgtcagctgtcagcagcaagcagctggggagttctttagtccttaaggaggatctaagtgtcaccacatgaagtccataccaatcattagaactaattattgctgggaattgtggtttgattcagcctaagttatctgaactctacttttatctggtctttcacactttttcattcttttccacccttccacagtcatttatt

SEQ ID NO: 244064 - DNA, 351 bp, Homo sapiens
aaaaggtatatgatttatctatcattggaataccagaagaagaaggaagaaaaaagaagaaatatgtgaagtaataatggccaagaatgttacaaaatcaatgacagactttaaaatatagatccaggaacctcagaaaatatcaagcagaatgaatgataaagtaagtaaaccgtgcacattatatttaaaaactgcagaaaaccaaaaactaagagaaaatcttggaagaagcaagagcttggaggggaaaataaaaacttacctatagaagaacagaataagaattatggcagacttctcatcaccatgcaagcaagaaaagagtagagtaaaatattttaaaagttg

SEQ ID NO: 244065 - DNA, 473 bp, Homo sapiens
catactcatctgttggtggtgggtggggggtggactggatgaggacagcattgggcaacactctttctggcctccccactgcagggagccacaattactgtgggaggccagggtagtccagggtttccctttgggccatcagcattccaactgctcctcctacttctggcctctggagaactaaattaccaccatgcacttcccattccacctgtgcctcagcccgagggtcctgctcttcctgcatattcaagctgatctttctagggagtagcctgcactgtgccagcactacccccttgtcacaggcagcacctccctgtgctgggggagcctcagtctgcccttgggctcaggcccctaggctcaggttagctgacattcccaggaaatcctacaacttctcctttcctttcatggctgtaagacacagtccactatcagtctcattgtaaaagacatttctaaagagt

SEQ ID NO: 244066 - DNA, 380 bp, Homo sapiens
cctcgcagcattgttgtaaggactaaaagagacagtgtacgtgaagtgcagagtatctggcattcaacaagtgctccctaatggcagtcggattggacggcttattttcccttttcagttctcatggcactgtgtagttgtactgtaactttagggggttgcttttcctcatttgttttaccatgaaaaatattttcttttcccctttggagaagagaagtggcacacacaccactgaggatcactgtgaaggtggagaggcgttgtagaagattggttaaatgcccgggctctggggccagattgcatgagataacatctttttttttgggatggagtcttgctctgttgcccaggctggagtgcagtggcacaatctc

SEQ ID NO: 244067 - DNA, 302 bp, Homo sapiens
ttctctttgcaatcctttaaaaaattcagatcatgttagtcctctgcttagagccctccaatagctttttgtcttaaagtaaactctgaaggccttgctgtggcctgccaggctaaccctcttccgaacaaccatcctcacttcgagccttgccagacagatctctttgctgtttcttaaaaacatcaagcttacacttgtaatcacagcactttgggaggccgaggcgggcggatcacgaggtcaggagttcgagaccagcccggccagcatggtgacaccccgtctctactaaaaaaaaa

SEQ ID NO: 244068 - DNA, 345 bp, Homo sapiens
tgatgaatcagagggatacctaaatacaaaaactgagtgaaaacaccaaaggatgagccaagtttgccaatgatagagatgatatcctactcatatttgctctgaagcaactaatacaatgcttcatacatggttccctcttgtgatgttcatcttaagctgactttttccagatacgaatgttgtgggtggcagcagaaaaacccagcacctgggctcacatagtgcttatgcccagtctcaatcttgatgcacatgcaccccgtgtgtacttcccctgtctgtctaatatcactgagtttccttataacttcagttcttaaaagcttcatcaccataacatca

SEQ ID NO: 244069 - DNA, 555 bp, Homo sapiens
gggtaagcttgaagttggtcactgcaaaagaagagcaaatttgtgtatatggtgagggcagtccatgaaaggatgctcctatcttttatttttctttttaacttttattttgacataatttcagacatacagaaaacgtacaagaatagtaccaaaaagttcccatatattatggtgtgcatgtgggtagaaacatttttctggaccacttgagaacaagttgtagacctgatgctcctttgtccctaagtacttaagtgtacatttcttaaaattaagggaattctcttacgtaaccccaataaaatcatcaaaatcaggttattaaaattaataaaacactattatctgatctacagatcttttcaatctcacttgtctcagtgatgtccttcacagcaaaaaagaatcccagatcctggtagcacgcagttttcataagtttgtctcctttgatctggaacagtacccagtctttgtgttttatgacattgacattttgatgagcatgagccagttattttgcaaaatgtcctctgttttggacccccttgt

SEQ ID NO: 244070 - DNA, 448 bp, Homo sapiens
ttagccctcattgatccattccgagctaatttttgtatacagtatagggtaagggcccaacttcatattacactattttttttaaaaagtatgcatatatgtttgtgtgtatgtatgtatttatatttttaaatgaactgcactgagtctatctgagctcgggcattactgttgagttatagaagagctaagttgtttgggggtctcaaatctatgtgataaatatctcccttaaaaactcacagacttcaggtgaacacaggtagtaaaaaataccctttccaaaacaaacacagtatgaaagctaagataataaaatgtagaatttgaagagaaaacatgtctcctgaaatccaaaggccagttgtatgaaaatgactgtggcagaaacatatataatttcaattgtataggaagggacaatagtctcaagacatgtgtcatggag

SEQ ID NO: 244071 - DNA, 458 bp, Homo sapiens
gccctgccaggtggagggtgagccgcctgtgtccatttcctggcagcgggataggctggccttagccaatgagagtggtgtcaccctgatgccagatggctccctgcacctggccgccctgccttcccgccggagcctcccttcccgtgcccacgagtaccactgcgtggcccagaaccgctacgggcggctggtgagccgacaggcccgggtacagctggcaagtaagtgacagggctgctcctgggattgggggatgagagttggtggggcacccacagaaggcacccatggggcccagactcgctgagagtgggcctgagcagggccagcccagccattagacacagtgtacacactggtagagcctctgattcttttaggggcccacaaaaatgttttaacttcttcaaaaccagaagaaaaaaatgaatacaataataaatatgtaaaaatga

SEQ ID NO: 244072 - DNA, 537 bp, Homo sapiens
tagggttatggtatataaaaaagaactaaagttgctaatttgaaagaggagctaaaactgagtaaatgttttaaaaataatttaaagaactttggatgggaaagaaggaagatggcaaaatctgtaactaaaaataaaacaaaattccagcaggtgtgaaaggatatgaaatgttgaatttgttcctcaattcacttttgcaaattaattacattcttttttttttaagacagagtctcactctgttgaccaggctggagtgcagtggcacaatcttggctcactgcacctccgcctcccgggttcaagtgaatctcctgcctcagcctcccaagtagctgggattacaggcgcctgccaccaagcccagctaatttttgtatctttagtagagttagggtttcaccatgttggtcaggctgaggcaggagaatcgcttgggaacccaggaggcagaggttgcagtgggccgagatcacgacattgcactccagcctgggtgacaggagcgaaactccatatcaaaataataataat

SEQ ID NO: 244073 - DNA, 373 bp, Homo sapiens
cacaagaaggattcaacacaggaaggtgcatttagaaagaatctatgacatattacattaaaacaaaagctggcaggacatggtggctcacgcctgtaatcgcaacacttcgggaggccaaggtgggcagattacctgaggtcaggagttcaagaccagcctggccaacatggtaaaaccccgtctctactaaaaatacaaaaaaatttagccgggtgtggtggtggatgcctgtaatcccagctactcagaaggctgaggcaggagaatcgcttgggaacccaggaggcagaggttgcagtgggccgagatcacgacattgcactccagcctgggtgacaggagcgaaactccatatcaaaataataataat

SEQ ID NO: 244074 - DNA, 229 bp, Homo sapiens
tgcctgtccttccatcctgtactaggtagaagggaggcatgagatgtagataagggagaacacacttagttgggatttagaaaaatgaggtggtacaaggtgccagggagttagaagagagggtagggctaagaagtgggataaagggagaaaaaaaaaagtgcaaaggcctcagaaataacttgggcctatttggataagtagggtcaattttgcctacagttagctt

SEQ ID NO: 244075 - DNA, 459 bp, Homo sapiens
ctatcttactgctaaaagctaatctgagatgcagaggattctacagcctgaaaaactgagaaaaacattgcaagactcacatactttaaacatgattacttctatgcatatctcaatttaagaaaagacaaatgcagtattatacaacactcacattttagcataattttgaggaagggtcttagctcataaatttggcctcctaatgtgaaaactaaatttctgaagcagggcacgttaagcctcatacctgggaacttgggagagatttgagaacttgagagagacttacttttattctcagttttgtcaaatagtagtatttggaccaatggcctgaatgaaaaactccttagaaagtgttcataggctgaaaattattcatcatgctggaatgcgcctacctcagaatatttgcactggctgtttcctgtacttggggactgtttcccctggaaa

SEQ ID NO: 244076 - DNA, 381 bp, Homo sapiens
ctcccaaagtgctgggattatagacgtgagccaccgcgcctggcccttatcacattttttgaccacctctgtgttgacatggcatacgaagttttctccaagtggaagatccccctcacaagattgtcaacaagtgtttggacttgagcaggaaagcagaggaacgatcatgaaattctaatacatttgagaatcctagtggtattaagattttctagctaatatagtttacatccctagcatatggttccctcaagagttcagcaaagcctttctagtaaaaatattaataaaggtcaagatgtaaattggaacaataagcagtaattcacccatcctaccaccagagaataacaagggtaggcatatgtgcgtatgtac

SEQ ID NO: 244077 - DNA, 572 bp, Homo sapiens
  misc_feature (405)..(405): n is a, c, g, or t
  misc_feature (407)..(407): n is a, c, g, or t
  misc_feature (418)..(418): n is a, c, g, or t
  misc_feature (516)..(516): n is a, c, g, or t
gggctcactctgtcacccaggctagagtgcagtggcacaatcttggctcactgcagcctcgacctcctgggctcaagtgatccttccacctcagcctcttgaataactgccactaaaggtgtgtgccaccatgcccaactaatttttgtatttttttggtagagatggagtttcaccatgttggccagactggttccgaactcctgacctcaagtgatccacccacctcggcctcccaaagtgctgggattacaggtgtgagccaccgcgcctggcaagagccttctttacttagcacagaagattgcttaataaatacttcttggttataaaaaaaaaaaaaaaaaaaaaaaaaaaaaaaaaaaaaaaaaaaaaaaaaaaaaataaaaaaaaaaaaataaaaananccaaaattccnatacactaactcctaatccaattcacccccacccccctatcacatcttttctcccaattactctccaaatcctatacctcctccacctcccttttttnacaacaaccttcttccttacttcacacttccacataaaccccctaccaaacaacta

SEQ ID NO: 244078 - DNA, 636 bp, Homo sapiens
ggtgagtcagataagggaagcaacaaaatcaatataaggatctactaccaagttggctactgcagtgaacatcaggtattaaatctgagctgctcaatggttctaagaagaaaacagactatgcctcagcattgtccaccagaagggtaaaatggagaagcaattcactattgtctccagcccccaagggctattgattgcccacatttatttgttactaatgaatgagtgctgagcagagtgccacaggcatcagagaagacctggcagaaagaggaaggtggagtataaaagagggaagagcagcagacacgtgagttgaggcactgccagcctgaaacaggccaaggttgcatatactgtgtatttattcccttgagtccctccttgcaaggccaccgcaggtatgatttatatcaccctacctaaggctacagctcctgttgggtggcccatgaacctgggatctgagccaaccaacttatctctcagaaactccatctctgaatgctccgacaaggaagagacccatggtaccaaaatgaaacctggttctgaattggagaatccaatgctctaggggatagcaatgtaaatctgccaaacccaaaaggctaagcatcatgagattgggaa

SEQ ID NO: 244079 - DNA, 165 bp, Homo sapiens
acgataatgtcttcaaggttcatccatgttgcggcctgcctcagaagtgcctgtctgttttttttgttgttgttgttttttgtttgttcgtttgactttgttttgttttgtgtttccatggagtctcactctgtcgcacaggctggagtacagtggcacaatctg

SEQ ID NO: 244080 - DNA, 509 bp, Homo sapiens
tatctgtcaggtgtaaattttttattttgatgtaatttcagacttgaaagttctaagaataataaaaattcctttgtgtttaccaccctgactgttatcactctcctgtatgtatgaatatgttttaatccttttgagagtgagttgtacatatgcctcttgatatctacatatttccttgtgtattttcaaaaacaagtgatataattatcaaaatcaggctgggtgcagtgtctcatgcctgtaattctcagcactttgggagactgaggtgggaggatggcttgagcccaggagttcgagaccagcctgggcaatacggggcaagccctcctccacaaaaaaatgagaaaaaaaaaattagctgggtgtggtgacacacctgtagtcccagcttctctggaatctgaggcaggataatcacttgagcctaggaggttgaggctgcaatgagccgagatcacgccattgccctctagcttgggcaacagagcgagactgtctcacca

SEQ ID NO: 244081 - DNA, 342 bp, Homo sapiens
gtgggttggagagtggaaagaattgacaggatgacctgagccctgaagtaggagggaagggctgcataagcaaaggaactggctttcgatagttcagctagtagaggactggaggatggaatgtatgggggcagatgctggcaagcaaatgtggttgagcaagtccatgccagaaatgccacaaatttaccaagagacagagtcaagataattatctatgctggctgggcaccatggttcacgcctgtaatcccaacactttgggaggccaaagcaggtggatcacctgaggtcaggagttcaagaccagcctggccaacatggtgaaaccccatctctacc

SEQ ID NO: 244082 - DNA, 460 bp, Homo sapiens
aggcaaacaatggcagactgcattcttcctacttctccaatcatatttatcagtcccattgggagaataactttcagtagtgctcaaaattaccagcatccaatttgtaactgcaaggaaccattcaagaaataaacacttcaagaaaagaaataaaccattcaaggaaagaacacttatgggttctcactcataagtaggagttgaacaatgagaacacatggacacagggaggggaacaacacacactggggcctgtcgggagttgggaggcaaggagagggagagcattagaacaaatacctaatgcatgtggggcttaaaaactgggtgacgggttgacgggtgcagcaaaccaccatggcacatgtttacctatgtaacaaacctacacattctgtacatgtatcccggaacttagagtaaaatttaaaaataaataaataaataacaaaatgtt

SEQ ID NO: 244083 - DNA, 281 bp, Homo sapiens
cagaagccccaagttgaagaagagatacaaagcttggaagcaggaagagatggagcggacacacaaaggaatccaacactggagaacggcaacgtaaaggtggcgtgctaggggaaagctccagaattcctgcagctgggcgctggagccaccctgaactttcaaagacctccctattccagtctccacaatcccaggtcctggtatgtccctggatttggggggagattctggctcctttgtagcaccacaataaacccttattgcctgagttatcccaa

SEQ ID NO: 244084 - DNA, 420 bp, Homo sapiens
agttgaaaagtcaaattttcaaaagcttctatctgccaccatgaacttaacagtttcctagtatttagaaacttttctgatttttccaaatgacaaatacatgacattacccgttcacatatgaataaagatctattccaagtacaagatagagaaatagattttaatgtaacaaaatagaaaaactcactactatggtttcagattctaatactggaattaatctttagaaaattatcactgttgaattttggtgtagtatgaaaggaagaatatcataattaccagaaaacaaatgattagaatattgctccatcttaatcacatatcatatatgtgttaggccagatatttttcatacatttccattgaaataatgtgttacaacactcacaaataaaaaaaaaaattcaaccatct

SEQ ID NO: 244085 - DNA, 394 bp, Homo sapiens
tgagtaaattccatctcaaaaaaaactactttgctcatccacagaagcaactcttctagcatctagaatggtgaatgatctccagaagcttttcaatttactttgcccagatccatcagaggaatcattatctatgacagatgtagcctagcaaaatatatttcttaaataagaagacttgaaaggcaaaattactccttgacctatgggctgcagaacagatgttgtgttagcaggcatgaaaacaacatgaaccttcttgtacatcttcatcagagctgttggatgaccaaatgtattgtcaataagcagtagtattttgaaaggaatctttttgtgaagccagtagctctcaacagtaggcttaaaatatttaataaaatatgctgtaaac

SEQ ID NO: 244086 - DNA, 378 bp, Homo sapiens
cataagatatggtcaatttgggagatatttcatgcacttttaaaaagcagccatattctcaattatcagagttcagagttcaatatacttctgtaggatctgcctcattggccatgtcactgaagtcttctatcttcttactaacggtttgtcttggatagagagtggtgtggtgaattctccagccctgagtataattttatcctttctccttgtatctcctgcactttttactctttgaaagtgactgtattattgggcacatgtatattaataactgtgataccttcatagtgaattgtagcttcagtgttatgaaaacacctccttttaaatctcttttaatgccgtgagctctaacatctactttgttagaca

SEQ ID NO: 244087 - DNA, 373 bp, Homo sapiens
accagcgacctcatcactatgtcaccaaagtgttttggaacttggtattccagagacttctggaacgccgtgcaaggcctgcccccagcaagccacaaccaggaaggtgcaggcacgcccccactagctcctcccctatttattgcctcctggaaaacccaggaccctcttccccatctccacccctacccctgggggcagcccagggagagccaggcacaatgagggctcccaacagctgcaaggatttatctgaacctttgagaaagaggaggagccatctaagtttctggaaacctgagccccaagtgagcccgggttctctctgtacctgcaactacctcatttcaataaagtctgtgttttcccttct

SEQ ID NO: 244088 - DNA, 496 bp, Homo sapiens
aatccatgttcatgggcttcttaataagacaagatatttgtaaagaaatagatttatataatattattaaccttaatataagaagaaaaatacatagaaccctatatccagcaattagaaaatgcacatttttctaggactgacatggtctatttgtaaaaaatggaccattgactaggctgtcaagtaaatcttaaaatttaagaatgcctggctgggcgctgtggctcacgcctgtaatcccagcactttgggaggcctaggtgggtggatcacctgaggtcgggagtttgagaccagcctgaccaacatggagaaacctcgtctctactaaaaatacaaagattagccaggcatagtggtgcatgcctgtaatctcagctactcaggaggctgaggcaggagaattgcttgaatccgggaggcagaggttgcggtgagccaagattgtgccactgcactccagcctgggcaacgagagcgaaactctgtctca

SEQ ID NO: 244089 - DNA, 627 bp, Homo sapiens
taaagcgagaactgaacaataaacagttttctacaacagggcttctataagaccagtaacttctatgctccccaaaaagtatttatgaaactatttgagtggttttacatcttgattattcttccacttaaatattgtctttaaatgacctgcctgggtgcatgtccagaatggaaatagcaaaagttagatgtcttacagtccaagctctacaagtcctagctatgtgaccatgttggttatgattagaccaactgcatttggtctaatcctaacctctgggtgttttaataaactctgatagcctccagggattattaaaaagtccagaggtgaggccaggcatggtggctcacacctgtaatcccaggactttggaaggctgaggcaggcggatcacttgaggtcaagagttcgagaccagcctggccaacatggtgaaaccccgcctctactaaaaatacaaaaaaaaattatcctggcatggtggcacacacctgtaatcccagctactcgggaggctgaggcaggagaattgcttgaaccttggaggcagaggttgcagtgagccaagatcatgccactgcactgtagcctcctgggtgacagagtgagactcagtctcca

SEQ ID NO: 244090 - DNA, 365 bp, Homo sapiens
cttaatgctagcagagtagaaaggaggtacaaatgagctcagttcttcatcttttatagcagggaatcaatagatacaagcatattagaattccgtgagaacaaagaaaacaggagggttttaaaggttgttacatttggaatatggcaataggagtaggatgggcaagaaacatttacttttagttctgtttttactgttgttttctgtatgctgtaggtattactggtataatttctgaaagctaggttgggcgcggtggctcacgcctgtaatcccagcactttgggaggccaaggcgggcagatcacaaggtcaggagatcgagaccatcctggctaacacggtgaaaccctgtctctatt

SEQ ID NO: 244091 - DNA, 180 bp, Homo sapiens
tttaaaatggtattaaatgtctcacacatggaatatggttggaccagtttaacctgtccaggcacagtggctaatgcctgtaatcccagcactttaggagggaggccgagactggaggatcacctgagcccaggagttcaagaccagccctggccacatggtaaaaccccatctctacca

SEQ ID NO: 244092 - DNA, 300 bp, Homo sapiens
caatcacagattaaatataaaatgataaaaccagtggcatagccaggttcaaaagcaagagaaaaagtccatggaccaaaaatggaaaataaatgcaagatggtgaatagtgctgatttcataggctttttggctccaagactgaaataaagcaaagattggcagtagcttgactctggtaggataccagggttgaatttccttcacagaagaagcaggacctaagccaggtagaaaacttgatgtcaggagtttcgaggaggctctctgttgtgaagagcggctgtatatatatataaa

SEQ ID NO: 244093 - DNA, 331 bp, Homo sapiens
gaaaccctttcttgatcgtgtgggtggctctgaaaagagcctttgggttcaggacgccgaggaacgcctcacttggagctggtgtacttggtgacagccttggtgccctcggacacggcgtgcttggccagctcgccgggcagcagcaggcgaacggccgtctgcacttcgcgggacgtgatggtggagcgcttgttgtagtgtgccaggcgggaggcctcgctggcgatgcgctcgaagatgtcattgacgaaggagttcatgatgcccatggccttggacgagatgccggtgtcggggtgcacctgcttcagcaccttgtacacgtaga

SEQ ID NO: 244094 - DNA, 407 bp, Homo sapiens
gcctctaaacttttcgcatccacaaaatgaagcagttggatcagaagatatctaaggttccttcctgtgctaagatcctagagtcctaaagttccattcttgttgttgtaatgaagtgaaaagcacacatattcataccaaaagggtcataaatttaagattcttctgtggagggactgggaaaagtctttacagttttaggttgtaattaagaaagtgaattatgctaaaattgactttaggaaaacaatggtgttttgtgtaaccacatggatatcatctgggtatatgtaaataggaggcaggtaaaaatgatgaatgctaatctctgtaaaattcaaatgaatattaactcttattcaaatagcacaagtacattgcacagggaaatcaagacgtgaattcat

SEQ ID NO: 244095 - DNA, 620 bp, Homo sapiens
agacagagtttcgctctcgttgcccaggctggagtgcaatggtgcaatctccgctcaccacaacctccgcctcccggattcaagcgattctcctgcctcagcctcccgagaagctgggattacaggcatgtgccaccatgcccggctaatttttgtgtttttagtagagagggggtttcttcattttggtcaggctggcctcagactcccgacctcaggtgatccgcctgcctcggcctcccaaagtgctgggattacaggcgtgagccactggcccggccagagctacgagttcttaaagcactttattctttgtatctcagtgagaaggcatcaccatgctctaacttagggatgatggcatcttgaattagttgtgcagcagagatggaaagaagtaggtagacatgagagagacagcttagaaatggcaatgatgggggttttaatgtactttcattattgttagatgaagaaaagccaagggttttaatattttatatacaggtggctttgagtctactgcatggataaggccaaactgggctcctgggggcgggagggcatcatgactctaagtggaaactgctatttcgagaccccaaggaacatgagaatgg

SEQ ID NO: 244096 - DNA, 693 bp, Homo sapiens
aaaacaaaacgttaaagcgtttctttaacagtcgtgggatgtgaatctgatcattttaaccctcatgtttgttagacactgcttatttgagctggaatttgctggaatatctgttatttatctgttatatactgtaccagatccaaatgatatattgtctaattttattactatgttcattaccttattggaaacaatacaattttgtcctgatacaatatgaaaaagactatttcttttcaactagggcacatttagatttgtttttgttttactgttgatttccaagagtgctaaatagtatctttttgttactatgtatacagacttgcacaaattttcatagttgtagttccattaaaggcactggactccaaaaaattatctaaagtatttttgttttccattactttaaaagattaattgaataaagcattgtggtggatctgtggctccattaatcattctgaaattgatatgtttaattctggattttgtttttgagagaggagataactgtcaatcaaatattgaacagagaccctagtatttcttttaagttcaaataaatctgggaggaaattgcaactttgttcatactcctatccatggaagtagatactcatgaagtatcataaatagaattttgcctttaatgggaaggcaaagctaataaagacattatattaaata

SEQ ID NO: 244097 - DNA, 419 bp, Homo sapiens
tcataaaaatgaaaaatgtctccctaactgaattataaagtctttgagaccagaagccacactatgttagaatgtgagcataatctgatttgtacagagttgatatttaaatatttgttagttggctagaatacatgagacataaaaatgcaaagtttaaagttccacttcagcatgaatagcagttagcacaatctgactaacttctctcaatattaaaacagaagacattactgaaaaaggtcaagacaagttaaactattggcataaatttttcccctacagaaggtcattctattttgaaaaacattttgaatggtaatagaattgtacaaataaactatctcagaatttaagcaagtgcttactacaatcagctatattaaataataatagtgtttatactttagtcaataaac

SEQ ID NO: 244098 - DNA, 649 bp, Homo sapiens
  misc_feature (515)..(515): n is a, c, g, or t
  misc_feature (518)..(518): n is a, c, g, or t
  misc_feature (537)..(537): n is a, c, g, or t
ataacttctctaatttaaaacgtgtgggggttgcacattttaaaaagccaaattaatagttttctcaagtttttgaggaatgatgtactcgcgtggagaaatttacctatgacaatcatcagtcctatgacatctgttctggcctgcagagctgaaatgaagtgggaaatcaatacattctcagacgaagaagaataagagaatttgtcaccagtagacctgcagaagaagaatgactaaaggatggtatctaaacaaaaacaagccaaaagagaagaaaccttggaagggagaaagaacactgttagcaaaactatatgtaactacaatagatttttcttctcctcttgaattttctaaagtatgatttctaaattatgctggttgaagcaaaaattataaaactctctgctgtggttctaaatgtatacaaaggaaatatttaaggaaattattttataaattggggaattaaaggtaaataaaggtataatttcacaggatgtaaaatgganaanaaaaaaaaaaaaaaaaaanttgggccaagtggattttaaattggaccaagctatggcttgcggccgaatttggggctaacttgcgccaatgcccctataggggggcgtttaacattaactggccggcgttt

SEQ ID NO: 244099 - DNA, 403 bp, Homo sapiens
aatttcttttaacaagcagcacagaagagaaaaataccacaggaaagaggcagaacaccaccaccaaaaggagaagcccccttgcttctggagacagatggctttccagggttcagatggtcttcacttatactaacaatgctttctctgttcacaaacccctctccagaaagactaacacacacctaaatattgccaagagataatgactccggttatcactctgtaaaaatgatacgatgagcagttggtcttacaagggagccgtgagaatgtgtgtggggctgcctggagccaatctttactagctgtgtaaccaggagggagtgctgtgaccactggcgcctcagtaaagtggagataagaatggtacctaattcttcaaaacaaggatctctgagta

SEQ ID NO: 244100 - DNA, 457 bp, Homo sapiens
aaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattg

SEQ ID NO: 244101 - DNA, 467 bp, Homo sapiens
ttggaatcaaccaagtcttccaagctcctgttaaggttgatattttgacatcctcccatgaatcatgaatggtcttaatggcattcacttactagagtagtgaattctgtccagaaggttttcaatgtgcttagcccagatgcatcagaggagtcattttctatggcagttctagcctgatgaaatgtatttctttaataataagacttgagtgtcaaaattactcctttatccattatgggttgtggaatgaatgttgtgtcaacaggcatgaagacaacattcctttccttgtatgttaacatgcaagggctggtccctctgcaggctctcgggaggatcccagcccgtccagcctcgagcatctgaggccctgtcatgctgcatcactgcctcctttctccacattttgaggaccctgtgattcccttgggcttgtctgggtaatccaggacaggattcttatt

SEQ ID NO: 244102 - DNA, 746 bp, Homo sapiens
tgaaagctttaaaaaactccatgaaaatttgcaaaacttaaaaaaaaaatgtagaagaggactaaacttgataaaatattaaaagaattgaaacccttcctaaaggcagcttctcaagggagcacaagttcacacacagtttacttttggaggaacgtctgaggtcatgaggactagattctagagctacaggtctcagggacagtctcgagggatacagggcccccatcaccacatccccagatttaaccgcagcagctcagcttttatctgtatctgttggagctctctaggaaatgtcaataccaaagcaaacccaaatcacaactagattagattactattcaagagaatgattctctaccgaaactgtgcaaaatggggatatcaagagagttggaaaatgtaagacgtaaagaccataatcaggaaaatacgcatcatatttgttattcactgagagggaggaatttccacttaaatcctatttccagcagctggattgtgctctcagtggagtgctctggattctgattaatagagattttctagtcctcccagcaacttccttctcaattctcttcactttccgcagatctcggcaccagggttgcatcttgtgggctccattgtgttttcacacaatgtgctatttgtccttcacagtgttttggtttatttttctgtttgtccatcttgtttttgaacaattgccagcatttaaaaatgaggaaatctaaaatctg

SEQ ID NO: 244103 - DNA, 247 bp, Homo sapiens
acatatccagttaggtgacacttcactatgtatggagaaacctttaggctgaacttaaaatatgtaaggaggcagctttagcctaaacttaatttaacaggtggtagcaaaggttctaaggagggagattcttcattcaacaagcagggaaccctacccgagaggggcaacatgaaggcacgcaggcttgggctcactcctgtttcccagctcatccttgtaataaatgtttttcaccatcaaaaca

SEQ ID NO: 244104 - DNA, 451 bp, Homo sapiens
tctcaaaaaaaaaaaaaagtgccagcgtatgaggtaattagattggttctctccagaggtaacctgccaagaagagatgctatagatgttactcatatactgtaaaacattgtgaaatcagattactttaaaatgatgtattacaaagttttgcaaaaaagcagttgtgactgtggaagcccaaggcttatatcccagctctgtcttacactaaatatgggtacagtgtttccactctgtccataaaatgggagctaatattctccaacctgtgtgcctgacatgatggttaaaaggattaaacaaaacaatagtttgtaatttattctgtcagagcacactgctggtaaataaaagggagtaagttgactaaaactaaatttaaaaaaaaatcctaataaaacaagtttgtaatttataattgtatacaaataaaagatgttacaaaaaa

SEQ ID NO: 244105 - DNA, 426 bp, Homo sapiens
actggagtaatgttgctttccatacataactgttgaggaaatgtactaacacagacgagatcaaactgaaaaagaattatatgtccaatgttctagtcctagaaagaatacacacacttcctctctcttcctctaaatccatagatgttagcagtgaaagatactaagaaaatgaagaactagaacgtggaatattgtcacatggaactaacataagaagtaaaatgtaaatgaaggaattttatacatgtgcatttcaaatgatctcgaccacaaaatcagagaaatgacagacgaatacatgaattatcaaaccattcgctgttcaaaaataaacttctgaactttagtgtttgcttaatggaaagttctttcttttctttactcagttatgacctcagacatgcatcagaactcaatgcatat

SEQ ID NO: 244106 - DNA, 428 bp, Homo sapiens
gggtaacagagtgcgaccctctctcaaaaaagtcaaaataaaaagtaattcttgtgagcatcaaatgatgtgtggaaagagttttaactgtgacagatgataaggacataaaaaggaattgctataagcaaaacacatgattacattttttcctcaaatatatttctaaacctgttactgaagttttgccaacgaagggttgttaggtgagaaacaaaactgagttctataatgtatcatgctcattgctaacatataaagcttattatttataatagtttttctgttatttatataatcatacttcagagtaaacgaagaacttctatgttagaaaccagcctctcagaggatttgtatatctaacctataaacagagaaaaattaagctcaaagatctgacacaactctcagaaagtttactttat

SEQ ID NO: 244107 - DNA, 332 bp, Homo sapiens
taagctcaaagttaaagaaggaaagaaataataaagatcagagcagaaacaaataaaatacagactagaaaaacaataaaaaaaatccataaaagtcaggttttaaaaaatatataaatatatataaaaatataacatataaacaaaatagacaaatctttaagaaaaaagtctcaaaatcagaaatgaaagaggcaacattacaaccaatattacagaaatacaaaggatcttaacagactactatgaataagtatacctcaacaaattggacaacctagaagtggataaatttctggacatatacaacctgccaaaactgaaccataaaa

SEQ ID NO: 244108 - DNA, 419 bp, Homo sapiens
gccctcacatggaagttggtgccttccgtagtcctatttcatatgaagattggcttggcatgtggagggcactcattcggcaactccccaggctttgggcactgtgtggaggggcttgtgtagggaccagcaggcctggtgtgaggggtccaggcgtcaaggagctcctggctgggccctctgggcagctgcttccactcttgtctctgccttctcatctagagagactcccaagccctggaggggtgtgttgtgttaggaattaactccctgcctaccccaaggcctcagaaatagattattagagatgtgaattattctttgagacttgggataagaaacagccaaagctaaacatatttcagttttaaaaaatcagtgttttataaaacacagtttggggcttttaaaggtacata

SEQ ID NO: 244109 - DNA, 644 bp, Homo sapiens
ttccgtcttgccagcccattctctctaatgactgtctccctcgctggatgtgatgaagtaggctacattatgcagcaccccatgaaacaaagaattgagtgtgaccaccaggcaacatctggcaaggaactgagttccaacagtgcacaaggaagtgaatcctgacaacagtcccaagagcttaggagtgaatccttctccactccagcctcagataagtcttgcccttaattgcagcctcatgaaagactctgaaaccttgggcccaggtaacccatgccaagattcctgacctgcagaaactgtgggtcatcaagcatgttctttcaagtctctacatgtgtagtaatttgttatgcagctttagataaccaagagatggaacaattggaactgccctacagttacggtggggcataaaatgacacaagcattttggaaaacagttgggcagtttcttataaaattaaacagacacttaccctaacacccagcattgtgctctaggtatttacctaagaaaaataaaacgtgtttatacaaagacttatacatgaatatttatagcagttttatacataatagcctacaagtagaaacaactcaaatgtccatccaaagacaaataactaaagtatggaata

SEQ ID NO: 244110 - DNA, 399 bp, Homo sapiens
gcagaatcattcagccttaaaaagaaaggatattctgacacatgctacaacacagatgtacctcaaaaacattatgctaagtgaattaaactagtcacaaaagaacaaattgtatgattctacttatatgagacacctagagtagtcacattgataggtctgacctttgtgggtccatgtatacatgaattttcttccttatgcagcaagaccaccaactccctaagttttttggtggggggggtcaaaaattatatgcaggtttttgattgtgtgatgggttggtgcctgtaacacctgtgttattcagaagtcaactgtatttttaatgccacacacagtttaaaaaagaaattagtttctcctaatgtgcacattaaaagtagtaaaaatggccaa

SEQ ID NO: 244111 - DNA, 499 bp, Homo sapiens
acattagtatcaaaggtacactgatgcaagaccagcaactgggcccctgtgtcagattaatatggcttttgtggagcattaatccacttttttaaaaaatataaaaggttataaaaaggcttattgaattatatcttttagtcaagttgtttaaaatttagtagatttatttataagatttgagagacatttaattggtcttgacctaatgctatctttattagagcttactgtttgggaaattaagtctcctgtctcaaagtataaagggtttggccatttatttttacatctttgagttatcattttggctaaatgaatgacttatttattttacaatgacctgtgatcctatttcgtgatatcctgtgttttaaacttttcatatttgacaaactttctaaaatcaaatactaaattcagtccttttgacctcactaatgttttgatattaggtcccctgaagtccaaaacagacatatttggcttattttctaca

SEQ ID NO: 244112 - DNA, 384 bp, Homo sapiens
attcttacctgcatgtatgataaaatgtataagagttgcagttcctccacatccttgccaacactcggtggtattcatctttttaaattatagacattctaatgggggtaaagtgatatctaattgttgttttcactttatttcactaatactaatgttattgagcatgttttcatatgctattggctatttgtatatattcaaatatctattcaaatcctttgctcatttttgatagaatcattttttttaattattattgagttgtggccaggcgtggtggctcacacctgtaatctcagtactttgggaggccgaagtgggaggattgcttgagtccaggagtccgagggcagcttgggcaacataatgagaccctgtctc

SEQ ID NO: 244113 - DNA, 1294 bp, Homo sapiens
ctgaaagatggtgtgcagaattctaatgttcttcctctcgcggggtcgtgggggctttcttccagttctctgggttctgatcgttggggctgtcctgacacccttcttcagatgaccgctgtcaggttggtgaaggcagtgcgcgttgggccttccctccctagagatgtgattgcacgtcgggtaccaggagcctggccagccctcagcttctgctaaccagggagcagtgaagcccggtttacttttgttggcttgtttattttctaatgtcacctgcctctgcactttaagtagtatttgggctgttatggagtgtgcacattctaacacagcaccttgtcagctggctgagaagctgaaaattctcggcattcctccttgatgtcaattacttcaaggagcaggaaggtgacttcttttaacaagtggaaaggattcaggtaacaaagccatttcctcttcttaaccctctactgtggaaagttattgacttagcgacacagtctgtttatctgggcttcaggagcagggctttggagactgaaggcttctccccacttttgtgcaatgttatatattttttctcactcttcatccagtctgagtggggtctgccccctcccctgagcagtcaccatcctgctacccactccggctctattggcgactgtggcatagggtggtggaaaggacgctggactgagagcccagagatcagatgtctgaccttccctctgcctggaagagctgcctggcctctgatcagggtccctaccttcgttttctggcctcactcactgtggcccaccatccagcagtgcaggtgtcctggggactcggggaaggtcagaagtggaaggaaagcctccaagccctcgcatgcaggcccaccattccactgtcaggttttcttccctttccttctgctctacattttgtgccagcagtttgggggtctcctgaatcttatcccttcgcagcggtaggcaggtgcaatttctggccagtcactgaacatgaagaagcatctataggcggagttaaatccaaaacacttggcctgacacacctggccttgaagtctcccccagcctctcctcttgtccccaacagtggttcatgttctagccacacagaaattgagggggtcctgtgttatctgtgttcctgcagacagaggcttgcctaggacagcaaaagtcatctaacataaatatatgcatgaataaactcactgtcaaaattcagccacccaattccatgataatcagtcatttactgattgccagag

SEQ ID NO: 244114 - DNA, 454 bp, Homo sapiens
tattggactggtctagtctcattgagtatattaaacttgaatctagcctgaacataaagttttctgattgctaacttttaaatatgtattcataaagtctagaggtgagggtggggggaaaatgaatatttatttgtcatgtgccaataagtttggtcagtacaattatctttatctcatttaatttttacaactaccctgaaaaataattcttacaggaaaaaagaaaaaaaacgtacagagcatgaagaggggtagagtaggaatgcttgttggggatacataggttaatagcaaccttagatctagatctggcttggtcttataggagaataacactgactttgtttttgtggtgttttttttttttttaaaaatccagcagccaaaaccagatttatctcatgggtggattacttaactcataaggctgatatattaagctaaatatacc

SEQ ID NO: 244115 - DNA, 812 bp, Homo sapiens
cattccagaattagattgtggtgatggtttggttgtacaactttgtaagtatactaaaaaccactgaattgtacacttttaaaaaagttaaacatattgctaccatatgacccagcaattctactcctaggcaaatatccaaaagaattgaaaacataaatctacacaaaagcttgtaaaggaatgttcatagcagcattattcataatacctccaaagtagaaataacccaaatccatcaactagtgaatgcataaacaaaatatggtgtatctgtgtggtaggcaaaatcatggcccccaagggactttgcagatgtgattaaggatcttgagatggggagattatcctggattatccacataggccagtgtgatcacaaggtgcttaaaagttgaagaggaagatgaaagaagaaaaaaggaaattttgactataaaaaaggaggccatagtgatgtgtgagaaggacttgaatgctggcctcgaaggtggaggaagggagccataaacgcaggaatgtggatggcatctacaaagtggaaaagggaaggaaaaaggatctcccttggagcctccaaaaaggaacacagctccgacaacaccttggttttagcccaataatacctgcctcaggttcctaacctacagaactgtaaagtaataaatttgtgttgttttaagctactaaatttgtggtaatctgtggccgggcgcggtgggtcacacttgtaatcccagcactttgggaggccgaggcaggcggagcacgaggtcaggagatcgagaccacggtgaaaccctgtctctact

SEQ ID NO: 244116 - DNA, 398 bp, Homo sapiens
tgcctgcttgttctcaagggcattattgtgtattttaggttttcatttgttgacctaaaaggaagaagctcaggtaaaattaatataagtagagagtgtatttgggccaagactgaggattgcaacctgggagcataaattcaagttgtcctgaatatatatgctccatctagcaacagttacaagtagcgttttttggtttgtttgtttgtttgtttgtttgtttgttttttttttgagacactgtctaaaaaaaaaagaaaaaagaaaaaatatctgacaattttctgcaggtaaaatatgtttttgcctaaaatgaagctgaagatatatgcacatatttattgttattttatacaatttgtacttctatgaataaagtcagacattcacttgca

SEQ ID NO: 244117 - DNA, 342 bp, Homo sapiens
ttttttttttttaaagaaacaaactcaagttgcactattgatagttgatctatacctctatatttcacttcagcatggacaccttcaaactgcagcactttttgacaaacatcagaaatgttaatttataccaagagagtaattatgctcatattaatgagactctggagtgctaacaataagcagttataattaattatgtaaaaaatgagaatggtgaggggaattgcatttcattattaaaaacaaggctagttcttcctttagcatgggagctgagtgtttgggagggtaaggactatagcagaatctcttcaatgagcttattctttatcttagaca

SEQ ID NO: 244118 - DNA, 440 bp, Homo sapiens
aatttatgcttcaccttctctcttaaaaaaatctccagagagaggaatgcctgcatatggatgttggtgcatgtttcccctgaaaaaattaggagaaagtgggaagaataaaactcagacttcagcaaaaccttaacatttgttaaagcttttgcacacatattaaaatattccccaatttaaagagcattgctgtatggttttggtctaagcatgacgttacctagttaacctgatgttaactgtcaccatgcagagacatgtaaaggcaaataaagtcacagtacagccaaggctataggttggtaaagatgcttcattatccaatattacagtggaggagatgtttttcttagaatcaatcatgtatttagcaaaatcttgccagtcagaatttgtggagttgtagcaaagcatataataaagatcttggaatcaca

SEQ ID NO: 244119 - DNA, 470 bp, Homo sapiens
aattaaattttatttaataatattcattaaataaaaatattattatcatgccagttttatggtttgaatatcacctttgcatgcattttctaacttgtttttgaaaacctcactgtaaggtacagttactcatagtaaaaacaatatgtgatcaatataatgtttttaataaaaatatggagttgttctaaaaaaaaaaaaaaaaaaaaaaaaaaaaaaaaaaaaaaaaagaaaaaaaacaaaataaagactaaataaaactaagccattataaactgatgagccgttcgttatagatcaatcgactgagttgataaatgcctattctcaatgtaatggcttggcctttcagacagttgtccttttctaacttatttgcaatatggcaaagtcctgttcgaactttcatgccaacaggtttacgtttttaaacgggatatgtacatggatggaataattggttggttaac

SEQ ID NO: 244120 - DNA, 446 bp, Homo sapiens
ctgcaggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataat

SEQ ID NO: 244121 - DNA, 469 bp, Homo sapiens
ttacacttgatcagggaaatgagcaccaaatgttggacatttttcctgtttccggtcaacattgatgttaatgatctccaaacaaagatgctttcaggtttggtgacagcctgtacacccagtgctctagttcatgttttcagggagctgactcactctgctgcttgaatcaactgaaagctggaaaaaaatatgtgaaacaatggtttttaagatacaggacataaggcagccgggccatccctgggagggaggaaaagtacagggtgagctccatgattgcatgaaagcattgcctggagagagtctctggagcatggtgtcaggaggcgcctgcaggtctccctgagtttagacagaacagggagtctggggaagccacggcatctgggggttcttagggctgaggctgggagaggagaaagcaactcagaaccaaagttctggtgacagagcgagactctgtctc

SEQ ID NO: 244122 - DNA, 206 bp, Homo sapiens
gcttaagctcagtggcaagaaaggagtttattttaaagcagctcttccaatgacgggacttgattaggactgggcaaggatcatgatacaacagtatcatagttcactgcagccttgaactcctgggctcaggatgaaagagtgtggggaggaacagttgtcatggctcacatttgtaatgagctgttcctccacacacgcctgac

SEQ ID NO: 244123 - DNA, 557 bp, Homo sapiens
cctaccaccacacctggctaattttttgtattttagtagagacagggtttcacgatgttggccaagatggtcttgatctcctgacctcgtgatccacccacctcagcctccaaaagtgctgggattacaggcgtgagccatcgtgcccggccgtttacatgaataagttctttagtggtgacttgtgagattttggtgcacctagctttttctaggaagttctaaccctacaggaggttgtgcagtagaaaacgggtgtcatcccagctcagcttcattagcctcccaccctgtgtagggcctggcctttcccccacgcagccccagggcccttggcctgcacccccagcctctagcagctgctgggaccccctaaacccccgggcccccttgtgggcattcgggaggcatccagacatgcagcagcatgtccagacccggctttctatagacgctgacctggcggcacctggcctggcttcctgggagcctcgcggctgggctcttctgcttgggtttcagtgttcgtggtagccccgcctgtctgggcacggccg

SEQ ID NO: 244124 - DNA, 287 bp, Homo sapiens
aaaggcatgaataccaggaggtatggatcatggggccatcttggagaccggctaccacaattccctagaagatgtcacctaatttttgcctaaatacctccagagatgggtagcttgtttgagaggcagcccaacccacttttgaaaagcattatggtttaatttatattgagttaatatcttcagcaacttctatatatcagttctaatttaatcccaaaatgttcttccacaagacaatcattcatataattggaaacatgtcaccttttcagtcattggcgaga

SEQ ID NO: 244125 - DNA, 295 bp, Homo sapiens
caaaggtttatttcttgctgatgaagattcactgaggttctgggacactctacagagaagctcttctgcatgtattggctcatcattcccagtggttttactcttaggaacccaccatgtcaatgcccttggacctcaaaggccctgacactgcatgtggagtcaggtgcataaaacatccttgaatctattaattctgggcctcctcaatgaaaggttaaattcatttaaaatacttaaatgatgacatcgtagatccaagaggtcaaataaaataaggatttagtcttttttt

SEQ ID NO: 244126 - DNA, 291 bp, Homo sapiens
tgagacccagatttcccatcatttagcatatcccaggaaagtgcccacacagaagaatctgggactcccaggccatagcttatcttggccatgtaactttggtcatgacagtgatctcccactttgctcatgtagagagtgaaatatagattagggcacaagatgaactgtaggccgggggtggtagctcatgcctgtaatctcagcactttgggaggccaaggtgggtggattacttgaagtcaggagtttgagaccagcttggccaacatagtgaaagcctgtctccac

SEQ ID NO: 244127 - DNA, 360 bp, Homo sapiens
cataccaaaagctgctgttgttgacagtttaatgtctatggatctgactcggagagaaatgtgccacttactgaatcaccaacaccatatctttggtgttgaggtggggcacgcttactttttcatctgaagattgacacagcccaccaagaacatttgaaagagacaggattgctgctgaaaaggcatgacatcaagccacacaaattggatggtaagactagagattaacttgtgaacaggtcgtatgacgagagctgaaacgtacaactggatcttggtcatgccattcctcaaaggagactaagaaatcctgaatttttaatttatgcttaatagccatggctttgtctctacaga

SEQ ID NO: 244128 - DNA, 453 bp, Homo sapiens
gcacccagcaaagaaaattataccaaagcacatgataataaaatagctcaaaaccagtgatacagagaaaagtcctaaaaccagccagataaacaagacacgttaattacaaagaggaaatttcttttctgaacaatgcaagtgaagacatacagggatatcttaaagtactgagtgaaaaaaaaatccctgtcagcctagaattctatacacagtacaaataacttttaagaacagtggcaaaataaagtctttttcagacatacaaaatcagagaattcatcaccagcagaactgcattacaagtaatattaaaggaagtccttcaagcaggaggaaaatgacaccagatgaaaatatggatctagacaaacgaatgaagagcactggaaatattaactgtatgggttaaggtatatgatttcattactatttaaactctttgaaagatat

SEQ ID NO: 244129 - DNA, 441 bp, Homo sapiens
cctgagtagctgggattacaggtgcatgccaccacacatagataatttgtgtatttttctacagatgggatttcaccctgtttcccaggctagtttggaactcctgggatcaagcaatcagcctgccttggcctcccaaagtgctgggattacaggtgtgagccaccacacccagcccaaatatgccctttcaaagagtatattagatgaaccagaggggaagggagggccaggcatggtggctgacctgagcaacatggtgaaaccccatctctacaaaaactaaaaaaattagcaggacgtggttgcacacacatgtattccctactcaggaggctgaggcatgaggattgcttgagcccaggaggttaaggccatagtgagctgtgattgtgccactgcactcccatctggggtgaaaaaatgagactgtctcaaaaa

SEQ ID NO: 244130 - DNA, 543 bp, Homo sapiens
tctacagaagatagcaactcagtaagacttatttatacaagtttagttttattgccaatatccatgagatattttaaaatcaacttaaatatttgtaataaaggattacagactaggaaatatatttctttaataaaaataactcacgaaagttgaattgtgactaagaggaagagaaaagaaggaaataaactaacaattgttaaatacttattaggtgcagagatttatatactttacatcatttaactgttaaaagagtcctgtgaagtgggtgttatgactattgctttgaagttgagggaattgaagctcagagaatttgagtaactgaaccaaagtcatatagctagtaagtgaagaactaggattcaaatctagatctgtatgcttccaaaattcactctcactctttgtatgagaggccaattaaaaaccccctacgtccctctgaatttgaactcaattgagaaataaaacagagagatgcagatcaaagcactcattttctcactaataaaaatgactggaaaatgtggcttt

SEQ ID NO: 244131 - DNA, 474 bp, Homo sapiens
tgctgtattaagacttttgacacattttcagtttctccattgacaaagagtgtgtcaagtaagatttcaaactgtgctgtgtgaataagcccctttttcttcatcctcagcaagtgataagcagtatcttatttttttccagttgaggaaatgatgaaaacgatcagtgctctaaatatgcactcctgttttcttatagtgttaaaaggttttgttttttacattgggtggcagtttaatatagtgcaggtgttggaatcattttttcaatacttttttcatctaggagtttaatatacttcacatttattccaagtttcttttatgtacctcaataacatttaatatttttcttcaatatgtgggccacacatttattaattaaaattttttttgctgggtaacaaaaaagaaaaagagcagcagaaagcattctttcattgataaaatcaagtaaactgatttaaagaaata

SEQ ID NO: 244132 - DNA, 642 bp, Homo sapiens
ttttatatttccccatctcagccagaatctcagctagttggagttatttacctggtggagtgaccgaaatgttaatttccaagggatctaagttgtcaattaacctgccctttttttttgttgctgtagttttcattaacttttttttaaattgaatatggaagtataaagaggcactccgaagagtccactgtgttccaaacaaaatctcctttgtccttgctgtgcagcagtaactcaatttcctcttggtattctggatcagtaactccaacaagtagagtaatttcttttttccttgtttgttcaagtggcataaggagcccaaaatggccgtgtgaaagtctcatcttccaattcagtagaaataccattgtgtctcccagtggaaatcttacctccttggatacaaagacctctaaactcatagagcaaaaattctgtgagtgagttattaagcaatcatagtgagaagaggcacccttacaccttgaatcctggagccatgcattgtggctatgggggaaacagtatcatacactggtctgtgatttgaagaacatactgcatcctatacacaaaatattataattttagggtgttgtttctcaacctgtttagtaattgagttgtacataagca

SEQ ID NO: 244133 - DNA, 911 bp, Homo sapiens
ctcactagataagccagcatggcgtggacccagaaagccacctagagaatggagcaacagctcagaacttgagactgaatgccctgcactcactgtggtgtaatgacctgacctgttcctgggtggaagcttatatggatggaatcttttccataaagtgctctggacttcccaagagaaagtggctggagaaattacagaatgcggccgggtgcagtggctcatgcttgaaatcccagcactttgggaggccaaggtgggtggatcacctgaggtcaggagttcgagaccagcctggccaacatggtgaaacccccatctctactaacaatacaaaaaattagctgggcgtggtggtaggcccctgtaattcccagctacttgggaggctgaagcaagagaatcgcttgaacccaggaggcagaggttgcagtgagccgagatggcgccattgcactccatcctgggcaacaagagcgaaaatctatctcaaaaaaaaaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttcaa

SEQ ID NO: 244134 - DNA, 354 bp, Homo sapiens
gtactattagtacagattgatatgaaagaaagattagttatgcttatggataggtaagaagagacactcttgcaaaatggtagattgaaacacccactgaatcttcctggaagtgtgttgaaatcagttaaagggttaatgacacaaatatgaggatgattttgtaagggtatgatgaagggggcaaacagcctaatcaaaagaaaaaagaaatagcacatcatgcaaggttatcgacactgttctcagtaacctcttgcatccctgctggaaagaaactagtagggttaagtcaagaatttcctattgtgaaaggaagaagtgaccattgatttgtgccttgtcactcaggtt

SEQ ID NO: 244135 - DNA, 396 bp, Homo sapiens
gcataggtatgaatcatacagtaatacacttatgtgtacatataaatttaggaagtatcaaacgtatcaatggtgtttgattatttgggagaagactatcagtatcccttttcttgagtgccagaaaaatctgcacttacatggattacattaatacggtgataagtacatgtctgttcagagctattttaactgcatcaggccaatctgctacaacttttacattacaaagttatgagttgttttatagttgccatggactctcaggttgaaagtcatgcaacctgagcacgcccagatgtagcaagtgtacagccacagggggaccctaagtgctcagtctgaggagcgcggactgaatttagaaatggacaccccatgggagcatccaggatt

SEQ ID NO: 244136 - DNA, 450 bp, Homo sapiens
tggggcagggtcttactttgtcacccaggctggagtagtggcgcgatctcggctcactgcagcctcgaccacccaggttcaagtgatccccctacctcaggccctcaagtaccctggactacagacaagtgccactgtactccagcctgggcaacagagcaagactctgtctcacaaaacaaaaacaagcaaacaaaaaaaacctctgttatacagatattaaaaggggcaagacatccctaatacatctggtgctctaataaagttaccttaatctgcactcccagaatgccaatttaacattaccactgtactcacagtcttgtatttaatggcctatgatttaattcttgtgtgtatcctgagggcaaatactatcttcaaatctctagaaccaagaagggcctggcctgtctctttatataggtttagttgaatgctctttgaaaa

SEQ ID NO: 244137 - DNA, 504 bp, Homo sapiens
cagctttcatagtcacaaattattgcaatattttgctgttatactaaatatgggttttttttgtttgtttttaagacagagtctagctctgttacccaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcagaaatgccactgaagggccaggcatggtgtccaacacctacaatcccagcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaa

SEQ ID NO: 244138 - DNA, 108 bp, Homo sapiens
caagcaaagcaacaacaacacactcatcaccacttctaagacacgagaactaacttcaaacaagccaattgtgaaatcctgatttttctccttaagtaagttatggaa

SEQ ID NO: 244139 - DNA, 464 bp, Homo sapiens
taaatgggcaacaaaacacctgaaaggacatttactgaaaagtagactcccaaaacaaaaatatgtatttcacagctagatacggtcgctattagcgtcctaatggccaactccatccatgtgcgtattttgaacactaaaaacgcctcctgttacccctaagaccttgtttggataacatttttctattataagtactcgaaaccaaccccatttaagatgtttacccttattcttgagtccttgatggtttgggaaatttatcattattcatattgcacaatcctgtcactgtcttttccattaggcacagtgcctaaggtccacaatatttttagaggcccacaaaaaatattttaatttcttttcaaatcagaaggaaaaaaaatttaggtttaagaaagtattttaatatatattaatatatttgtttttgtgctaatacaatcttaaaatgtatgtat

SEQ ID NO: 244140 - DNA, 417 bp, Homo sapiens
caaaaaaacttgtagcagaattgaagaggtgagcacgtcataactgttagctgcttttattattgttgttattatagttatacattgtgttcaatattgtgggtaccagggtggtcgatgaaatgatgggaggggaggctgggtgcggtggctcagcctgtaattccagctctttgggaggccgaggtgggcggatcacctgagttcgggagttcgagaccaacctgaccaacatggagaaagcccatctctactaaaaatataaaaaattagccagacgtgatggtgcatcccagctacctgggaagctgaggcaggagaatcgcttgaacccgggaggcggaggttatagtgagctgagatcgcgccattgcactccagcctgggtgatgagcgaaagtcagtcttaaaaaaaaa

SEQ ID NO: 244141 - DNA, 454 bp, Homo sapiens
cacagacttggaaaggcagaggcacttaccaaaggggactctgctgttctgcagccaccttgtgacatacatggaggctttgagagcaggggcctggaggggaatgatagagaagtcatgtcaattttaggttttccagtacatgtaatagaaatgtttacacagtactgtagtctattaagagtgtaatggcattatgtctgaaacacaagatacatcccttaatcaaaaatactttcaaatgctatgatcgcttgagtctacagcgagttggaatcattttgctggtggagggtcttgctgatggctgctgactgataagggtggtggttgctggaggttggggtggctgtggccgtttcaggaaattggacaacattcaagtttgtcacatcaattgactcttcctttcatgaaagatttctctatagcctgcaatgttatttgatagcag

SEQ ID NO: 244142 - DNA, 583 bp, Homo sapiens
gatgggaggatcacttgtgcctgggaggtagaggctacagtgagccgtgatagtgccactgcactcccacctgggtgacagagcgagaccctgtcttaaaaacaaaaacaaaaaaagcagcaggactgtgatttctctgcaggccagaacttaacagtgggaactgtagtcactgaattaggaaacctaaatccagtgggagtaattggatcccaggatggcagggctaagtggtagcaagcaactgccaaggacaagctgggcatagttgctgctgctgaaagaagagagaatctggagaccccaaactcactacactggagggaagttaagtttggaaactgagtcatgcaagaaactgccttttttgttcctaaatagatagctataatttcgcatgcttacgttatcttatgtaaaatagagagttactgaacatgagaaaatgcttcattgacttttcccctactccctctttccacataaaaaatgtatagattcactgagtgctaatcagagtctcacactctccttgaggaagaggaaagctctttctcctttacgtatcaaaggggatattgct

SEQ ID NO: 244143 - DNA, 292 bp, Homo sapiens
atcattgttatttctgccagtacccctctgtaggttctcattacttcacatttggacagctgtaataggttcttcagtgttcatgattttgcctctcaaccccctttcctactacaattatcttcctaaaacatagaatttggtcattctctttcttagcaaccattgacaactctccagtagccaccagttcttagcaggtttatgaaaagcttcaatatctagtcctaacctccctttctagccttatctcctgccatttgcttatatcataaatctaaaactttaacca

SEQ ID NO: 244144 - DNA, 496 bp, Homo sapiens
taacttttatgtgtatcccaaataggacaggacagtcattcatttcttataatgtatcagctaatttcaaggagacatcggaatttttgtggagacatcggaatctgaagagcaaagtgattcaaattgggtcacagattaaataatttttaaaatgtttactttaaatatcttaaaaaactttaaggagaaaattaatttttctatattgttcttggccttaaaatatacattaagcattagttttctggcttttgatgtttttcataaaattagctcaaaaaatgcaaaaagcttgtatgaatatataagggcctttgtaatcatattgtaattgcttgacatagttaatttcttgatttctgactctggcatctgagtttcataattgttatgtaattactctatttttttaaatcatgtttttaaatggaagtttcagtctcagatcttttctatttcatgcaataaataatttttagcagtaaagaattat

SEQ ID NO: 244145 - DNA, 404 bp, Homo sapiens
aaatttgatctaattgatatatatagcataatattaaactcgataaacttaaaattgaatatgtaatgtgaatgcacatttaatatttattcaaatgctctatattgtgtcatagatcaagccgtgacaaattttcataattgaaaatagaaataatacattttctgacatcagttaaactgttagaaatcatttacaaaaggacaacttaatccacaaatattttaaaatcaagcaacatattcctaaataattcacaagtcacaaaattagtctcaatggaaattagaaaatattttaagaaaatgagaataagcgtgagccactgcacctagcagagcttacagtgagccaagatcgcgccactgcactccaacctgggcaatagagcgagactccatctc

SEQ ID NO: 244146 - DNA, 87 bp, Homo sapiens
tacaaaaggcatattctttcatggtttctgcaatgagaggaagtgtaatgattattttaatatttctattaaatatgtttaactgta

SEQ ID NO: 244147 - DNA, 350 bp, Homo sapiens
ggtcatcccatcttcctgctttcttttcagcccctcactgcaagataggtcccactactgctaagcacgagagttaaaaaggttggggccaggtgcggtggctcacacctgcaatcctagcactttgggaagccaaggcaggaggattgcctgagctcaggagttcaaaaccagactggacaacttggtgaaaccctgtctcaactaaaattaaaaaaatcagtggacatggtggtgtgcacctctagtctcagctactcaggaggctgaggcaagagaatcacttgaacccaagaggcagaggttgcagtgagccgagatcatgggtgacaaagtgaaactctgtctca

SEQ ID NO: 244148 - DNA, 720 bp, Homo sapiens
ccaactcccagcccaggccaggctgactcacgcggtgaccagagccatcaggagagggaggcaggccaggctgtctccagccagccctgtgaagaggaagagcgaaaacagggaattagtttgaaacttaaactgttgtgaactaggggggtgaaagggccgcaaagccagctgatctgacatggagccgcataccttggggattaagtaaatatgtactgtagaaaaccaaacctgcatgtaattccaggttgcttttgttttgttaaatactgccctgagatttacaattcctccggggtggctctgactgggactgaactttggagcctgaactatcagccaaagccgatccgattaactcttccctagccgggctggccggagcctgtggtggccaagctagcaggggtctggctgtccaggactccctcttctccttgggtggtttggacagccgcttgaccttgcatttggagggggagttgggaagcgtttttaacccttggacacaacgaataaggggaagtcagagttgttctcagcagtttcatttccttgaggcgatgccccataaaagggctcctgaagctctttgtgaaggggactgaaaagggcagatgagggtgtcctttggggcggacgtggggtttgggacaattgcatgtgattgtcattctttagctgtctgcatcccacagaaacttttttctgagtctt

SEQ ID NO: 244149 - DNA, 348 bp, Homo sapiens
ctggtgccccaccccatagagaatgctggccacgtgctggtcctgtgtgctggtggatagctgtgtcctgcgctggcatgccctgggactgtccttcacactaattagtgtcacacacatcccccctgaaactgctgcagcctttgcttaagaagactttaggtggctcacgtctgtaatcccagcactttgggaggccgaggcgggcagatcacgaggtcaggagatcgaggccatcctggcaaacacggtgaaacctggtctctactaaaaatacaagaggcaggagaatggcgtgaacccgggaggcggagcttgcagtgagccgagatcgcgccactgcactcc

SEQ ID NO: 244150 - DNA, 898 bp, Homo sapiens
gccgacatctgcacccactggtcagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataattttttaa

SEQ ID NO: 244151 - DNA, 1177 bp, Homo sapiens
atggataaaggcaacattcgttggacattatagtatcacattaaagactggagtgcagtggcacaatctcgcatcactgcagcatctgcctcccaggttcaagcagttctcctacctcagcctcccaagtagctgggaattacagccagaaaagtgtaagaataaaaagaagtggtataaaagtgcactacaagaagcatgtctactctatggatattctcatgagcaaagactggaaatgtgctgcctatcaaaacaacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataattttttaa

SEQ ID NO: 244152 - DNA, 902 bp, Homo sapiens
aaaggatcaacactggagagagaagaggggaagagaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctttgatgtctgagttttagaacattatacatttttcaaattaattataaaaatattggcatctttatatttatccaaagttaaaactttaaaaatgtttagtgaaataggtataaattataccaaagtttatatttgcggtaactttctacttcatattttgagaatggccatgatttttagagccagtcaaatggtatttaagttagtgttaaaaatttagaattaaaaaaccctgatatttgtatttatatatttcttgtttgccttaatttttaaatggtttgtgaaatttgcctaacaaacatatgttttacaatgattgtttaggccctttgttcaaaaatggataacttaaaatggctggccaagctattataattctcagaggtaattcaaatctaataaacttagagaatgtatatttgcagtggaatcaaactattacaaaataaaaggaaataattttttaa

SEQ ID NO: 244153 - DNA, 763 bp, Homo sapiens
atggataaaggcaacattcgttggacattatagtatcacattaaagactggagtgcagtggcacaatctcgcatcactgcagcatctgcctcccaggttcaagcagttctcctacctcagcctcccaagtagctgggaattacagccagaaaagtgtaagaataaaaagaagtggtataaaagtgcactacaagaagcatgtctactctatggatattctcatgagcaaagactggaaatgtgctgcctatcaaaacaacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagttatctaaatgcagcccagaagctcctgcaggcagtctgtttgaaaaccactatgaagaggactatcttgtaattgatgggataaaattaaaagctggagaatgtattgaggatataactaataaatttaaagaaatagatgctgatgcggccaacccccccttccccctctccatcctccgtagcaatcgacgcgagccc

SEQ ID NO: 244154 - DNA, 947 bp, Homo sapiens
atggataaaggcaacattcgttggacattatagtatcacattaaagactggagtgcagtggcacaatctcgcatcactgcagcatctgcctcccaggttcaagcagttctcctacctcagcctcccaagtagctgggaattacagccagaaaagtgtaagaataaaaagaagtggtataaaagtgcactacaagaagcatgtctactctatggatattctcatgagcaaagactggaaatgtgctgcctatcaaaacaacaagataaatccgaaacacatgacaaagttgctgcactggtcaagaaaaggaagcagacttctaaaaataatattgaaaagaagaagcccaaatttagaaaaaggaaaaggaaagcaattttaaaatgctcttttgaaaatgtttattctgatgatgccttatcaaaggagaacagggttgtctgtgagacggaagttttactaaaagagctggagcaaatgctgcagcaagcactgcaacccacagccacacctgatgaatcagaagaaggacatggagaggaaataaatatgggagaaaagacaatttttttttttggagatagagtctcactttgtcaccaaggctggagtgaagtaatgcaatctttgctcactgcaatctctgcctcccaagttcaagtgattctcctgcctcagcctcctgagtatctggggattacagaataataaccaaaggaggtttatggtggaggatgaagaaaagctctgtctgagttagtgagtttgttaaagcaatttttcaagcaaaagaaaatttgtgattgaggccaaagagaatttgagagcctcaattactcagattttaaaaaacaacacttaatgtttacacttagtgtttgacgcttcattttccttcatatggataatagctaacatttattaaacacttcttatatgcccgaaa

SEQ ID NO: 244155 - DNA, 134 bp, Homo sapiens
ctgtcaaattctttttctaggaaagcaattttaaaatgctcttttgaaaatgtttattctgatgatgccttatcaaaggagaacaggggtatgtgaaagcctgtcctgcttttagttctttaacctatatataa

SEQ ID NO: 244156 - DNA, 236 bp, Homo sapiens
tgttatttctggcgtgtttggctgtctttgctgccatagcatttcccgcacagtgcagcctttataccttctgccctcgtgaaggggcttagatcctggtagagcagatgatgcttggaggaagatgcattagctccagcttccatggggcctgagggctcttggggtcatcagggaactatcttaaaatttgctaaaccaagccaagacacatcacttgctgtcttatttaggga

SEQ ID NO: 244157 - DNA, 1467 bp, Homo sapiens
agtctaaccctcctctctccatgcccattacctcacgtttccaagtctaaccctcctctctccatgcccattacctcacgtttcccagtctaactctcctctctatacccattacctcatgtttcccagtctaaccctcctcgctatccccatcacctcacgtttctcagtctaactctcccttctctatgcccattacctcctgtttccaagtctaactctcctctctccatgttcattacctcatgtttcccagtgtaactctcctctctatccccattatctcacatttcctaatctaactctcccctctctatgtccattacctcacgtttccaagtctaactctcctctctatccccattacctcatgtttcctagtctaactctcccctctctatgtccattacctcatgtttccaagtcttcatcagttcctggatgtgtctggttccaccctcttttccagccctttggtttgaatctggacacgtctaattgccaccagtctccttgctcccttttcaatcatcccacaaaccgccaacttcgtaaggtgtaaactccttgtctgctttagtcttcatccacgtatgaaggtgaaagtcagctatgtggtctgggcctgctcaaaatgactctcaggctaaccctcccaccacatttctctctcacatagaaactccaaccaaaccgcatgactcgctgcatcccacacactggaagtacctgttgctggggctccttcttaaacaactccacctgcatgaaggggccagtcatctcaacctcagtgttctattcctgcgtcagcacaatttggcccataggcgaaacccagacagccgcccacttttgtgaataagtggacacagccatgtccactcatcagtgcactgtccgctgcttttaggctgcaagagcagaactcagtactggcgacagagcctgaatgtcccgcaaagatgaaaatattcactgcttactcctttacagaaaaatcataaggacctctggtctactgaaagcctacacacatccttcgagatcatcaccaatgtccctgggctatcatggggatctgtgggggtctgacaatctcacaggaaaagtcctcagtactgtaaggctaccctcgaaaaagcgaccaaggaaggcacgtttttaaaactactctgaaattatagcaaatccaagctaccacgggttagataaattacccagaaagaagtaaaaatgctgacattggcaacttgccgtgtctctgtgctacttttctcttttcctccatatcagatgcctacaatctaagggaacagaatggtaaccacagggcctcaaggagctccgtctacaggaactgcggggggaacagcaaacatactgatgctgtacggaaaggcttcgagaagaccgtgaagccatcttcatctcacaataaatccaactgcttatccaaaaaaaaaa

SEQ ID NO: 244158 - DNA, 1041 bp, Homo sapiens
agtctaaccctcctctctccatgcccattacctcacgtttccaagtctaaccctcctctctccatgcccattacctcacgtttcccagtctaactctcctctctatacccattacctcatgtttcccagtctaaccctcctcgctatccccatcacctcacgtttctcagtctaactctcccttctctatgcccattacctcctgtttccaagtctaactctcctctctccatgttcattacctcatgtttcccagtgtaactctcctctctatccccattatctcacatttcctaatctaactctcccctctctatgtccattacctcacgtttccaagtctaactctcctctctatccccattacctcatgtttcctagtctaactctcccctctctatgtccattacctcatgtttccaagtcttcatcagttcctggatgtgtctggttccaccctcttttccagccctttggtttgaatctggacacgtctaattgccaccagtctccttgctcccttttcaatcatcccacaaaccgccaacttcgtaaggtgtaaactccttgtctgctttagtcttcatccacgtatgaaggtgaaagtcagctatgtggtctgggcctgctcaaaatgactctcaggctaaccctcccaccacatttctctctcacatagaaactccaaccaaaccgcatgactcgctgcatcccacacactggaagtacctgttgctggggctccttcttaaacaactccacctgcatgataggaggggggcccccctcctatcatgcaacctggtggtcccccgctcccgggaggtcaccatattgatgccgaacttagtgcggacacccgatcggcatagcgcactacagcccagaactcctggactcaagcgatcctccagcctcagcctcccgagtagctgggactacaggcatgagccactgcacccagcccttcaaggtataagtaaaaagggcaagtgcaaaatagtgtgtatgctataccactgcttgtgcatgataggaggg

SEQ ID NO: 244159 - DNA, 360 bp, Homo sapiens
tgatgttctagttatgttatcactcatttattagctgcaggattcctatgttagagagaaatttcccattatttactatttagttatcttgaggtccctatgggaaaggtagaataaatgcttgattctttccctttatttaccattttaaaaaataatgagtccctatctcttccaaaggcaaactgtgaattttaaaattttttctcaatgtttatctcttcttttgccagtggaaacattttttagttgactccaagcctcctgcctcaactcttctttgatatctgaaactttaagatgtcccacttctattttttatattttccattgtagacctggaataaagtcattgctctc

SEQ ID NO: 244160 - DNA, 294 bp, Homo sapiens
agaaaactatcagtgcttcagaagttcccttcatgctctgttttgtcactaccagggatagtaaccagtggcagaaatttggctacttttgtactttatataaacagaaccgtctagtatctacatagttcctatcgcctgtttatcttaatatgatgtattaatagaataatgtttaatgatatgattaacatgtaattttaatggctgcatagtattctgtcatatagctacaccataatttatttaatgagtcctttatgtgtttatgtagcttgcagtttttcgctatta

SEQ ID NO: 244161 - DNA, 501 bp, Homo sapiens
gctccccttgattaaaaaccgcctaaatccagcccgaaaacatcagcctcatgactcatgtcagcataaccagaaacattccaaccctaagataaacccgtctccgaccaaaaacataccaaccctgagacagcctcccctctgaccagagatattcaaccctgcaataaactctccctcacatacaaacattctgaacctatgataagcacccccttccaaaacccttaaatgtgcttagtctataagagagaagagctctgacctaactcagccagaagcccctctcaggtttctctaaaataaacctgtgtttaactgtcaagtgacatttcatgcttctttcctctttaattcttacagtgagtgtgtagagcacgcttgacataagtgactccaccttagaaaaagattccatgttacatttcattcaaaaggcatcatgcctacaggagccagatgttcacctgatcaataaagcccacatccaaacagttaaga

SEQ ID NO: 244162 - DNA, 377 bp, Homo sapiens
agtttatttgaatggtatccggcaaggttcaatccctaaagcccgactcctgtagggcagacccccagctctctgctgagctagcctggcccaggggtggacttttgaacccctgaaagagtaaagaggacatgcatccttaaagcaagtacaaacagtatatccctccttttggctgagcttgccacaaaggcagaggagtggtaagctgaagggtgtgctgcctggcaggcacctgggaggtcaccaatatcttcttccccttgtaagataagacagtcaaattgggagcaggcatggctgcacccttgtggaagctcaggagattgggggcttgccaggtgcctgtcgacgggccgcgaatttagtagtagtag

SEQ ID NO: 244163 - DNA, 463 bp, Homo sapiens
tgcccagttctgagcacggtttactgagttctaggtgacaattatggggtcagggagtggaagccttgggaccctccagacaagtgggcagagcacaagcatgggacctgatgaccttggcagtttacttcgccttctgagcctccgtttcctcacctgtaaaatgggtatggagacctaagctctggcgttgctgtgagggtgagatgtagtaacgtggagatggcctggcaggtgcctggcacatagtaggtgctcactgaatggacttcccttcccccttccgagttctatgcctaccaagaagctgcacgcgtgcctaccccaggaggagaggaactgggggtgggggagcgggggctggaataaagggaagggcagtagggagaatcagttctccctggaggagatggcacactttgcttggagaagaaaaactacaaactacccaggagttgccccc

SEQ ID NO: 244164 - DNA, 424 bp, Homo sapiens
gtctccagggacagagtctaggaataggaatttaaatcaaagtcataacagactttataggaaatattaattcaaataggaagtattgtagagtgtgtgtctgtgtgtggggggggtctgtgtactaactatagaaatggaaacatacggtaaaatatcaacgaaatggaaagaatgttctggggaaaaaaagccatttacaatggtataatccaaggaccataattatttttctgagaaaggttattcctcacttaaaagtcaatagtattttctattcacttcaacttattcagcaaatgtaaaaatatttcagttcttttttattttgattttttgagatattccctaaaataagtaggatccgctgttaccactgttggacgactcaccaatgcacccccatcccccatttctgatctaa

SEQ ID NO: 244165 - DNA, 311 bp, Homo sapiens
actgtgtgcccaaacacaatctaagcatgttacatatgacctcttatcctcacaaaccttgaggtaggaactgttagtgttgtcattttatagacagtaaacttgtgtgttgtgtaacctctctacagtgacatagctgttaagagcctgtattgaacctgggcagcttagcccagagttgggttgggttggggttttttcagttcttttttattttgattttttgagatattccctaaaataagtaggatccgctgttaccactgttggacgactcaccaatgcacccccatcccccatttctgatctaa

SEQ ID NO: 244166 - DNA, 410 bp, Homo sapiens
gcatgaaagctactctacctattctgtagagtatttaacaataatcaccagctactaagtgccaggtcctgcgttaggggtgcagatggtattgagatccctgttttacaaaccaagagatggagattcagagaataaagtcagctgcccaaaggcacagagctagggagtagccgagctggcattcaagctccagtctctcaggcttggaaatccatactccttccattttgctaaacagttcttacctgatgttctttggggctgctgatgagtctgagtaagtaggcctagatcatgatcccagtccaggctcagctgtgtgtagtaccatgtcatcatgtatgacaaggtctgacccccccgactagcacagcagtccatcatcattacgggggaaaaaagaaagg

SEQ ID NO: 244167 - DNA, 336 bp, Homo sapiens
gctcaataaaaaatgattatccaggtatcacctcaataacagaataataagtcataaaatacctacaagtttccaagtactatgatgaatgtcttatataattcagagcttaaaaataggaatgctgggaaatagcagaatatcagtctaatatgagggaagtaatctgatccagagttaccaaagtactaggatctcaatagcagggtatgctgcatttaggttaaaggagataattatgggtgatagttcagacagaaaaatagtttgaaggccaggtacagtgattcacacctttaatcccagcacttggaaaggctgaggcagatggattgc

SEQ ID NO: 244168 - DNA, 387 bp, Homo sapiens
acacccatggagaccccgcccagccaatccccaccctagcttccacccagatacactctgccaggccacaactgcaggcactctccccccagcctccacccctcacctgtgccctggacctcagactcagctttccatcctacctgagttttctgcctccctccatcctgtgtccccccaccatacatggctgccagagacgtcctcttagaagtcacacctggggtctgattgcgtccctcgcctccccagatcccccaaggtctccttcctgtgccgtcatatctgcagttcttaggactgtctagacatgctttgttcaactaggtaatcacacggggtaaattggatttaaatgtaattaagattaaataaaaatacacatgc

SEQ ID NO: 244169 - DNA, 470 bp, Homo sapiens
agctcactctagctcccttcctgttagaatttattcagaacctccatttctaggaggaagcaaggagggggcagttatcttcgtggacttgggtcctcctggaccctttgtcctcatggttatgtttcaaacagagttgagggctccctaaaggggaaagattatttaagttttgtaaatgctgccctccaaaaaccactccacataaatgtttcatggcttagcctctgtgaggccagagctggaacattcagctgtgagggtgtttatatttgtggaactctcttgaacatttgctgtgggttttaaacagctgctatgctgaagctctggggataggaagatcatgaatattcaggtgaagccaccagaatgaacagccgttaatagaataaatgcctaaacagttgtgtaaggcttattaagacctattggggctgagataataaattcccactctgacatgttgc

SEQ ID NO: 244170 - DNA, 684 bp, Homo sapiens
ggagtctcactctgtcacccaggctagaatgcagtggcaggatctcagctcgcggcaacctctgcctcccgggttcaagcagttcttgtgtagctgggattatatagccatgcaccaccacgcctggctaatttttgtatttttagtaggaatgaggtttcaccattttggccaggctggtctcaaactcctgacctcaagtgatctgcccgcctcagcatctcaaaattctgggattgcaggtgtgagccactgcgcctggcttcaaattgtcccaatttctgcttataaaagtgttgacaagctgattcctgagtccttctgatgagactctagtagtcttgacagcttccttgctacctgttaattacataatgttccaggctaattttgcattgttttacctccagacccagaataagtaattttgccatggaatcctggttccttttaaatgggatatggtgttgagagaccatgacctgggcactagatcactgctattaagttggccatttgctcattgttattatgccttttcagtgaagggatctgcaaaatatgtcctggtttggttttgtttaagataaaagacctcaggagtttttacagatacttacaattcaattctaggactatagagttttcacttaatttcttctatcttttttccctgtctccttt

SEQ ID NO: 244171 - DNA, 470 bp, Homo sapiens
ctacatctaacgccatggccccccttgagtgaagtatttctcactgtgttttaggaaatgtcataaataagttttttttaacaccctgtcggaccataaaggattgatctactggtagacacttattctcaatcagagcttttcccaagggaatttgtcatgtggaaaaaagccatttgtcaaggaatggccaggcattgtggctcatgcctgtaatcccagcactttgggaggctgaggtgggcgaatcacctgaggttgggagtttgagaccagcctgaccaacgtgaagaaaccctgtctctactaaaaatacaaaattagccgggcatggtggtgcatgcctcctatcccacctactcgggaggctgaggcaggagaatcacttgaacccgggaggcagaggttgcagtgagccaagatcatgccattgcactctagcctgggcaataagagcaaaactccatctc

SEQ ID NO: 244172 - DNA, 612 bp, Homo sapiens
gatacggagttttgctttgtcacccagcctggagtgcagtggcttgatctcggctcactgcatcctccacctcccaggttcaagtgattcttctgcctcagcctcctgagtagctgggattacaggtgcacaccaccacacctggctaattttttgtatttcagtagagatgaggttccactatgttggccatgctggtctgaaactcctgacctcaagtgatctgcccgcctcggcctcccacagtgctgattacaggcatgaggcactggtggcccccagccttaatcttctgagttccatttcccttggaacctgacttgcaacagatacaatgtatatcgtgttttaaaacatgtaccataatacaatttatgttgtgaaacagtattatttatgtttgggaatgcgtgtgtattttgtaaaactgtaaaagcatgcaccagaatgacgaacaccaaattcaagagagaagttacttctggaaggtagaaaggaggacaggcttgtggaagcacacacataatgttttaataactacattacattttcattcttatactggatactgtatacatatatactggttagagtattccttatgctttcttt

SEQ ID NO: 244173 - DNA, 619 bp, Homo sapiens
aatgaggtattcattgtagggtactgaccacgaatatttaggcagctcacttgaactagcttaactgcatcctccacctcccaggttcaagtgattcttctgcctcagcctcctgagtagctgggattacaggtgcacaccaccacacctggctaattttttgtatttcagtagagatgaggttccactatgttggccatgctggtctgaaactcctgacctcaagtgatctgcccgcctcggcctcccacagtgctgattacaggcatgaggcactggtggcccccagccttaatcttctgagttccatttcccttggaacctgacttgcaacagatacaatgtatatcgtgttttaaaacatgtaccataatacaatttatgttgtgaaacagtattatttatgtttgggaatgcgtgtgtattttgtaaaactgtaaaagcatgcaccagaatgacgaacaccaaattcaagagagaagttacttctggaaggtagaaaggaggacaggcttgtggaagcacacacataatgttttaataactacattacattttcattcttatactggatactgtatacatatatactggttagagtattccttatgctttcttt

SEQ ID NO: 244174 - DNA, 560 bp, Homo sapiens
gcgttgagttgaatgacagctgacttcatggctgtctgcgaagtggggaagcctgaacacagtcctataaactaaaggccactgcagacttttagcacaaggagatccttacagggaacatgtgccatcagctctttggagtgaacaaggaattagacccccatcatgccaaaaaactaggatttttaggtggtctttccatcccttcagatttaagtattcaaagaaagagagacagacctacattccaagggtcttctgagtgcaaggccttgtgttgtttgtttatttaggggagggcctggtgctcttctctgttttatgctttaccttcttttatttctcagatctcatgttagcactatgttctgaattccctaataatggctcttgagaactgatttacattttgttggtttgtttacttcttgagcacataaaaggaccccaaattagagatactatcccttgggcttctgaaaaatgaatcaaccaaaactggttgactctaaccttgccttgctgagtaaaaattctgctttggatgagaaatgtcttga

SEQ ID NO: 244175 - DNA, 459 bp, Homo sapiens
gagaggaaaactatcgccaacagaaagaatccagataggaagagagaaaaagaaagaccagagatggattttgtgtcctttttaaaacagcctcaatcacctgattcctccctgccacttctctgcaaatgatagagttcacacatctataattctctcataggttcatgtgggctgctcctcataaccctgctcaaacactactgaggcatcaggatcttcaagattcataatcacataacaattgttttgagctgaagacagcagaagaacataaggataccctgtacttctcaggaggataggaacatcagatttggaatggatgaggaaactgaagcgaaagaatgttgactaattttgtcaaggtcacacaactgggtgctttggtgggctcttctggggacaaaagaaagcacaacaaaaaaaggaaataaatggcatatgcaaacccctaaa

SEQ ID NO: 244176 - DNA, 618 bp, Homo sapiens
gaaggtaccaaactcagctaaacacctgatcagattgacttaactgtccttaatgataaaaagaagcatacctatttttggacataaatgttatttatctcagtctccactgctcttctacatacaacatctagcattctttcaaaaatcataagacagaaaaatcaaggggaagacataaaacaatcaaagatctgattcagatatgactcagccgtttaaactatcaggcaggaactttaaataactatgagtagcatgctaaaagatctgcttggaaggagagcaagaggcattgagcgatttcagcagagagatggaaaccataattaagagtcaaaaattggcctgacataggggctcacacctgtaatcccagcactgtgggaggctgaggtgggtggatcacctgaggtcaggagttcaagaccagcctggccaacatggtgaaaacccgtctctactaaaaatacaatgaagccagaaggtcgcttgaaccttgcaggcgcaggctgtaccagcctgaaatttccttcttgcacttcaccccgggccaacagcaatcgaggttccattctacaaccatctcccacatcgcgttcccacttttatttgatg

SEQ ID NO: 244177 - DNA, 549 bp, Homo sapiens
gcatttgtctcctgccgcagctggggctgcagatctagtcttcagttcacagagaactgccccccaactgctcccccgtactctgctcctacaggcccagctgctgtggctgtgcgacctgcagggactggcagacccgtagctaagacgccaggatttcctggaagcagagaaatgtgaccatagtgtcttcagacctgaaactgaattggagactgttaggcccagaagaacaattagggtgacgtgtgcattgagtaaacccagacctggtcacctgtctggagcaaaggaaaaagccatggagtatgaagcatccaggtaggtgaaagcgaatgaagaagaggatgacatagatgagagatccaaaggccaaggaggaacccagacttttacatgtgatttgggaagctgtgcttcagtggaaatcgtttctgagaagcctgggttttttcacttgttctcacataggggcatcttctgtcccatgctctctaacgactctactttttcttcaataatttttcttcagatttgcagtgagagcca

SEQ ID NO: 244178 - DNA, 398 bp, Homo sapiens
aatctttacatctggagatctatagcagggctatccctagtgacatgcgtgaagaagcttggaaatggtgctgggtaggagctgagtgtgcagaatgtggaaaggcattctaaaccaaaggaagaacacgagtaaagatgatgaagcagggataaggctaaaatgaaatttgtgatctgatccacatacaagcacagtgtagtacagctggaatatagagaagagcttgaagacttatgagcaactatcccggtactcttggaggctctgcaaccacagtttgagaaactccgcgttcaaagttaaaaactgtcacctgattttttaataacatcaaagattgtgaaagcaagtataaataacacagagattaaaataatgaggcaggatcagaaagg

SEQ ID NO: 244179 - DNA, 460 bp, Homo sapiens
ccatctactttctcttacctggatcagtgcaacagtctctttcccagataattatgtctccgtaaactattctcaacatggcagccattaatgatcctttcaaaacgtgtcagatttatgccactcctttattcaaaactctgtagtggtaactgttttacaaagaaggaagaattggctgggcgtggtggctcatgcctataatcccagcactttgggaggccaaggtgggtggatcacttgaggtcaagagttcgagaccagcctggccaacatggtgaaaccccatctctactaaaaatacaaaaattacctgagcgtggtggtggacacttgtaatcccagctactcaggaggctgacacaggaaaatcgcttgaacccaggaggcagaggttgcagtgagccaagatcgcatcattgcactccagcctgggcaactagaatgaaactccatctca

SEQ ID NO: 244180 - DNA, 347 bp, Homo sapiens
ctgtactgctgaggctccctcgggtctgctctgctgggctcttcaggtctcaagctcaggacatggtaatcacaggctaggctgggaaagatgtagctgtgtctctgtggaactggtcatccactggggaactactggggaactactggggagcaggccgtggtctgcactgctggcgatacctcctcctctgctgggtgtggtggctcatgcctgtaatcccaggactttgggagggcaaggcaggaggaacacttgagcccagaaatttgagaccagcctagacaagatagtgagaccctgtctctacaaaaaatagaaaaattagccaggccggtagtctctac

SEQ ID NO: 244181 - DNA, 574 bp, Homo sapiens
tcatttttaggagtttttcttttgtattctgaatatgagtcattggtcagatatatgtattgcaaatatcttctcacattcagtggcttgccttttcactgttgatgttttcacaaacaagttactaattttaatgtagtacagtttatcagttttttcctctgtgataagctctttttgtgttctgtttatcatctttacccattcaaaggtcaccagattttctatgtttcatctaaaggtttaattgttcaactttgatgtacagatctgcagtccatctggacctggtgtttgtatttagtgtgaggtagtgttcaagattcatatgggccaggtgcggtggctcatgcctgtattcccagcactttgggaggacaaggcaggagaattgcttgagcccaggagtttgagaccatcctgggcaacatagtgggaccgtgtctctacaaaaaaattcaaaaattagccagaaattagctaggcatgatggcatgtgcctatattcccagctactcaggaggctgaggtgggaggagcgcttgagcctgtgatgtcaaggctgtagtgagag

SEQ ID NO: 244182 - DNA, 1388 bp, Homo sapiens
  misc_feature (7)..(7): n is a, c, g, or t
  misc_feature (293)..(293): n is a, c, g, or t
  misc_feature (923)..(923): n is a, c, g, or t
  misc_feature (1370)..(1370): n is a, c, g, or t
gtttccnctcacacggtaggcggctgtgcaatttcgtctggagtccccagacccctcctcatccttcccagggttgctctgaggccattcctcgtcatctaggaggggtctacataaaagcatttataaacacctccaaatgggagccaggcatgcccacctttggagcacttttctctactgcaaatttatctactgctcgtgaaatctctggatttaactctgatgaaagactggaggctgaaggagaacttcaatatcatatattttaaaggttgattcacagtttggancaagaattaaagaaccacgaacttcaaggtaaaacgggcaacggcgttggggcaagcctctctgcatctgcgtgtccagcctctcctgcgtgccagaagtccccaggcaggagtgtggtgggacatccggctggggtaaggacaggcaccctcccactgtgtcagggcccagagagtgggtggagaagctctgcaagagacctgtgcaagggcgccttgcaggagcctgcagtccccacaggtgtgtttgtggataacacttggggagccctggccttttggggtcacggagggcttggctctcacctcagagctgcagaggagccgcttctacatcaggacatcagaagctggaacaggatggccggcgaggggcctcttgttggggtcacagagatgggtcgcagagatggcccgtgtggaaggttggattctcaccccacctctgcccctagatgtcctggtgaccctcccctctgtagtcttggttttttgcaaaacagttatgacctcctgccatactgggtactttgcttatgtattgtgtttactctttactgtgtgtctctcctgctaaggtctacgaagaagggtctttgtgggtggggttcttagaggcatcccaagtancagaagcagtccctggactaaggggctcaataaatattttttatttattattttttctttttgagatggagtctcgctctcttgaccaggctggagtacagtggcacaatcttggctcactgcagccttcgcctcctgggttcaagtgatttccggctaatttttgtatttttagtagtgacggggtatcaccatgttggccaggctggtcacaaactcctgacctcaagtgatccacccgcctcagcctcccaacatgctgggattatagacatgagccaccatgcctggccaaatatttgtcaaattgaatttgtatttccatacaaattttagtctggataaagtgcttcatgcctgtaatccaagcactttgagaggctgaggcgggtggatggcttgagcccaggagtttgagaccagcatggaaaacatagagaaaccccntctcaatataagaagaag

SEQ ID NO: 244183 - DNA, 244 bp, Homo sapiens
ctcccaaagagaatatcacgtttacaccttaatccatttatgtgctggctgcgactttcatggagtaagctgattcctttatttcctagttcatagggaagcaagggtagctacttgactgaataggcaattagatattggagaggaacaagaattaaaaatataaacatggggaaaaaggaaaaaatacatttgatatatgtcatagctctatatcatcaagttataaagttatatgattaca

SEQ ID NO: 244184 - DNA, 363 bp, Homo sapiens
  misc_feature (352)..(352): n is a, c, g, or t
tgcacctgcaatcccagctacttgggaggctgagacaggaaaatcacttgaacccagaaggcagaggctgcagtgagccgagatcatgccactgcactccagcctgggtagcggagcaagactatctcaaaagaaataaaataaatacataaaaataaataaataaaaatttgaattatcatcaattccctaccaccccaacaaatcaacattcattctccatattcattacagtttgggtcaatattcaatcacaattttaaaataattacatcaatacaacttcttgctttttaaaaaaaaaaaaaaaaaaaaaaaaaaaaaaaaaaaaaaaaaaaaaaaaaaaaaaggnaaaaaaaaaaa

SEQ ID NO: 244185 - DNA, 484 bp, Homo sapiens
agctaccccagcattttctatcatctataatagtacctggatgtggttttcagactcttcaacctcctggttaccctcctaaaagcacttcctctgcctcagtgtcccacttaaaaagtgtgtgacttggaattggatacagcacttcagagcaatgggcagtgggactaccccgatattatatacacagagaaaatatttaatgaactctataattttatcaaggtgttgagctttttgagcaccaacatcttgagtaaaaaaaaaaaatctttttacatagttgctaagccaggattcccacattctctatgtttgtacgtacattgttttttataacataaatgtcacacttcattcagtcctacttaattcaattggtggtaacccatcactttagcttctggagatattcttcccaaccactgatttatctatttgttcacccttccattcattcaataaagatttattgaacagcttt

SEQ ID NO: 244186 - DNA, 548 bp, Homo sapiens
atccaggggcttgtggggagggttcccgggggctcttggggaggggtcctggggtttcctaggaggggtctggatccttgaggaggggtcctaggccttggggagggttcctggggccctggggaggggtcctgggtcctgggggtttggaggagaggtcctgggtccacaggctttcctatgaaccagtcatgtcctgttgtgcctctgatgctctggacagtgtttggaaatgcttgttggtctcagtaatgagtggtttgtggccgggtgcagtggctcacacctgtaatcccagcactttgggaggccgaggcaggtggatcacgaggtcaggagttcaagactagcctgaccaatatggtgaaaccctgtctctactaaaaatacaaaaattagctgggcatggtggcgggcacctgtagtcccagccactcgggaggctgaggcaggagaatcacttgaacctgggaggcggaggttgcagtgagctgagatcacgcccctgcactccagcctgggtgacagagtgagactccatctcaata

SEQ ID NO: 244187 - DNA, 399 bp, Homo sapiens
gtagtatgaccatttctcttggtatatgcccttttgagtaagctggaaattaaaccccatgaaaaactactttaattcaattagatgccggaagagtgtgtgtctaaggttataagtaaaccatattatagaataataatacacacacacacacacacacacacacacacacaagtagtacctccaccagggggaatggatggcttttagaaaaagtaagagcatgtgaagtttcctggttacatagaacaatttggatacatcagaaaaagccaagagtacagaattaatctatactggaaaaacgtttttccggttttttttgagactaacattctcagtgtcaggttataatacctgagtgcgaaatgcggaaaaatgcaataggaactgaccaaa

SEQ ID NO: 244188 - DNA, 576 bp, Homo sapiens
gcgtaaaagaagcgccataagggaccaacgagcagtccagctataggtgtggacgcctggtcccacccggaattgcaggggcttggctactgattggctaagaaagtcctcctaggccctcattggaggatctaaacgcctctcttcggcgtggagacgggaagggacgactcagacgaggacaagaagtgggcaggggagaggcggttgttttgcttcagccgcgggtggggcgcaggcgagagtgggaaactgggaaggccgggctctggggaggtgttgcggggaggggaaaggcccggatgttccctaacaatgaaatcatcgccgacctatcagagccgccgagctgggatacctgcctgacctgtaccccggagggagaagagtgggcgggaaattggggtgtcggaagaacctggaaagcaacgtgagaaagtgggacaggtgttcccttcaggaggattttgtgctattagagattatttttataccagcccttgacatttccgtattttgtttctcagtcggcattgatattaaaactcccagcctagtctcttgacatggacttgt

SEQ ID NO: 244189 - DNA, 562 bp, Homo sapiens
gatatataaaatatcaataatagtaatagcttgtgagagtagtttgtcagtatactcacaaagatcatgaatttgacgcttactagtatgagggataaataaaaaacattttataatatgtagctaccataaagatacgattatgacacaactgagaattgagcggtcttttaattctccttttgagtaatctttaccaacctgtcctctgagcctccgtgtatatgctatgtttaagaccaatgattagctatttatacatgaattttccatttttccttgttcaaaacacttttgtcacacaaataatattaactaaactaaagtgacttgagggagtatggattaatgaggttcacaagaaaataaataaagcaacaacttgtgaaatttagggcagatgccatttattgccatttcccgctgactgttaagtagagatttcagttcagataaacacattctaagaattactactgaaagtgtaaacatcagcctgcattttagtacttgctggttctttagtaaaaatttcgaatgtcagcccaaggttgtcttgcta

SEQ ID NO: 244190 - DNA, 622 bp, Homo sapiens
ttctgatcaatacccagttcagcattaggtcattagtgctcattacagtgaaagacggataactgtgatcctaataagtcatttgggacactttaaagattctttatatgccacatggtctgtcacctaaacccagtcaggtgctctttgaatttaaatatcatggctcttacaagcctaatacttccattttacaaaagtcaaaataaactgatggggtaaagcctaaatataaccactctaaagagtacacgggaagagatgaatcaaatgactaatccaatctcaaaataaataattaataaaattacaaaatgagttttgggcctcctagtttccagtttcatatacttgaaatacttctcctttacttaaattcccaggaattcctatggttgtcataaataattagagtgctaatagcagctctgattctgctggtaagaaggaagagcttggtcttcaaagctgaatttagtaactcagggcagggggtctttggctgcatcccaaaagcagataatcaaagaaacaaaggcacttatccccaaagtcctcatctgtgattaaaactggcatccttaagtgccaatggtaatttatttatcccagcgtattcaag

SEQ ID NO: 244191 - DNA, 456 bp, Homo sapiens
cttggtcaaggaggggtctaggagctctgtcccttgtaaagacaccttatttataattaaattggaaagtggtttgaaatagtataaatatcctgtattctaacaatcttcttctgagtattttatcatcaattaatcacccctgcctgtgtcagttattatatttatgtttttacattggaaattgtcttctcaaaattttactatgtacttgtttttgctggcattctgtcgtaaaaaggaacattccctgcccaaagtttgactttcatccaaaattaattttagtccattaaagttaaaatgttaaagttttaaatcactttaattaaatttttttgcctatcaccctggactagtgaatttttcacatacaatgttttaagcttttattttattattggttttcatggataagaatatagattaataaaaacattcttatttacctgttta

SEQ ID NO: 244192 - DNA, 578 bp, Homo sapiens
agaaactgaactcttaaacactgatggtggtaaagtaaaatggtgcagctgttttagaaataggtttggtagtcaccaggtatacagaaatgaaaacatatgtctacacagaaacatacaagaaattttatagcagcattgctcatcatagctcaaaagtgaaagcaacccaatgtctatcaactgatagatgaatgaacaaaatgtgtttctttccgtacagtgggctattattccggcataaaaaagaaatgacatgctgatgcaggttacaacatgtatgaaccatgaaaaggccacatattgtatgattccatttatatgaaatgtccagaattgagaagtccataacgagaggagattagtggttgggaggggcctgtggggggaaaatgggggatggctactaatggatactgactttctttttgtggtgatgaaaatgttctcgaaccaggtagcagggaaggttccaaaactttgttaatataccacttaaagtgtacatactttatgagtgtgaaatttatggtatgtgaattatatataaattaaaaaattcaaaaagaagtgttaaa

SEQ ID NO: 244193 - DNA, 511 bp, Homo sapiens
tttgagacagagtctctctctgtcacccaggctggagtgcagtggcgcaatctcggctcactgcaagctccgcctcccggattcacgtcattctgctgcctcagcctcccgagtagctgggactacaggcgcccgccaccacacccagctaattttttgtatttttagtagagacggggtttcaccgtgttagccaggatagtctagattttctgacctcattatctgcccgcctcggcctcccaaagtgctgggattataggcgtgagccactgtgcctggccacatttatattttttctagttcctattttttacatttatatttatatttattatttattaggtattttatttaaaaaattcctcaagtagtttgtgatcaaagtccatttaaataactaaattcaaattaaaaaataatctggcgtgaacccaggaggcagagaaggcagtgagccgggattgcaccactgcactccaacctgggagtcagagcgagactccgtctc

SEQ ID NO: 244194 - DNA, 521 bp, Homo sapiens
gcaactgtgccactgtgaatgcctcatgtgtcagcatagcttattatctagctctgagcagaatgggagtgctgctgaattagtcttggtccacaggtatctccagtgtcccagatgtttcacctcctttgttcttatctttgcttttattttgggttacaaacacagcagataaattaattctcagcatcttcagagaaactgtgggttagagcagaatcaccaactagaagaaaccatttaaattcaaaaatcataaggaacccagaaccaatgttaacactgcataaatacaacaagattaataggaggccccacagttaattcctaaggtggttcttagctgtaaagcaattcaaatgaccttcttataaaccctgggcaaaagtcccctgtgatgtggtggaaaatatcaacacgtaaaggaaataagaatgactgtgagttgagttttgttgttttagatccagatcatgaatatttaaagaaataaaagcattttgagttgggaggccatgcta

SEQ ID NO: 244195 - DNA, 366 bp, Homo sapiens
ctttgggtggcttaccatggcctttggtgtattagtgtctctgagaagttctgcaggaaagactctcattttgttaggtctcatgtagcttctccccaccgtgtctaatcacgaaggctgcatctgacggaaaacctattaacatgctacagaaatgctgcctgtgtgtacgcgtgatccctcctcccccgtgtgtttggaggcagtgaggattagagcgtggctgggagaggagcgtgcaggggtaaggacggggtaggggacccactgctggggactactagagctgaagctcccctcctcaggctgtgtcctctctttccctctgggcagtgcagaaaattcactcaatattaggcacagtca

SEQ ID NO: 244196 - DNA, 526 bp, Homo sapiens
catgaacatttagctgctgagcccaaaagcttgatttttattagctatatttgttgcccatatattggaacagatcttaaagtggaagtcagatgtgtattatcagataccatttggagtaatgagtgtattttcctaatctttccaacaccaacctaaaaactcatctcaaaagcatgcatactaattaatttgttttccatatagtaataagattaacaacctcgcatttacacggggtactgagtcatgctcaaataaaacaagttctaatgagaaaaattgaatgtggcagcaaatcatgtcccacccggcaatccaggtttatgtgtgtttgtctgtctttgctacacgtatttttgtcaggatctcactgtaaacaagatgatttctctcatgttgggttagtctaggtaaatttgtttaatgaacaacaaagtcattgtaaacattgcacaaatctgagtgcctggcagcatggctaggaatcttttaagcagcttcaaaaaatgaaacgtgtacacca

SEQ ID NO: 244197 - DNA, 354 bp, Homo sapiens
tctgccttgagtgtcatggagacaaagtggagaacctggacttctactcctacctagcagtaacaaggtggcagtaacccttcccttgacagagtggtgtcaaagagagccatataaagcagaaaatttaaatgaaatcatttcagaacataatgtgaaatacccaggtttcaataaaaattgctttttatgtcaataattagaagtatcttgaaccaaatgaaaaagagcaatcaataaatgctaacattgagatgacaaagacgttagaaatatctaacaacattttttttctaatgaagatttctaagcagccatgatttcaatgagcaattataaacatctttaggtaaa

SEQ ID NO: 244198 - DNA, 485 bp, Homo sapiens
catgaccaagcctcccttggccagctgtgcacctggtaaggccgctctgggataaccaccaccccaggcctgggctgcaggtcttggcatcctgaagatacaagcaagaggagacttctttcctcatagcctgtgagtcactctgctgggtgccctctgacagccctacccccccaatgcctctgacccctggggtcccttgctccttcccccaatgagatctgaagccaccaggatcccaggtcacccatttctctcccttgaccgtcacagtgcatctggggagcctttcagtcttgtcgcaggttgagcaggggcctcctggggtccagggcagtcctgcttcctgaggctagggctccccagccaggccaaaccccaggtgcagggctcactcctatcctgctctcttggcctcctgagcagagcttggcatgcagtagatgctcagtaaacactaaacaaatgccttacattctcctaaa

SEQ ID NO: 244199 - DNA, 453 bp, Homo sapiens
agttctttgcaagctttaatctgttaaaaacccagcaagaattccattggatgattttattagctcataccacaccctgataccaagtaatatctcaataaactatgatttttgactctttcataaaaagaactccatctgaaaatagacaaagttggatgaaaataataccctttttctttttactgtataacggtatcaacttgataacataacaaaaagaggaagttaaagtgaaattttcagtctggatacttgttgtcacataaaggatcttttactcaactcttcatcaaaaaagtaagagaaagagaaagaaggaaggagggaaggaaggaagggagagagggagagagagagaatgaaggagggaaggaaggaagggagagagggagagagagagaaagaaaaagggaaagagagaaagaaaggaaagaaagaaaaggaagaaag

SEQ ID NO: 244200 - DNA, 367 bp, Homo sapiens
ctcactcatccacccgcctgtcgacctctgtcaggtttgacttcttgcaagggaggaaaggaaggccgagagacagaaagactttgctttcatgatgagtgcaaccacagatgagtccagcaggggcaggttgcggtggaatggccccaactcagacaccttcaaggatctcccactggctgaacccaactgggaatgaagtgacatggaaatctgagatgcagcctacagaaatcagtcctcctagcatccatggcagaggatgggtgaaactggcaaacagtttcctaagctaagactgagccccaaacagatggaagcgcccacagacgtgctcctcctcctccttggcatcatcatcattgga

SEQ ID NO: 244201 - DNA, 446 bp, Homo sapiens
atttgaatgccttcttgattataagtcaaaaagtacatagtgatctattatcaaaaactattggcctatctgttgacaacttgggtaggtcctcctttaattttattgaaagcaaagaattggaaactacctaatttacaaaaaaaagaagaagaagaagaagaagaagaaatgtgttacctaattattagagctcactttctaagtttctaggaagtatgacccaaaaaagcttggccaagacttatcacatggctgttgattataccatcacccttttacttacaggcgtcttgcttatggacctaaaaaagatgaaactggagttagaaacaaaaacagaaaattgtaaattgtgcatttggggacttttctccttgactgtgaacagagacctatatacaatgccaaatttcattttttaagaatgtctcaaaatgcagagt

SEQ ID NO: 244202 - DNA, 199 bp, Homo sapiens
ctctcaagaggagggctactcattgactgggtagcaaaaggccccacttctattagggcatgctggctggagtcccctgtgtcctggccatagcacagcctttgactggcatcatgcccattctatgaatgaatagagagattgactaacccgagtgactagctttgggagctggtaggatgattaggaaaactgaacc

SEQ ID NO: 244203 - DNA, 590 bp, Homo sapiens
attttttttttttttgggatttttagtaaacagggtttcactgcgttagccaggatggtcttgatctcctgacctcgtgatccatccgcctcggcctcccacagtgctgggattacaggcgtgagccactgtgcctggccgcctttcccatttttgaagacaaaacgcatggcatatagggggtactcaatgatgtgttaaatacactaattaaagactgagagtctgtattagttttctaaagttattttctttgcatcttttacttagaatataagtgtgagttcagttgcttaatgcctagtgccaagacaactatggttgttgagttcactccccaagtgggcttctcagatttctctgtgtgaaaaaaaaaaaaaaaaaaaaaaaatgatcccctgatagtatctccactgtctccatcaaagggttttgtttgtttttttctttgagacaccacctctgtcatccaggctggagtgcagtggtatgatctgggctcactgcaacctccacctcctaggctcaagcaatcctcccacctcagcctcctgagtagctaggaccacaggcacgcgccaccacgtcca

SEQ ID NO: 244204 - DNA, 382 bp, Homo sapiens
tggccaggctggtcttgaactcctgagctcaagcgatccacccgcctcagcttcccaagagagacatttccctttattcttcttctacgccctcacggtgccactgttttataatctgatgttaaaatctatcaactgcagtgggaataaaacagttaagatagaaataatacataaaagaggtaacaaatgcagttcatgctttttagttcacttgacaaagcatgactcagctgctttgagggattcctatttaattttcttgggtcagcttgtaattaaaccttaaaagaacctgtcaaggccaagcacagtggctcatgcctgtaatcccagcattttgggaggccggggcagacggatcacttgaggtcaggagttc

SEQ ID NO: 244205 - DNA, 627 bp, Homo sapiens
tttttctttgagacaccacctctgtcatccaggctggagtgcagtggtatgatctgggctcactgcaacctccacctcctaggctcaagcaatcctcccacctcagcctcctgagtagctaggaccacaggcacgcgccaccacgtccagataatttttgtatttttagtagagatggggttttgccatgttggccaggctggtcttgaactcctgagctcaagcgatccacccgcctcagcttcccaaggtgctgggactgcaggtgtgagccaccatgcccggccccaagggctcttttaagagagacatttccctttattcttcttctacgccctcacggtgccactgttttataatctgatgttaaaatctatcaactgcagtgggaataaaacagttaagatagaaataatacataaaagaggtaacaaatgcagttcatgctttttagttcacttgacaaagcatgactcagctgctttgagggattcctatttaattttcttgggtcagcttgtaattaaaccttaaaagaacctgtcaaggccaagcacagtggctcatgcctgtaatcccagcattttgggaggccggggcagacggatcacttgaggtcaggagttc

SEQ ID NO: 244206 - DNA, 382 bp, Homo sapiens
aatagccaaaagcagtcttgaaaaagaagaagaaatatggagaactcacagttcttgattttaaaatttacgagaaagctacagtagtcaaaacagggtgatactggaatagatggacatatagaccaatggaatagaatagagagcccagaaataaaccctcgcatatatgatcaaatgattttcaacatggatgccaagaccactcaatggaaaaatgacagtctcttcaacaaatagtgttggggaagctgcatatccacatgcaaaagaataaagttagaccctttcttaacaccatataaagtaactcaaaatggatcaaagacctaaacatatgagcaaaagcttctactagactcttagaagaacacattaagga

SEQ ID NO: 244207 - DNA, 177 bp, Homo sapiens
tctttttcagtatggactgacatggcatctttcagaataacctaataacaaatatgcctcatgacagcaagtatcttcccaaggcatcagtgttttgtcttaaatgaagaaggcatactccgcccattaacaagatgttgaccttattccatatgaaataacaaccctggccatcct

SEQ ID NO: 244208 - DNA, 411 bp, Homo sapiens
ctgtctacccagctccctcttggccacggcttcctggccagccctgctggaaaccgggagctgctgcagagctggaggagggagggggtcacccagatcacctctgcagagagcagggcctggccggggatgggcttcacagaggccctcttccacccatccatgcttgttcctacgttcacttcagggagccctgaggttttgcgggaacccagggtcctgggaccccagcctcagcctctcccctccacctagcatgtccagaaatgctcatctgcagtaccaagtaccaggtgtcccagtggaatttcttctctgaataccactccggggaggaataaaactgagggagataagcaccaccctgggtttgttcgtgctgagctaaaggaataaaggctctgcactgaa

SEQ ID NO: 244209 - DNA, 392 bp, Homo sapiens
cacctagaattgcgcgtcgacatttttgttgagtgggcaatgaagctgtttgttgagaaagttagaagtatatttgagaatctgaaagggcttgaaaagttaggatgtagactgggcatggtggctcatgcctgtaatccctgcattttgggatgctgaggcaggtgggttgtttgaactcaggagttcaagaccatcctgggcaacatggtaaaatcccatctttattaaaaatatagaaattagccaggtgtggtggcactcacctgtggttccaggtactcaggaggctgaggtgggagaatttcttgagcccaggaggcagaggctgcagtaagcagaaatcataccattgcactccagcctggatgacagagcaggaccttgtctca

SEQ ID NO: 244210 - DNA, 194 bp, Homo sapiens
tacctgttagtgtcctttatcttctaacatctattgttgcctttgaaaaatctgttgggaattttctaagtctgatcattcgtaaggtaacttttctttttaggttatgggttgtttttcttatcccttatctttttctttcttctctgccttttactggtatatatctagaaatatattttaaaatacttttc

SEQ ID NO: 244211 - DNA, 469 bp, Homo sapiens
cagaagccagactgcagtaagttggggagttaactggaagtaaggaagttaactaagatctagagtttctttcaaatagcctgccaggaatgggaatgagagagctgagaataattaaattaatgagctaggtctcaaggaaactagaaggaatgggttctagaccacagaaggagggattaattgtggtcttgtagggagactcagcttcctctgagaaaggaggaaagggaatatgaaagggaatacaggtaagtttgtaagggagggcttgttggtgggcagtagggaaattggagacattactacctaatagcctcagtattctcttaggagttacagacaagagaactgggtgcagcagctcatgcctgtaatcccaacactttgcgaggccaaggcgggagaataactggaggcccggcatttgaaactagcctgggtgatgtggcagcactccatcgccaga

SEQ ID NO: 244212 - DNA, 502 bp, Homo sapiens
caatttctgcaatggctttgcatctgataaaaattaaaatgcactggaatatcctaaaacattgccagagacttcttgaaggaagatgttgatttatatgttgtatagatataataactgattgaaatactctcactgatgttaacttgcagcaaagttaaaggcttgacatgccttttcaattacaatttacttaatctcagtatttcatgtttctctggttggttggtgatgattacagagtgaaaaatatgtattgactaaggtaattacttaagtcaaatatttataaaatgtattcaacggaagttacgtttcactatactgtgggtttactttttgtactgtgtgcttcttagagcaatacgttttaccaccctgtatacccctcagtgttatagatataaaaatttaagtatccagataaggggatagatggttgatagtaggcaggcatataatatagagatgaataaatagataaagttgttagttatacttt

SEQ ID NO: 244213 - DNA, 392 bp, Homo sapiens
ccaagaaggggtcggaagagggccagccctagtttagggggaggtcaggacagggtgtgctgacgagtttgtctgaactgagatccgaaagctctgccaggaaagccaccaatgcaatcgacttgcaattcacaagttgcctgctcaacaccagccggtgtgcatgcccggatctggactaggacatggcttccagtcagcttttgctgccggcagtgatgaagaaaggcagcggttccctctgctggttccttctgcactgttcagttgtcataagtccccagggattgtattcctctgggggaagcagggcagggcaggctccagagggccagtgaggcgagcagttgtctaacacctttcttggaatgaaatgaaatttacttttatca

SEQ ID NO: 244214 - DNA, 342 bp, Homo sapiens
tctgtttccctgtagcttgtactgacttttactaatctaatagcaagacaagaagtctaaggtgggattacaggcatgagccaccacgcctggcccttgttgtgttttaatgtgaatcctgttttacttataattaaaagtagcttaactaggatatttttcagtaatggccctatttctttgaaaccgaatagaattaataacctaataaactcttagggcttgtgggacctaaaggataattccccagggttgcatgtccttcacctgagaaatgaatgcagggatctttggtagagtcagttaagactagggctgttgaacccagcgagactctgtctt

SEQ ID NO: 244215 - DNA, 612 bp, Homo sapiens
ctggggtcttgcatcccttctctgattcttcccttgaggtgggctgtccaagtgcgcagtggcctgtcagcgcttcgaaggggtcacacgtgcagtgtgtttactggagttgtatgcatgctcacttgaggcattcttcccttaccaaaggttcctaggtcataggccagttaaatgccgccatttttgccttcagtgcacatatgtgagcccactcgccctactcctgagattttattgggaagctgctgatcgcatttcaggttttttctgtctattgggaggctgccccttcctggtgccagttgcaaccaattattattttagagtgacagttaacaaccatctgaccatcacctgctggttgcctgatattcctgggggagggcaaggggccctctcctgccctgctcatgcctgaccagctacctactgtaacaatacttaatggtaaaagactgaatgttccctctaacacagggaacaaggcaagaatgtctgtctgctctcgccacttgtattcagtattgactggagatcaactgccagtatagtaaggcaaaacaaataaataaaaggaaataaaaggcataaatattggaaagaaacaaa

SEQ ID NO: 244216 - DNA, 452 bp, Homo sapiens
tggagactgtgttctcttcgctgtttagttagcgagcagctagggtggagtcggcctcaaaggttccgctctcatgtcggcaagtgtgatttgaattttaaaacactgagctttcccggtggaagagttcccaagtttattccgacctacggaagcccaggaggaccaggattaccgctgccgctggatgcgtccagggccgggatgcgcgaccgtgagacgctgcgcttccgaagccctcgcaggcttccgggtgccagagcaggagacataccctctgtccagccttccactctcagcccccagttttttcccacttttgcttttcaggagtcgtccagcaagacttgaaaggaggagaaaggcctgctggacaggatgctagagcctggcagtgaccacttgggggccctgggcattaaataaacttcttggggcccgtttcgttatta

SEQ ID NO: 244217 - DNA, 1094 bp, Homo sapiens
acctcatcaggaggctcagaccttgccagactgcctgctttcatggatagacataaaaaccttcagcttgaatgttaacaccttgatgggaaaggtggctcatggaatgttttcttatcctttgaacactcctcatttcagaagctttgcttctgttgcaaccaaacatgacacttagcgtgctgagcaggaaggacaaggaaagagtaattcgcagactgttattacaggcccctccaggggaatttgtaaatgcctttgatgatctctgtctgcttatccgtgatgaaaaacttatgcaccaccaaggtgagtgtgcaggccaccaacactgccaaaaatattctgtaccactctgcatcgatggaaatccagtactcttgtctcaccacaatgtaatgggcgactaccgattttttgaccatcaaagcaaactttctttcaaatatgacctgcttcaaaatcagctgaaagacatccaaagtcatggtatcattcagaatgaggcagaatacctgagagttgttcttctgtgcgccttaaaactgtatgtgaatgaccactatccaaaaggaaattgcaacatgctgagaaaaactgtcaaaagtaaggagtacttgatagcttgcattgaagatcacaactatgaaacaggagagtgctggaacggactttggaaatctaaatggattttccaagttaacccatttctaacccaagtaacgggaagaatatttgtgcaagctcacttcttcaggtgtgtcaaccttcatattgaaatatccaaggacctgaaagaaagcttggaaatagttaaccaagctcaactggctctaagttttgcaaggcttgtggaagagcaagagaacaaatttcaagctgcagtcttggaagaattacaggagttatccaatgaagccctgagaaaaattctacgaagggatcttccagtgacccgcactcttattgactggcacaggatactctctgacttgaatctggtgatgtatcctaaattaggatatgtcatttattcaagaagtgtgttgtgcaactggataatataaagaattgctcctggtaactaaaaaaaa

SEQ ID NO: 244218 - DNA, 734 bp, Homo sapiens
ctagccctacaaaacactgaaatgtttaaaatgcaaatatcccagcgtagtaggccgatcaacgtaacatagaacctataaataggtgcttttacatgtagaatttattttgataaagttacgaataaaggtaataatgtgggaagcaatagcctccagtaatgctgaagcaacaggatcttagaacagcgtttgcaaagtgtgctctacagaaaactatgataatagaaatcaaaatttaaagtgtccatagtccagtcaccttgagaaactctgggataaaattgtgttttttatagcaaaattaaaataatgtgtgctgtgattcaaatgggctatatgatatgtttttttaacacagaatgaaaccaaatcagagtgtcttgcaggattcaggttctttggaccacactctgcaaaacactatgttagaaatttagttttgtccctctccctcccactggacaccaaaacagcagttatatctaaaatgtgaattcatgaaaatgaatggaaatttgtatttctcacatctctagaagaaagctgtctccatgaatgatgttaaaaagggagatattgacatatttgtatgaaagtggagaaattgagaatatgaaaaaataagcaaaatgaaaagatttgggaaagactgctgcaaaaataacagaggaataatatgcagttgatttattttttattttttatttttatgttttttgagaccaaggctg

SEQ ID NO: 244219 - DNA, 589 bp, Homo sapiens
ttatggggtcatgtatgaagaattttgtcttcatacttgaagtcaaaggatgaaaaatttgatccctaaagagttcttttcacaatttttaaatttcaataaaataaagaatggtaggactgtgattgaaaaatgtgatactaaatttttctattgaatgatgcatatttatttttaaaatccttctctgtacttattcattcaacaaatatttattaagtgctcagtttgtgccagccactatagtaagcactgtggagtaaaaacaaacttggtctgtgcaatctttggatttaggttattggcagggtaggaggcaggtattaataaaataacacaaaactgcagtgaagacaagtatgattatgagcagtatggtgctgtatagataatatggtgatttgacttaataagaggccagaaaaatggtttgtttatttatttatttattaatgacagagtcttgctctgttgcccaggctggaatgcagcattgcaatcttggctcactgcagcctcagcgtcccgggctcaagtgattctcatgccttagcctcccgagtagttgggactacacgggccagcgcct

SEQ ID NO: 244220 - DNA, 326 bp, Homo sapiens
ctgagagaaagagagagatcgagaggaatcgagatttatgtgtgaaacacttctaaacatgccctataagtacagtagattctcccctcacagccacaccctgtaagtgctgtattttcagagctgaacaattaacataaggagcatgagtcaggctttgaacaactctgtgggaaccagaaagccttttgctattaggaatgatgtaaattccccaaggctggaagaaatccacaatggaaggcagacagggtcataaataacaacaatgaatactgcatatgccacataaagtatgatgctgtgatagtgacactctttcaaat

SEQ ID NO: 244221 - DNA, 1896 bp, Homo sapiens
aaatttaaactataaataggccaggtctggtggcttatgcctggaatcccagcattttgggaggctgaggtgggaggctcactggaggccaggagttcaaaaccagcctgagcaacatagggagacctcagctctacaactgaaaaaaaaatagccaggtgtggtcatggtggcaccggtctgtattccagccacttgggaggctgaggcaggaggtttgcttgagtccaggagtttgaggttgcggtgagctacacaatgagctatggtggcactactacactccagcctgggccatagagtaaggccctgtctctaactggaagtccaaagagggatctacttcctagactattaatttaatagatcaataaattaatcaagaatatgatttttttctcatctttctctgtagtcatattttatacagactttttgtttaagtaatctctctttatgggcagacaatgatttcagaaacaccacaaattattctcaaagagaaaagatgaggattttttttttttagaaaatgtaactcttttcagtagctcttggcagacctaccttcacattttcttgactaaaaacagtcattaaaaaaagtcagtcacaaacaggtgaatttaaattatcatggtttacctatgcttaacaagctttatcctcagaggtaaggatagggttactttcccgaattttagatatgtggaaatatttggagttatgtcaataaatgaaaaagtgtgatggatatagtgcttgccttggaatatacccaatacagatattctgaaaactttaagttcagtaatatgccaggggttcccaagaccacttgagacctggtaatttattggaagtctctaagggaatcagaagctgtagtactcattgttacagtatattacagtaaaaacagtacagatagaagtcagctaagagaaaagacaaatgaagtgaactccaggagaaaccaagtccaagctctcaggtgtcccctcccagagcagttgcatggggacatgtttaattatcccaacaacaatatgtaaagtacaaagcattgccaaccaggaacactcgctggagcctagttgtcgaaggtgtttactgggatcagtcgcatagtcatgtaatgcccatatgattgacctcagctccatgacatttaagcacaactttcttcctacacccagagtaaaaacagatgttcacataagtcacgttgataacataaccttttctggtcgaactgggagagtatggcccaagacttcaggaaaacaagaacacttttatcaagcaaaatactccaagggctcagagatgaactcctagtctaaggtctagtcctgcagagggacccctctttggaatgtatagtatttgagcaattcaggccagtcaagttaaaccttttcacccatgcctaaatgctatttaataaatgtaaataacaacgatgagatagtttattaaacatttttattgaaatacacaaatagtatatagttaattaattttaacaaagtgattgtacatatttcacaataaaattcccttaaattaccatctgctctatctgcaagtaattattattctgattgctaataacatagactttttttaacctatttttgaacttttataatagaattaaacaatatatattcttttctggatggcttctgttactcagaaatatatttaggagagtcatcaaagctctcttgggtataccatttatccttcttgcttgataatgctccatgtatgtatatatatgctatgatgtgtttattttactcttgatggataactgcaaaacttccaatttaagctgttgtgaataattctttaataaaaaattttgtacatttgctgaaaaaaata

SEQ ID NO: 244222 - DNA, 456 bp, Homo sapiens
actaagtcctgcacaagtgctatttacttggctgaactaattggagtctggggtgttgcttttttagctttacgcccactcttctttgggaaagtgtgctttaagggggatgccatggatgttgaatgccccaatctccattcctgcaacaatcagaaacacatttttctcactaaatatactcccagaagtctctctcacagaaacaaaagcaatcacttataaggatctgtataagggtgtttattacagatgcatttgtagtggcaaaaaatctacaaagaccaacactaagaacatggttgaactaatcacagatcatgcacatctctgaatattatgaaaaagagggaaatagagttctatgagttggagggatttccgcaggatgttgttgacagagaaaatcaagatgaagaaaagtgtatactatgtgatcttttgtttaaaaagaaa

SEQ ID NO: 244223 - DNA, 208 bp, Homo sapiens
gataaaaggagcggtccaaggcactggagtgctgtgttttatgtttaatgcataaagggagccactgcctgccccaaaccaggtaccttcgaaacatcacgatggccctgaggctgcacctagacctgagcacgtagcatggaagtcattctggcagtggccgtggtctctgtggaggtctcagcttccgggccgccaggcagcccag

SEQ ID NO: 244224 - DNA, 432 bp, Homo sapiens
gcctaacttaatttttaaaatgtatcagattcaaagtttaatatttgattttttaaaaaccagtaaactcaacatatatttggtcaattgagttttgacaaaggtttcaaggcaaaccaattggaaaaggacagttttattaaataaatggtgcagaaacaactggatatctatttttttaaaaagaatcttgactcttaccccacactatcacttaaatgtaaaagttgaaattataaaacttatagaagaaaagataggagtaaatctccatgatcttgtcttacgtaaagttttcctaggacacaaaaagcactaatcatttttgtaaaaagataaatttaacctgataaaattaaaaatgttgattacttgaaagactttataagaaaatgaataggcaaataagatattcacaaaacatatatatga

SEQ ID NO: 244225 - DNA, 163 bp, Homo sapiens
gccacactagcctttgtaaaaggctgtgatctgtgcatccactatccataaactgactagggcacaagtggagcagaataagggcacacagagatccttctcactatgactcggaactccaagaacacactagccagcttgtcaaccagcgggtaggacagac

SEQ ID NO: 244226 - DNA, 423 bp, Homo sapiens
ctcccctatccctcccaagtcgtccttcggctcctcagcacccattttccctgctgcacaccctcctgacaactcctgccctgaagccctgggcccgggtcacggcgggaaggtgagtgctcacaggcgcgagctcacgttaccaagttgggtcagcgtgcagagaaaagggaattgggaattggagggctgtaaaatgtaaatgtgctttaaattttacatttcctggcgtggccaggacaggctgaccttccgattacaatccgcgtcatcccgtcgcttctgcccccagcctggcgaggtcgggaaccgtttcccgcaggactttcattgggagttacgagggcgccctgtgcctggaggtggcgcgggctggagccctcccggaggagaccggcgcctggcagggggtcgtcgcggccg

SEQ ID NO: 244227 - DNA, 521 bp, Homo sapiens
ggctggtctcgaactcctgaccttgtgatccacccgcctcggcctcccaaagtgctgggattacaggcataagccactgtgcctggccgctatgaataatatttctaagcatggttacataactgaatattaaagtcacatattacttttaaaaagaattagtcattatcatacattatctaagtattatactaatattaaaatattaataacaatagcctacataatagcaaaaattggaaagcagaatagaggggcagaggaagttaaagtatgccctgtcttcatcattaaagaaaagattcaaaaagtattgcatcatccctttgaggactaccaaaaaaaataggttaaagaatgcttatgaagctgggtatggtggcatacacctgcagtcccagctctcaggagactgaggcaggaggattggttgagcccagaagttcaaggctagactgcactatgattgtgcctgtgaagagctactgcactccagcctgggcaacatagtgagactccgt

SEQ ID NO: 244228 - DNA, 540 bp, Homo sapiens
aatatttattgaataatcgaataacttagtgtaggaatttagtcttagtcattaaatttaactaggtttagtcaacttaatgaagaaataactgataaaaaatattaggaaatattgtttgtaatttgagggtaaggaaagtcttcatcaagacccaaaatggatttgtctttttaaaaattaataaatttgaccacatagacatttaaaacttctttataaaaagtacaataaacaaaggttgaaagataagtatcagacaggagaaaatacttgcgacatgtaacaggatacattaaagatacataaaaagatacatacaaagcagaatgaaaaagacaatccaatagaacagtggacaatccaatgaacagaaaattagagaagagctgttgcaccatatacaaaaattcaccgagaatggatcaaagacctaaatttaagaactaaaacaccgaggctcttggaagaaaacaaaatctaaatggtattggagttggccatgatttcttgaaatatgataaccagagcacaggcaac

SEQ ID NO: 244229 - DNA, 180 bp, Homo sapiens
cattagattaaaagccagagacatattatagtcctagttctttcgcttactagagatttgaccttgaaaagcttaatttgtttaaatcccgtttcctcatctgaaaaatgaagactgatgatatctgtcctaactccatcttgtgatgatccaatggaataaagtgctgtcaaaatgtga

SEQ ID NO: 244230 - DNA, 267 bp, Homo sapiens
aagtggaaaggatccttggacgtcaggcggtgcagcctccttgaggttctgaaatctggcagccacattctggcctacagcagtccagcctctacttaatcatcacactgccagagctcacctcatggggccacatctctgtcactttaatagggaaacagtctaccaaaaattggaccaagatttgcagctcttcaaactccaccccttagtcctacctcagacctttaaagcttcccagaataaatctaatttctcaatgacagc

SEQ ID NO: 244231 - DNA, 432 bp, Homo sapiens
acattcacgttctgaagtatcacctcagtctttttctctatgcacatatataattattttaaattaaaattgggctcaagccatgtttacatagttctatagcctccatcttctgcttaacacagtgtcgtgtcccttttcctctgtctcaaaaaaaaaaattttttttttacttgtattagtaatggaaatttgtatttcaggagaatcgcttaagcctgggaggcggaggttgcagtgagccagcatggcaccactgcactccagcttcggcaacagaaaaaaaaaaaaagcatctgttttgtttactatttaaataattacatttatttatgtcaatgttgaacctatttattgtcttattgtttaaatgttaaatctgtgcagcagctttattctttaaatattaaacatgtattgtgttcattaaaa

SEQ ID NO: 244232 - DNA, 479 bp, Homo sapiens
ataactaaaagtataattggattgtttgtaacacaaagaaaggataaatgcttgaggtgacagataccccatttaccctgatgtgattatgactcattgtatgattgtatcaaaatatctcatgtaccccacaaatatatacaactactatgtacccacatatattaaacattaaaaaattttaaaataaaagcgtatctcattggactgtagaaagtatcaagtgagataacctttccgatgtgcctggtactgaataactaagtgctgaattaatttttgtttctctctctttccagaaggaatgaaatagaaagaataaagctgaaggacatttcatttatgttcaactagaaatccaatatagttttaggcaaactatattttcccttgcaactgtactcccttacatacatgtaagtgggaaagaataaatgtgacaaacaaaatatcactcctgattccacaatctaaacaaa

SEQ ID NO: 244233 - DNA, 178 bp, Homo sapiens
tcttctttcatattgtttttaactgatcattcatgtcctgctatgggaagtttagcatctctctcaaggatgctcctcctcaccaattttctaagaactgcagagtctgaatcagtttacgggggcatcactgccacttccaaatgcaaataaaagggagaattggagtgccaccaat

SEQ ID NO: 244234 - DNA, 450 bp, Homo sapiens
cccgggttcacgccattctcctgcctcagcctcccgagtagctgggactacaggcacccgccatcgtgcccagctaatttttgtatttttagtagagacggggtttcactgtgttagccaggatggtctcgatctcctgacctcatgatccccccaacttggcctcccaaatctcagtataatgaggtgttcaaacctactcatacacaatactttttacaaaatactcaaaactggttattcttttaacacaaatggctctcaaatattaccacacctagtttatgttctaatgtagctttactactttcacatcttaacaaaagcccttctgataaaaatcaaagcaggaaaattttctgtttttaaaatgaggaacatagccccagctaaggtagtaatttcactatgatcgcacatctagtatatggctcgtggccgaattcctgt

SEQ ID NO: 244235 - DNA, 283 bp, Homo sapiens
tcaaaaaaaaaaatttttttttacttgtattagtaatggaaatttgtatttcaggagaatcgcttaaacctgggaggcggaggttgcagtgagccagcatggcaccactgcactccagcttcggcaacagaaaaaaaaaaaagcatctgttttgtttactatttaaataattacatttatttatgtcaatgttgaacctatttattgtcttattgtttaaatgttaaatctgtgcagcagctttattctttaaatattaaacatgtattgtgttcattatcta

SEQ ID NO: 244236 - DNA, 724 bp, Homo sapiens
cagagacggggcaatgggatgttatatgacagaagcctacttcaagacattctccaaaatcataccattgaaaaggcagcgcagctcagagtaaggaactgacgtagatcttcctggagcttggtggaggggggtcagaagtatgaagaaaacaggaaatgtggagttgaatatttaagtgcatctctgaggcaacacctgtggctgagagaaggcaccagaagcagctttgagcagagagcagatccagcatcaggacagagaggaaaagaggcaaatccgatgtgatatttggccacatccaaacatcctgtgactctctaaaagcaccataaggtctttgtcacaaatatattcattaaattatgtgttttattttgttttttaatagcctttaagaagccaaagaattttgaaataaaagtatttcttctgattatgttcacaaattaacaaagaatccgtaagcagtgtgatccatttaagccataaagctgtgcttctgaagtattattagaaattctaaaattgtttcctaagattttggatacctttcaaagtgtttgaaatggatggtttagaaaacacagctggcttaataggctagcacaggggaaaatgaccttctacagataagaacacacccagatggaggtatttggctgtttcttaagagagttgctttagtgagcatggaaagaaatgttcgctaatagaaactcaa

SEQ ID NO: 244237 - DNA, 350 bp, Homo sapiens
agcctgtgcaactgtcatgatgctccggaagaatggtaatcagattatttcagatttgcatctccagggtttagcatcaggacagaggattaagtaaattctttccattaattctcacatctttagtttttcttccaagcaaacaactatacagagctatgtttcagaaaaatatagaggtaatattaaagtcaatgcagctgatgattcaatctaaaaaatacttcatggctgggaacggtggctcatgcctgtaatcccagtactttgggaggccgaggagggagggttgcttgaagctaggagttcgagactcgcctggtaaacatagcaccaccctcatctctaca

SEQ ID NO: 244238 - DNA, 429 bp, Homo sapiens
ctttctggacccaagggtatttatggaaggcagagaatgagcagtggccttttatataattcatcatgttatcaaagaaacaccacactgttagatgtgcccttgcaggtttggataaaattttatcccaacaaatgcatttttcccccctagaatgtgttcgctggggtttaaaggagagatagagataatcccattgagctatttatctctctgaaaacgttttccaggaagagtgttgaggttttagctgtagaactgctattgattttttttttttctggtgtgctttgttatagctggtgaacagtgacagtttgacagcactgcaaaataagaccccagtttatccaaggggagaaagtggagtacattcatacatgcagtaaaagattaccgactaataaaactcacaacaatgatttaaaa

SEQ ID NO: 244239 - DNA, 168 bp, Homo sapiens
acacacacacacatacatacacacacacactttttaaaaaataaagttcttcatccaaaggccaattcttaccaagtagtttgagaaccattgaagggagaggcttttattcttttacttctccctgcccatctcagatgtgatgagaccagaactcttttttttctt

SEQ ID NO: 244240 - DNA, 137 bp, Homo sapiens
ttctgttttccctctactagactggaaagccccatgacagcaatgatcaaatctattaagttatctccaatccctatcatattataggtatactacaaatatttcttaaataaatcaattattctttttatttttct

SEQ ID NO: 244241 - DNA, 680 bp, Homo sapiens
cagcaatcttgtttttattttcttccaaacatttaaaaccttgattattgacatactgaaattggcatgcattctcttttcatgcaggtaacagaatagacatggagcagatccctctgaaatcagttataaatattaaattgtattgaacattcatagtaaaaatacgttgtaaagtgctgaagtcatgtaagtctgcaaaactgccacaagctcaaagttcttctcaagcagtggcagagatttgctatatccaccttgttttagattatgcctgtttttgacagacactgtgtcatttcctcccccaccctccccaaagttttatagattgtcctatttctatggctggtaagatgctctacaaaatgtagcaggtggtgatgaactatgccactttcatttcagtgcagagaaatattcaagcttgtgtgtacctgtaaccaaactaggcttgttatgtttttcccccgagttgtcataaattaacattaatgatgagtaaagatggagcagcgagcattgaccgtcacctgcagggtgagattgcagtaaaataggtgagtaaaaagtccacctattatcctgacacttgtcctctttacagaaaactgtaacgtgagcaatactatacatgtagtgtgactccaaaaataaaaaataaaacaaacaacaacaac

SEQ ID NO: 244242 - DNA, 432 bp, Homo sapiens
cattcttttcattggtgtgagtcttgaatataaatggaaatcagaggtctgtaatagcaggccagtgtggataaggcagtaaggttttgagtctgaggagatggctgggggcagtttgtagacttattgtcagtccagtgtagaatttgagaatatagccagggcttaaggttccagtttcaaattaaagacaaaagaaatcagcaataccaaaatgaagacagaagcctgggaattgtgcctcaagatctggactgagaggacatttctacacaacagctcccctaagggcggggtatgaccgttgttgctaagctgtcaccatctctccttccctattagactggcttctgtggggtaattaaccagtacaaggatgtatgggaagctcttctgagaagacctcacattaaaacaaagtgttgttattca

SEQ ID NO: 244243 - DNA, 440 bp, Homo sapiens
gtctgaatctgtcagtctatagttctctactgttccatcaacaggaagcatctggtcattcttcgtgtaattgttagaaaataccaggtgtacttttaatgtttgctgttcaaacgaaaatagattggatcttggttaagttcacttggtttggccaggcacagtggctcacgcctgcagtcccagcacttggggaggtggaggcgggccgatcacctgaggtcaagagtttgagaccagcctggctaacgcggtgaaaccccatttctactaaaaatacaaaaaattagctgggcgtggtggtgcgcgcttgtaatcccagctactcgggaggctgaggcaggagaatcgcttgagccagagaggcaaaggttgcaataagccaagatagcgccattgcattccagcttgggcaacaggagcgaaactctgtctcaaaa

SEQ ID NO: 244244 - DNA, 220 bp, Homo sapiens
gagactccatctcgagaaaaaaaaaaaaaattacatacttagacgtgagagtcccacaaaatatgagatttaaagaagtgtcagaggattgaagcttatcatatagcatcctgacctgcagaaaagaagaggggcttggggcttttgggaggtggtggtgacataagttatgggagggtgcagggaggaggtgtatggtgaataaaagttgttatgcaga

SEQ ID NO: 244245 - DNA, 379 bp, Homo sapiens
gtgtggatttttgaatggatattctgaagacaactaggtggttttctaagctccatctgcttcccaggcctttggctgccattctaggcttggatgtacaggacaactgcagcactgggatgagcttcttcagcagctagaactgctttgagctgcttctctgaacagcctgtctggagatgtcccgggtggctgaatcactgcacctgctgagtgaccagctgtgtgtctttgaggctcgtggtaaggcagtggccagtgcaatgacactgcaagtgtggctttccaccctgccctgtcactcctcctttttcactctcactgccttgggactccacgtttcaaataaagcacccagtccagccccattttcaacaga

SEQ ID NO: 244246 - DNA, 575 bp, Homo sapiens
tggtcgagacggggtcttgatgtgttgaccagggtggtctcgaactcaagtgatcctcctgcctcagcctcccaaaagtgctaggattacaggcatgagccactccacccagccgtaaacctctttaaatggctaccaaacttaactaccatcttctctcaatgccactgtttcctttacaacattttccgtttttgatttaacatataatatgtgtttcctttagaaaaaatgcacagagaagctaaaagaaaagaaaattaattccactacttagagatcatcactgctaacaccttggtatatatccttttagattttgttttattgaaatatacacatgaatatatattaatctgcccaagaatatatatttataaaagtgggattaaacacatactatttacatatttatgaaaatggaatgaaatacatactccttcataagccctgccgtctttccacatcaacacatttatttaaagcatcattttcagtggctgcccaagtcatggtggaggatcagaggcaaatcctcttcttgatgaggatgaggagtgaggataggagaagga

SEQ ID NO: 244247 - DNA, 2169 bp, Homo sapiens
  misc_feature (687)..(687): n is a, c, g, or t
  misc_feature (804)..(804): n is a, c, g, or t
  misc_feature (1487)..(1487): n is a, c, g, or t
  misc_feature (1519)..(1519): n is a, c, g, or t
acgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacntgtatttcagtgctgaactttggttgtaccatattaaagatttagttcaaaaagtttatcaaggatccacttaacacgtcttcacaacataatatatgtaactgtaacatggggganagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacgttcccagttgtgctatttagaattatgatagtattatgctcctacttttctttgatattgagttgtcttgttattgtttattgttttccagagaaatactatagtatccacagaagaattgtgaatacttttttataattttgaactgggacatattgcagatgaggaaggtagaaacatccatttggccttagagggctctgctagtaaaagaactactcagtggtggtttgaaaaatcttgttctggggatctgaatttcaaaaatgaaccctaggggagatcaaaatccattttaaacaaagatcaattaagagccaaagtgaaatctaacttgcaaacaacaatttgaagccttgcagcagacttaaggaattcccgctctgactggggaaaagtataaaaatggacctgagagtaccctctngagggatgatcaagaatggagacagttggagntgtgctcattaagattcaaaacagcagaaatccatttttggagcagattataacctgtggccaaaaaaaaaaaatgtgtgctgtttgacagctaatggcaatttatacaatcattggaggctggtaaagctccctaatatgttgccaccattatcattgcaaccaaaaaaattctgaagattgtgtggtgatctacgaaagagataaataattactgttatttaaacccaagtgaaacaatgacggcagcagcatattatcaagaaatttaaattatgcatgaaaatgtgatttaaaaacaatgtcctttgggtaacacacaagaacctacactttcacagacaaggactcgacctcacatgtcacaagctactaaagcaaagttaagtgacttgggctatgaaattttgtcatgtccattttagtcactggacctttattccatggactactgtctatcatttggagctttttctaagaaacaatgcattccccaatcgagatgaagtaactggaagatgttaacaatttatacagcctaacaaatgatgaattttataaaagttagacctttaatattctgttggaagaaaactattcatgctcctgatgcatattttgattgaataaaacttatttttttaaataca

SEQ ID NO: 244248 - DNA, 502 bp, Homo sapiens
aggagacatgaaaaagcaaggaaatgtgacgccttcagaagaaaccagtaattctccagcaacagatccccatccaaaagaaattcaggaaagctcaaacagagaattgagcagagaattgaccggactgattgtaaagaaggtcatcaacatggaagagtcttttgaacaacaacataaagaaatgaggaaaagaggtggggagatatatgagatgattacctgccagaaagaggttttaaaattcaacagaagagtatttctggaactgaagaaatcattggatgaaatacaaagtacactcaaaagcttcaatgatagactagaacaaatagaagaaaaactctcagggcataaaatctgaagcatttttctcactttaaagattcatgggttgtactctggccattaatgtgaacaaaacctgctgggttagttcttattctggggtcttgggtaatcgttagagcgaaataaaaataatttcccttaaaaaaaacga

SEQ ID NO: 244249 - DNA, 307 bp, Homo sapiens
agcttgcaaggaaggagtcgtgattgtctcttagaagggctgattcgcagtctgtattatcttcatgcttctagcaagtttactagcaagtgtgtattaaaggttaaagaaagtagctttccagctattagagcttgagatacaacgtggaaaggagtctagaaccccagggagataaactaggctcgacctacttttctctaaacacaaacacagtccttgctgtttgctaaactgagcaaatttcatcgacagctgtcttctaggtccgtaaaatattttcttctataaagcatatttttaatag

SEQ ID NO: 244250 - DNA, 454 bp, Homo sapiens
tctcaaaaaaaaaaaagagtctggaaaaggagtaggtccagatccaggagtactctgcagtgccataccaaagaatacatgtgagctttaaaagaaccctggctacaacatggagaaaagtttgggaaaggagagagcctagagaaaaaagaccaggccggacacggtggctcaggcctgtactcccaaagtcctgagattacaggcgtgagccaccgtgcccagccccagcctttttttctttcctttttttgtagagacagggtctcactatattgaccaggctggtctccaactcctgggctcaagaaattctgctgcctaggcctcctaaagtgctgggatcataggtgtgagccacaacaccaagtcaatatttttttatatagagtacttgctgaaatgataatattttggatactggggttaaataaaaatattttattacatttaa

SEQ ID NO: 244251 - DNA, 585 bp, Homo sapiens
ttacacaaatgtaaaattagagtaataatagtgactccataggaccctcaagataaggaaataaggtattttagtcagatgattcttatcacatgtctaaaaatttagtgtctctaaaattcttgatatatgcataccagtagacactcaacacatttatttcactactaagaaaaaagttttctttagttagagacaagggattttatgtgaaatgtgtggaaattctatgccagaacgatagtacatgtagaattctttgtaaagatagaaatcttgagagaccaaggagttaattgtcaaggatctcaagttcttctcctggttagttcacattcctcatcttcctttgtttctggagttactcattatctgtagatctcttttaaaagtggtttttacacattcactttaaagagtaagaatgttcagtaaatacaattgtattttaatgtttaataaatactaatgtttaataaatactgtttgatgtttcatgtttttaagcattgaagttttaataaaaagctttgcttttaataaataaaatttcatgttaattttaatgcttttccaagaaataaa

SEQ ID NO: 244252 - DNA, 385 bp, Homo sapiens
ctcccaaagtgctgggattacaggcatgagccaccgtgcccggcactcatcatgggattgtaagacttaaatcagtttgaagattttaatttttatagttttttttctgtttattttgccatgaaatcattcacataataacttcatgtttctttatttaattcttactctagggatcaacagtctttaaaatttcagtgatatttatccttttataatcatagctataggctgggcatggtggcatgcacttgtagtcccacctactcaggaggctgaggtgggaggattgcttgagctcaggagtctgagactcagcctgggcaacatagtgagacctggtcccccccagctcctaaaaaaagtcagccacatctccgtctca

SEQ ID NO: 244253 - DNA, 580 bp, Homo sapiens
tgagacagagtctcactctgtcgcccaggctggagtgcagtggcacaatctcaactcactgcaatgtccacctcctgggttcaagtgattctcctgcctcagcctcccgagtagatgggattacaggcacgtgccaccacatcggctgattttttatatttttggtagagaagaggtttcaccatgttggccaggctagtcttgaactcctgacctcaagtgatctgcccaccttggcctcccaaagtgctgggattacaggtgtgagccaccaggaccagcctctagtataagttcttagaggaatcttaaaatgaaaaaattagtttgacattcccaaaactgttttccaagaaccaaaaggctttatcttatataaacacacctagaaaactgtaatttaaaaccaggctttttatacataacaaaaaggtaatctcaataaaaataaataataaacctgaatacaggcatatctcattttaatgcatttcactttattacacttcaaagatagagatttttaacaaattgaaggtctgtggcaccctacatcaagcaagtctatcagcaccatttt

SEQ ID NO: 244254 - DNA, 582 bp, Homo sapiens
atttccacctaactcccctttgcccacgatttcagggaacctaggaggcttcctggccttgtgaccttttccttgaatctcttataattctttctacctgtgttgcatggcagattctcagattgaggctaaagaaaagaagggtggggacaaagcatacagaatgtgtgtatctgtttttatgtgggtgttggctgtttttcgtcactgctttttaagctgaatcttagctggttttcttgaactttgactttaggtgtaaaaattcaaccagacattctctccttactgtggtcagctgacatcataaccactaaggcttaatgagcttaacttgcactttcatcactagcaaaggtcttgaagttatttctcttactgattcataatgggtgtgtgtatgaatcactctcacataatttagatataaaaacctatgaggatgagggagggaggggaagaaaaaaaaggactcctttcattttcatccgtacttcccagatgggctgaatctccgattatttgacccatcattgttattaatatggttaataaactacctatttattgattgaattgttc

SEQ ID NO: 244255 - DNA, 820 bp, Homo sapiens
gagcccccaccacttgttggggacctgcctaccgttatttcatgggtacactgcaggttccttctctcctatgctgcatgattggtggtctgctgtacactgtgcagatgtttctcctgtgctatttcatgattatttttcaagtggcctcttagtcaagggatggcaggtcaacacatgggaacatctgctcttaccatttttctaagcaaacagcagatggcattgctgctgtccttttgatctgaagcaaaaattcccatgtctgaggtgttggtttacattgacactgcctggcaagcgactgcctgagagtcggcctcccgcaacagtagcactgcttacagatgttttctctgcaatgctcatttttagtttgtttcttcctgtgactctacttctgcagggtgtcttaaactttgattcttcctcctgtgactgttgctccatcacctcactgatgtcaactatggtcctcaggtttcctaccatttgtcacttgggatcaccattagagttgccaaagaggagacagtaacctgcctcacatcaggaagtagacactggctatgtgtgtgtgatggactacacaagattatcttggaaatagctgaaccaccaacctttttctaggtgattcctctgccagacaagaccatcttaaaattacattttaaccattggatttataaaactttaatgtatgtattctgtaagatttgtactcatcgaacaacttatctttacaaacagtgcaaatatgcaaatgaaatgtccacttcagtgttattttctagacggagtagtagcctgttagaag

SEQ ID NO: 244256 - DNA, 438 bp, Homo sapiens
agaatcaatgggaagggcattgtctgtcctgctccatgggtgccatgcttctccggagagcagtggagaagcattgaagcgctttgagcctggagatgacagtatcaggcagagcagtttcagtgatggagggtggagggaatggcagaagccgccatagacaaggaggctgctccgacttgggactagcaagagaagagcagggcctggatggagggatcagaagcatgggtggagaagaaagggcagagatattttaaaaatggaaggaacaagtcttaagccttgaaactctcccctcctaggatcgtgtgacctgcaccatcctgcaagctgctgcgttgcctaggtgaccagcagcagcaggggttggatgtgtgaaacttgggatggaggaaggactggaagggagccaggaggattgagcaagaaaggctc

SEQ ID NO: 244257 - DNA, 591 bp, Homo sapiens
ggtacaaagatttaggcctaactagcttagagaagtggtgtggagtagtgtaggagactgaatcattggtctcaattcctcactctcctgtagtagttttctacgtctttaccctgccataacctcatgtgagatgggtttttgtacctgcctcttcattttgggcatgggtatatgacttaccttggcccagtgggatgttagtggacaagacaaaagcagaggttagtagtatgcttgggctgatgggcttatcctctagtgcctctgtcatgactatgagaagaaaaaccctgaattgccacagcctcttcagcctgtttctcattgtgagaccatacagcagagccacctgagccgacctgaacttaaagcagtgccagcgcaactcagatgcctgagtgaaaataaaattcttattgttgtatgacactgagattttgtggtctgttgttcagcgttattgtggcaatagatgatgactaacacatttatcctgctggatccaggacaactccaggggctttcataagcaggttttcttggatagtctctctaggattttgccatttacaccactccctatgggtc

SEQ ID NO: 244258 - DNA, 706 bp, Homo sapiens
tttatctgagtttggttttaaaaaatccagatacaagtggacccatgcaattcaaacccatgttcttcaaggggcaactgtaaattgaaacttcaaactgatttaaaatggaagggaaaaatctcgttcccactcttatcacaaggcaagcactgttaattatttctggtgtattttttctatattaagatatataaaatagactccatttttacacagagcaaataatatatatcatcctataccttgctttgttcatttagtaatatagcagaaatatttccataatagcacatgtagatgttttaatcattggatgggccataaatttatttgttgcctaactgatgaactttaaatcatttctacttacactattattataaacaacatttccatcaatatccttatacacatgtcattggggacttgtatgactctctgtaggataaattcctttcaatgaaattgctggatcaaaatatatgtacatttaagattgggttaatgttcctaaattgtaaccgccaaaaaagttgttcctttatattcatcgacagtgtaagtttcactgtaactttgccaaaactaagttttattgaatttaaaaatttttgtcactcataggtaaaaatggtatcacactgttgtgacctgcatttttctaagcactaatgaagctaagtattttttcaagtgttttttc

SEQ ID NO: 244259 - DNA, 528 bp, Homo sapiens
gggagcctttgtgtatttctccatctcagcagttcctggggcgcttcccaagtctctctgtcaccgaatggcagagctgggaaggacctgctccagaataatgggagggagcggtgggacaagggagggaggaggcggccagcgttggaatgtggagaccagggtattggcacttcagagctgagcatcttaacattttctcttcttacccccagctggggactttgcatttgcaatgagggccccacttctctgagccctagtgaaagtggatcactttaagcccacaacaatggtggcttcttatcctcttagttaatgctttagataacttttcttttagaccaggtaggggcttgtaaagtgggactgtggctctggccttgcctggtaagacacatgaaattttctcatcttttctaactatcttccctcccctgttttctcttaatttgaaagaaatctctgcattggtaaatgtggacaaatcaagctgtgttagtgacatatctccagcagttgtcacgg

SEQ ID NO: 244260 - DNA, 342 bp, Homo sapiens
cttcaggtcctagacatttctttgttgagaggttttgattactaattcaatcttcttactcataattggttggctcaagttttctattttcttcatgattgggtcttggtagtttgcatgtttctaggagggcaagcataaatttgatgtctctaggaataaatctctttcttcttggtttaccaatatgttggtgtatatttgttcatcatagtccattgtgatcttttgtatttttgtggtatcacttgtaatgctctctctttaatttatatttatttttatttgagtcttcttttttcttagttactctagctaaaggtttgctaattttatttttcc

SEQ ID NO: 244261 - DNA, 427 bp, Homo sapiens
tttgtaatttccttgaacacagctttccctcctgaaagctattttttcctttcaccgtcttgcttttttgaggcacacatacctttgaaagtatagttcatatttcatttgattcatcaaaaccattatagttacataggtgtagttatgttaaatttcatgaatatttacatttagagacttccacttcagggaagatagatcagatgtactttttcctatttctcttactaagtacaacgaaaagccctggaaattatgtataaaatcatattagaagactctgaaaagtggagaagaagtggcagactaactagggatcttgagacttgaggaacgacataatggtgggttccctggagtttctttttgcctcacatatcccagattagatactgtaaaaacgaaccaatgagagtaggccaca

SEQ ID NO: 244262 - DNA, 233 bp, Homo sapiens
gggattataggtgtgagccactgtgcctggctattatttttcttttcaagacccataggaattgttattgttgctttaagccattgatgtttactagatttacccaaatgttacctctttctatatccttcattccttcttccttgtcagatcaccctgtgataccaattccttacaccttttaaatgtttctttaatgagaatcttccgtagtaaactcagtttgtccgaaa

SEQ ID NO: 244263 - DNA, 459 bp, Homo sapiens
caggaaacatgcatgagactaatacaaacattgataatgtaaatgtacttcctagggtagaatataaatttttccctaaagtttctttccagcagctttatgaattaattggtatttgattgattgattgacaactccagttattaactaaattgaatcagctgggaaacattgcctggattacttcctcagaattatttctgcacagggactatatgattgaatgtaatcaaatagactcaagaaagaattaaattctttaaagtcacttaggcttttaattttttccctccttttttgtttttgtctaataattgaatactcatttaaaaaatgtgttattgatatatctaaggaattaaatgtcattgaactaatgttacctgtaacgaggaagaaattgttattgaaagaagggaaataaaaagagaataagttctgcaagactacttttgtgcc

SEQ ID NO: 244264 - DNA, 581 bp, Homo sapiens
gagaggagaataacttacgtgttaaggtaggaaatgtagggaagacactgtttttttcctgccaacatgttttattcaaattaaatatagatgattttatcagtatgcccatatggtaaaaataactgtatcaagtccatcaaatgttctgctttagactctcccaatgcaaagatcaatatatatgaattggatgttagttttgttttgttttttagtgtaggctattgtttttaagattctaacagctcctttacactaagcccgaattcattttacctggtgatttgatttgaaatgtatgagctgtattatataactttcaaataagtaatacaaattcaaagaatatggaaagaagagtcatacaggcacactgacagtgaattgtaatctggcaggtgacaatgattaacaggttgtgcggattcaactagacctaaatccctgaaacaatattaaaagacagaatttttaaattaaaaacattgacaatataataggcctataatatttaaaaaaatgtttacccatcatcagtcgatattaagttaaactagaaaatttggaacacactatcc

SEQ ID NO: 244265 - DNA, 554 bp, Homo sapiens
ccagcactttgggaggccaagatgggcagatcacgaagtcaggagctcgagaccagcctggcgaatatggtgaaaccccatctctactaaaaatacaaaaattagccgggcgtggtggtgtgcgcctgtaatcccagctactcaggacgctgaggcagaaaaattgcttgaatcaggaaacatgaaaaataacgaactattaaatcattagcaaaggtctgaaaagaacaagaaagtggctcctgaaaagccacacttgaactttgttgaaagagcagaccctatactacaatgtacagattggcaggcagtaaagttaatatgtgactgctgtaaataatttgtagttcatggactactatggtatgttgctgctttctagcctctgacctgcttgctttccatggattaaatatactgcaaataaagcaataacagggatacatatcaccgatggtgctagatacaagagtgcattttatttgatcaatgaggcacaggctatttttatttggaacttttctgttatatggaactcatacttgatagaaata

SEQ ID NO: 244266 - DNA, 473 bp, Homo sapiens
ttgccccggttgccctttcctcaccataaacttcaaccgaatgtaacaatatggtaggagagggatctcattaagcctcatatcgtagattctacacactggattttgtgtataatagccattcctactggagagcagataatagtgtttaccactggatagttcccatgtcctgtgaatctatgcttagtgttattgaaaaactgcatttacaaagtgtttcagacttgccttccaagcatcatttcacttcattcataacattctatgagtcggcactagtattacctggatttagagttgagaagcagagcacctaaagggtaagtaattgtcccaaggtcgttggggaactaactggcaccgggattccaacctaggttccaaagcctgccctccatctcctcaggggtccgaattctagaagaggagatatttgtgtccactagatggtgctgattgtcctcttaaaa

SEQ ID NO: 244267 - DNA, 404 bp, Homo sapiens
ttcggacatttgcccctgaacttgaagtgcgccacaccccactcccactgccagttgccacccccgtcagctctctttctgcctgtcctctttacactgttacagtgacacccaactggcagggggagggggtgggaggtattttgcctcccaggggatctttgacaatgtcttttggttgtcactcctgaatggggagttgctactggcatctctggatagcggccaggggtgccgctaaacatcctactgtgtacagaacagtccaccacaacaaagaattaaccagcccaaaatgccattggtgtcaaggctgagaaaccctgagctacactaaacaatgtccctgggaagacctcagtgaaagtgactgataatgataggaaaaaagaaggaaatgagta

SEQ ID NO: 244268 - DNA, 242 bp, Homo sapiens
agtagaccccagtctctgttgtttccttccttgagttcataagtttttatcatttagctcccacttataagagagaacatgcagtatttggttttctgctcctgcattagtatgctaaggacagtagccctaaatgactctcaacatgacaacaacaacaaaacaaatagaaagataattttggagagcaattattatgtacacatatccccatcaaaataaagacgtaatgaaggcaaagt

SEQ ID NO: 244269 - DNA, 442 bp, Homo sapiens
ttttttttggacaataaaggcctacttatctctttcgactgaagagagatagactgaagggaggcaaaattcaagtgaacactttatttcatgtaatacataataatacactcgaggcatttacgtgtattataaaataaaaaaagtttataaaataaaacgaacacttcgtttcatgtatataatgcaccttaagtgtattatatgcatttacatgtattataaaatcacctaactgcaagctagagaatccttaatatgtaatagtgagaatactaatgtctttcctcgagcgtttacagtatctaaaccttaaaatttaatttcgtgaagtccgttgtaagaagctgtgataaaagtttgagataatagaataggaaaactctaattaggctacaaaacaatgacacgtataaagcatctccttgtgtgaaagaaatga

SEQ ID NO: 244270 - DNA, 251 bp, Homo sapiens
aagtcacatcacactatctcaaagcccccgtttcctcacagaatggttgttttagagttatgtttgtaaattacctggcacatgtaggcatgtgacagactgtaaccaatgttactcaaggtcattttgcactgattcatactttgagccatttcctactgtagactctagcacacattttcaaggcagcttcctgataataaggctgtaggatatttttgggaaataaatccaaattggccattaaaacc

SEQ ID NO: 244271 - DNA, 575 bp, Homo sapiens
cattttatcaaatgctccactgtgtacatcaaagatcatggtatcatctatctctgggatgccatgtgagctttgcagttctggaagggcttcgagtcaagttttgattaattcttgatggttttatttgattatagaagtagagcttgaacgtgtgtgtgcgttttccctttttcttgtaagaactgacaatcttgattaaatttcccttttaggagtgggaagcaagaagcaaagtaattgtcaccacttcttggagaagaatggcttatagtgttttgaacatatcgtctcaaaataacctcttcggaagattagtggaaagaagcaaaactgtgaagaccttggttcacagtagctgttgatgtttctttttttcattttggtattgattataatcgcttcttcataaagctcagatgcagggtttatttccagttctttcaccgtgcttcttacctcagagtcaaaccattgctatactctccacatagttggtttccagtgtttaaattgcatgcgtgaggtgctcaggtttgtgacattgctttacatatattactgtaaaaaaaaaa

SEQ ID NO: 244272 - DNA, 469 bp, Homo sapiens
tgatagctgaagagcatgcttttaaggaagtctgaacgcccagcaactataccacacaaggaaattacacaaagattctgcagagacaacatggattccagaaaacaaattaatgataggatcatagactgagatgaaagaaagtgtagcagaattaagagaataatgtaaagaaacaatatcaccggccaggcatggtggctcacgcctgtaatcccagcactttgggaggccgaggcgggcggaccatgaggtcgggagatcgagaccatcctggctaacacggtgaaaccccatctctactaaaaatacaaaaaattagccaggcatggtggcgggtgcctgtggtcccagctactcgggaggcggaggcaggagaatggcgtgaacctgggaggcggagcttgcagtgagccgagctcgcgccactgcactccagcctgggcgacagagtgagactccatctcag

SEQ ID NO: 244273 - DNA, 325 bp, Homo sapiens
tcttcacccctatatccagtcattcatccaagtttggattctatctgcagaatgctccttggagccaggtctttctctccatcctcactgacacagccttagccctagtctttgtctctcttgcttagaccattgcagtagcctgctagctggtatcctgtctccagtctctccctccctgctgctactagagtaattcaccatctcccagccattttatttgttttttttttaagaaattgtttacttaaaaaaattctaatacatgtatgtggttccaaatacaatggaagaaagaacatagaataaaaagtaaatctttcat

SEQ ID NO: 244274 - DNA, 444 bp, Homo sapiens
atgattagtgacttaactctacccagtgtggcactagcgctggatttccaagaccacctgcaggttcaatgattcctgagagactcaagggactctacgtatagttatacttaacagttctgatttagtacaacagaagcaaaatcagcaaagggaagaattacatgggacaaattccacaggaaaccaggtggtgatgtccaagaggcctctcccagtggaatcacacagaacacacttcattcttccactgccaaattgtgcaatacgtataaaatgtcaccaatcagggaagctcattagaggtacccagtactcaaggtttttaccatgacatgctggtcatgtaggcaccctctgcctagcacataccaaaactctggaatcacagagggaaagctggtgttctgcataaagtatcttttttgtgtttgtttttttgaa

SEQ ID NO: 244275 - DNA, 394 bp, Homo sapiens
gacatacacatacttgtacaataatagttggaaacttctataccccactcacaataatggatagaagaatcaggtaaaattaggaaagtagaggacttggacaacacagtatgtgaactagatctaacaaacatacaaaaaactgcgcaacaacagaatgcacattttcccaaatgcacatgggacatttcctggatatatgttaagccacaaattaagttacaataaaatttaaaagaagaaaccatgcaaagtatcttttctgataacaacatatgaagttagaaatcaataacagatggaaaactgaaaaaaaatcacaaatatgtggattttaaactacacacttgtaaataaacaatggatcaaagaagaaatcacaaaagacttagag

SEQ ID NO: 244276 - DNA, 268 bp, Homo sapiens
ttgccttaccaccgaagatctgtgtcatctggtccccaaagaagcacagagactactacacaaaaaggggtaaatggacaccagaagagatccacaatttttagtccttatttacttcaatagttggtgtagaaacttccttgatttcagcagtctgggaggccaaagagggaggattgtttgaggccaggagttcaagaccagcctgcacaacattgtgagaccctatctctactaataaacagatacataaataataattttaaaa

SEQ ID NO: 244277 - DNA, 746 bp, Homo sapiens
gacttccttctgtggtgaagcagtaggaactctaatgaaggaaaaagtgagtttttggaattggaataaataaaggctttcccacaggaattgcctcattggattggagggaggggtttctggaactgctctggagagagaagggggaacgcattctggccggaagggttggatagctctctcagtggggcaggttagggagatcagggcttaaaagattcaccctgatgaggttttgctctttcaatgaggaagctagctgtaaacatatcaggtaccaagagaagtcctgagatgttgaacatcagttttgggggcccgcatgcaagagagaggaaggaaagatatagataggagccactcattcgctgcgatgcaagatgaccttaaaccttggtggaaaaaaaaaaaagccctaagtgtcaccttgcaaatgtttagaaataaaccaaataacaagatttcctgaggccttacccgctatttgacttaccagctacttgaaagaagcaggttgattgattgccctgcttacaaaaaagaaaaaaaaaaaaaggaaaagaggaaaagaaagaaaaagaaaaatctctgtttgcgtgattccaaagagcagttcagcaagcttacagttaaaaacacttggtcctcaaatgcaggttttattattattcaagtatggtgaggccaacagatcaggaggtggctggcattgaaaagtttgttaattatagttccccaaaggaggg

SEQ ID NO: 244278 - DNA, 429 bp, Homo sapiens
aggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttcttaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtac

SEQ ID NO: 244279 - DNA, 529 bp, Homo sapiens
atgacagtctgggaaggagctgggcctgagtgtgggtcaggaggctgggaagtgaccatgtggggtgaagggagttcttggaagaaccctgggttcctgaggctgcagctcaggacgtgggctcacctggcagaggtggcgtgtctggccccaggagctctcctgtgtccggcttcccctccacctgccccgccatgggtcatgcagagacaacagccttcctagtgctggcttttgattctctccatcccttctccccagcactgggtggcagtggtgcttggtctccagaggtctgggtgccgcccccacaggcttgcctgtaggggcacctcctctcccctgcccgcaggcccccgacagatgagagaggctccccacagggaggcttgtgtctgcctggtgctaccttggtcctgccctgtgcgttcacctcccagagtgacttctgggtgacactctgatagtgcagccataaaaccttataaaaggctttgctaaagtaaataagtcactccttgctattccc

SEQ ID NO: 244280 - DNA, 202 bp, Homo sapiens
aatgtcccctggagggcaaaattgtcccgttgagaccctctggcatggaaagatgagaaagagaataaagatgtaaaatatcctctgcaagaaaaactcttagctgagtgtggtggctcacgcctgtaatcccaccactgtgggaggctgaggtgggaggctcaggtgagtctcagtaacatagtgagaccttctctctaca

SEQ ID NO: 244281 - DNA, 279 bp, Homo sapiens
aacacttccccaaattgttttcaggaattctaaaattaggtgtttaattacaaaaatgaaaaagattttgaagagcaggaaaagcgtttgagaaagaaataaagcttcaaatcatagaatctaaaatttggaaatgatgttactctgtacctcctcatcattggagccatcactgtaaccctgtgtccctcagggcttgggcggggcttaagtgagtcctgtatgcaaagcagccagagccctacctcttagtatgtgctaaattaagtgttagtctca

SEQ ID NO: 244282 - DNA, 323 bp, Homo sapiens
taaacttttaaaaatactgcatttcctcccttcttcagattatccagataggacttaggttatttttatctcagacccaagggagaatgacctggataaagtactcctggacatctcccagtgattgaagttacatacatatatataggacatctgctcatagcccagcatgtaagattttggtattgaactttccagtctaagaatatccttcagatgagaacatgtagagagagagagaaaagaaaaagagagtatcttaagggcaggtagcagtgagatgcacagtaatgagtcagtatgtggtatcagaatttatctct

SEQ ID NO: 244283 - DNA, 307 bp, Homo sapiens
aatgggtgaaacaatttgctacccgaagccccaaaggctctgattaccggtcgccgctcccctgctggggcgcgaggtgcaaagactgtaccgaccgaggacccagaggctgtccccccggaggggaagtcctcagctgcacaggttggggggggggggggggggcgggcccaaccagtcacatgacgtcgagctccgccctgcctcctccatcccagcgctctacatctcggggggcctgaatttttacggatcccttgaatattaattttcttggattaaagaaataaaacataaattttcacaa

SEQ ID NO: 244284 - DNA, 805 bp, Homo sapiens
aagccccctgaagatcctgacgatctgggatgtgctggctacaccctgctccccgtcaaccaggagcgttactgaagttacagtaaaacaatgtcaggagactgacacaaaagcaaatcctttcaaagactgattttgaatcctgattgaagagatcaaaagagaatataagaagttagaactcatttctggggcaccacctcgatgaaaaagctgacaagttcctgctacccagagccctgcagttgccacagctcaatctcttctcaacctggtgcccagcttttcctgttgattctgcaactaggccagtcatcttttcaaaaattccttttctgcttgttgactatctctgctatttgcaaccagaagtatttagataaaatatttttaaaatgtatatgtcacctttttcctaattatgatgcaaacttatcgcagaaaactcgtaattctatacattagatacaactaatgttaacatcttagtgtttccttctactcttctattctaaatatatatacatatatacttctttaaaaatagttgagtaattagaagtagagtgactatatttatatcagacaaaagaagccttaagataaaaaaaattactagagacaaagagggacatttcataatgataaaaggttcacaattcaaacatgtaatttaaaaatttcatttgtaataccatcaaaagggatacaatactgaagaataaatttagggccaggcgcagtggctcacagctgtaatcccagcactctgggaggcctaggcaggtggatcacctgaggccag

SEQ ID NO: 244285 - DNA, 399 bp, Homo sapiens
aagccccctgaagatcctgacgatctgggatgtgctggctacaccctgctccccgtcaaccaggagcgttactgaagttacagtaaaacaatgtcaggagactgacacaaaagcaaatcctttcaaagactgattttgaatcctgattgaagagatcaaaagagaatataagaagttagaactcatttctggggcaccacctcgatgaaaaagctgacaagttcctgctacccagagccctgcagttgccacagctcaatctcttctcaacctggtgcccagcttttcctgttgattctgcaactaggccagtcatcttttcaaaaattccttttctgcttgttgactatctctgctatttgcaaccagaagtatttagataaaatatttttaaaatgt

SEQ ID NO: 244286 - DNA, 477 bp, Homo sapiens
ctggatgggtataacacacataggggtgacagttcccaaaggggatccatgttacccaggcaaagacctgctgtccagccattaatgcagacctgcctctccctccaaactgtgcaaaggaatgtactagttcttttcagctaccctagacaaaaactgctaaggctggtgatgctttattaaagaatcttgatttacacatactagaattatactactatacttaaatctaagttctagtggcctccagtaacagtgaaagagacctttaattaactaacacatttcccatttgccctgataatactctctggcagcacttgcagctatattttttactctgaggtcaactcagaggttacagtcttaatgttaccctgaaatgcttttcagagaattacatcaaaataggactgatgcagttgggacagcttggttgaacagaaagtcgaaaacagatatcaaatgatctgaaaa

SEQ ID NO: 244287 - DNA, 600 bp, Homo sapiens
ctactactactactaaattcgcggcccgtcgaccagctgattgtacccgggtacagcatcactccagcccacttagagcagaaacccagttttggaaacaacactgctcttgccccctgccccagctcactggagctggtgtctcccctcggcagccgttcactggggctttccccagtcctgccccctgggctctttcccttttgacactgcagtctggggttgtgtgtatctccgtctaagcatggtagggccagcaccctcaccagcgtggagacagccagggtccccgggtggcagatagccgcctcatgccctcatatgcgtctctcaggccgctaagcctgtactatgacttgatcaccgccactgtagtactttttaatttccttccttcagctcacacccaagaggggcctccagtcaatgtctgtagaagcactgaccattcctgcataattagaagctgaggcctagcacggtggcttatacctgtaatcccagcacattgggaggctgaggcaggaggatcgtttgaactcaggagctgaagaccagcctgggcaatgtagtgagaccccatttctacaaaaaataaaa

SEQ ID NO: 244288 - DNA, 312 bp, Homo sapiens
acttctaccaccataaccactcaatcatcaccgtgtgcccagagcagaggagcccacgatgctccctgcagtttcttccaggctctcgtactggtgatgggagaactggtgataagagtgggagtgagaacgggggaaggggccagtcccttccacagaactgggaagcccagaagtggtgtccatgtccctccatggactttctttctaccgtgttctcaccatttcatgcccagctcccttctcaccagccaggcgcccatggtggagaaaaacttaggatgtgtttaaagtcaaaaggcagttttgtgt

SEQ ID NO: 244289 - DNA, 673 bp, Homo sapiens
aaaattttatttaacaaaaaagaattaggaaccaaggtatccgagcagttttaaagtttgcaaaacatacttttaacataaagaaagcaacagctccctatttttcctaaacaaatatatctgatttcactttgttggtcctagctttcctaacaaacactgtctttgcatttctggtttttccacagaattggattttgaaaataaaactgttcttccctccttcttcctttcctctaatttctaccaaggtggctaacttccttatgtgcacaagagcctgcagttattagtgcgaacatattgtagccatgagcaacaatgctggggtagggtgaggcaaggcggggtgggggggcagcaaacattttcaaagcttatgtcaaaagtaggttctctgccaaaatgagtatggtcagtacattgattctaaatggcagcaacaaagaatacctagcacccctaaagaactatatgtggaaatactgcctgccagtttcttctaacacacggtcagttcagtgacagtcctactgaagcaatggattctagttttagtgggaaacttctctttatagatgcatttcagctcctgttgctgttttggcgactgcagtcctagaaacagaagagtcctctgtaatgtgattcagaagcaatgcgctgggttgtg

SEQ ID NO: 244290 - DNA, 375 bp, Homo sapiens
tgtttctctgggaaacctgatgaatgcagctgactttaaaacaggaagatatcctgaattatctgggtgagccctatgtaatcataagggtccttaaaagtgaaagagggtggtagaacagaaggtcatagtgatgtgacataaggatttgactagctgttgctggccttgaagatggaggaaggggtcacaagcaaaagaattcaggcagcctctagaaactggaaagaaaatagattctcccccagggcttccagaaagaaatacaaccatactgatccttttcagccctcccatcccttaagcacgggaaccacctcacgcaggccccacgtgccaatagtaatcaagcaatgtcactttgttaaaagataa

SEQ ID NO: 244291 - DNA, 412 bp, Homo sapiens
tgtttctctgggaaacctgatgaatgcagctgactttaaaacaggaagatatcctgaattatctgggtgagccctatgtaatcataagggtccttaaaagtgaaagagggtggtagaacagaaggtcatagtgatgtgacataaggatttgactagctgttgctggccttgaagatggaggaaggggtcacaagcaaaagaattcaggcagcctctagaaactggaaagaaaatagattctcccccagggcttccagaaagaaatacaaccatactgatccttttgcagttcatgagcatgatgattgggtattcgtgcacatgtgtgagatgtgccaccctcgaaccttgttatgacatcggcacattgctcatctaacaggaagaaaaataaataaataaaaagaaatac

SEQ ID NO: 244292 - DNA, 502 bp, Homo sapiens
actgcaaaaaaagatgtttgacagctggtgaggaatggaagacttagatgggaggttcagttactagacagcagagctgaacttagagctgaaaatgtaaatgaatggagtcaatcaacactgggctttagccaattgtttccatgtgtaaatctgggtctgaagattttcaatggaagtcagaaatatggatttttatgtaaaacatcaagtttttttttcttttccacagccacagacttataactcatgtaagctgtttctcaaatatctgcccagtggtgctggtgagagcccgatgaaaatgcacaaagagtgacacaacctggccaccactaagaagtaaagagctcagtgatttctcatctattctttcacagctacacaccaatgaaaacaaacacccgaaaccgtcttctgtggcatttgtcagttgaaaaagaacaccttagacttaacttttaaaatgtctgtaataaaaatataattccattttcttttc

SEQ ID NO: 244293 - DNA, 364 bp, Homo sapiens
cagtttcgctctatcactcaggctggagtgcagcgtcgtgatctcggcttactgcacctccacctccagggttcaagcaattctcctgcctcagcctcccaagtagctgggtttacaggcctaagtcaccatgcccgactcagttttgtatttttaatagagatggggtttcaccatgttggccaggctggtctcaaactcctgacctcaagtgatccgcccgccttagcctcccaaagtgctgggattacaggcgtgagccactctccccagctgatgttaatttttaaaaaatgcattctattaaaagggctaatttttactgcatgataattttttaaataaatatttaaaagacaaggat

SEQ ID NO: 244294 - DNA, 411 bp, Homo sapiens
gagcagtacaccttccacaatatgccagaaaaaaacacacttgtggttacactggcctctggagcctcaaaaagctgaagaagcccagagagatttgcttaaaagcactatttgaagtccttggtaaaaaatgcaacctaaggacaattgtatttctacattgaaaggcttttaaaactactttaaattggaaggtcagagcttcaaagagcataatgactggctgtttatctccattaccctctgcttctggtgcttctgtgaacatgttctgacctcaaactgtgagtggaaatgcaggaaggatgctgtctgtgcattagtgagagccttgaaacttgcctagagcacttctgaaactctgccaagatgaaataaatagcatatagcctcccttcaaatctcaacttg

SEQ ID NO: 244295 - DNA, 440 bp, Homo sapiens
cccgcacctcctgtagcaaagccgaatcgtagtcgcgctggctcagcatctcctcctttcctgctcaaagagatgccggctccggtcacccagtggcggcaggggcaggggtgcgcggcgggctgcgtgaccatgaagcctcatctgctaaggtggcgatcgcaccggcctagctcgtcctagggatttgctctgcggcgtcggtgtaataacgtaggtgaaagtcctcttccgtggcgtgatccgcaaatgacatcagcgtcccctgagcgagctacgtccagggggcccttggtacagttttagcataatttgaccttaaaatagctctcaacgattctgtaacccccatgagcccctgacccggcctcctttgttcactacagaaatcctcgacagaacaatgaatggatgtttctatccagagtaaaatatttgac

SEQ ID NO: 244296 - DNA, 459 bp, Homo sapiens
gaataatgccacagccactcagaaacgcgttggaaaggagagcaagtcctggagcctcccttccacagccactgggaaatgattctgataggtgacgtttttccagttcccactgtggtccaatccccacagagaagctgggaacatggggctggcatggccaggggagggtctcagggtagcctgcccattttactgatatgtttctgtaacagaatccttgtagtgggaagtcagccattcccagcacaggctgggcactgcactggcatagcagggtcacctgtggggtggtggcgtggactgaaatctctctacaaacatccagtgtgagctgcgctccaaacatttcatgtgatgatggcctgtgttcgttctctctctctctttccctcttttgagttatgtgtgtgtgtgtgtgtgtgtgtgtgtgtgtatgtatttgtgttggggtgggca

SEQ ID NO: 244297 - DNA, 422 bp, Homo sapiens
tgagtgagactctaaggtagccactaggcagtccccttcctagtgacttattatatcctgatctgggaaatgttgaacatagagagggcacaggtggtgaaactggtctcagagaagttgagaaaacatgggttcaagaacgcaggtgggaggctgggtgcagtggctcacgcctgcaatcccagcactttgggaggccgaggtgggcagatcacctgaggtcaggagttcgagaccagcctggctaacatggtgaaaccccatttctattaaaaatacaataaattagccaggcgtggtggcacatgcctgtaatcccagctactcaggaggctgaggcaggagaattgcttgaacccaggaagcagaggttgcagtgagccgagattgcgtcattgcactccagcttgggcaacaagagt

SEQ ID NO: 244298 - DNA, 435 bp, Homo sapiens
ggccaggcgcagtggcttaggtgaaggccacaccagacttgggcctacgtcttggccttccaggtcagcagagtggcctgggacttggatgccttggggtcacggagttaactgcagactcagactaagtggggccccagcagcggtcagccccagaaccaagttccggagccaacacccgaacaggaaggggccttgccccaggccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaatcccatcagccgaggtgaggcacctgttaccccggccttcctcacccccgcggcctctcctccattacaccgcggccg

SEQ ID NO: 244299 - DNA, 599 bp, Homo sapiens
tcttatccagtaaatatttgtttaatgaatgaatgattatatatttaacactagaagacgtttacatcagactgcaaaatgaaagttaaaacacagaatgtacgatgagatccctttctgcccacacactcatacaaacgtctatacaggcttaaaaaaaggcctgaaaacactaaaacgtaacagtggttagattatggaaacgttttttctccttgtactttctgaattaaaaatattcagaatatgcatatattacttccataataaaggagaaaagttatattaaaaaccaaataatcatacaaaattaaaaagtatacaaatacttttaatgactcccaattatctagaatacatggctcagcatggatctctcagggtccccaatctttagattcaacaatcatgtcacggttctccagtcttttcctcttctacctttagctgccaaattaatcctcctaaaacaccgtgagtttcttgtaatcactactttcaataattccccattttctatgtaaaaaagtagaaattcccaagcctggcactcaaggccttccacaatgatggcattcaatcatcctttcactttatta

SEQ ID NO: 244300 - DNA, 235 bp, Homo sapiens
caaggccaggagattgagaccatcctggcgaacacagtgaaaccccgtctctactaaaaataaaaaaaaattagccgggtgtggtggtgggtgcctgtagtcccagctactcgggaggctgaggctggaggatggtgtgaacccgggaggcggagcttgcagtgagccgagattgcgccactgcactccagtctctcaaataaataaattaattaattaattaattaaattaaat

SEQ ID NO: 244301 - DNA, 230 bp, Homo sapiens
caggcagcacctggttggctacagcagccaagagactcaaggcatcatacacagcacagcttaatatgattgctttgacggaggctcaaaaagaagtagatcaaaagcaatagaatgggtcaaccagccagggccttagcctggtagatttgtgtattatcctctgtgctctcatcttgtgtatttagtataatgaaagcaaataaagttaactatttaataaaacaatt

SEQ ID NO: 244302 - DNA, 1270 bp, Homo sapiens
ttaggccctagttcctccacttctcagccaggtaccctgcactttttgcagtagcctccttgcctggagcctaaggctaatttgctgatctgccaaccactgtctattctttctcctggtgtatctataagattctattagataaagacattagtacattgatttacgctattaaaaattatttctagccaggcactgtggcatgtccctatagtcccagctacttgggaggcagaggtgggaggatcacttgaggatagcaagactccgtctctacaaaaataaaaaaattggccaggcatggtcccagctatgtagaggctgaggtggatcacttgagcccaggagttagaggctgtagtgcacaatgaatgcacctgtgaatagccactgcactccagcctgggcaacatagatcctctctcttttaaaaagaaaaattatcttatccctcccttttccttgaaatcagagtccattccacactaactcaatgattctttttttttttcctttaattttttgtagaggtgggggtcttgctgtcttgcctaggctggtcttgaactcctggcctcaagccatcctcctgcctcgacctcctcaagtgttgggattgcaggtgtgagccattgcacccagccctgattcttttttaaaaaagctttattgaaatgcaatttaccataaaatttacccacgtaaggtgtaagatttaatggtttttgtgtatttacagaattgtacaaccatcaccagaatcaattttagaacattttcaccaaccccaaaagaaaatctactgtttagatatcaccctccaatcctccccaacccctggctagcactaatctgctgtttctctatatatttgcccattttggatatttcacagaaatgggatcataataatatgtggtcttttgtgactggcatcttccagttagtataatgttttccggtttcatctatatagcagcacacagcagtacttcattctttttcttttttaaaattgaagtaaaattcatataaaattcaccattttaaagtgtataatttagtggccgttagtacattcacaacgttgtacaattatcatcattatcaattccagaatgttttcattaccccaaaaagaaaccctgtacccttaagcagtcattccttctcttctcccccttaactcctggtaccactaatttgttttctgtctctatagatttgcctgttctggacatttcatataaatgggctcatacagtagtgc

SEQ ID NO: 244303 - DNA, 490 bp, Homo sapiens
ctgctaccccagcatcatccacaccagaggagcctgccaagcaggacctcacagctctttcagggaaagcacactttgtaagcaagataacatctagtaaaccttctgctgttgccagtgaaaaatttaaagaacaagttgatcttgcaaaaaccatgaccaatttatcaccaaccattcttggcaatgcagttcagttgatctcttcagtccccaaagggaaactgccaatcccaccctactcaagaatgaagacaatggaggtttacaaaatcaaatcagatgctaacattgcaggtttttctttaccaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagc

SEQ ID NO: 244304 - DNA, 556 bp, Homo sapiens
gctggagcactgctgcagaaagtgatctcttactcatacttcaagacacagcctaagtatgaccacctgtatggacccttccctaatgcccaggatcaagaaaagaatgtggccaccttccaaggctcagagtagctgtgcaatgacttgtgtcaaaacccgatccagagcagcagtgatgaaatcaccctctcctttaagacctggcattacaatggcctcatcctgcatgtgggcaagtcagctctctgatggatggtgcaatttccttggtcattaacctgaggtctggggcctttaaagctattgaggagccagtgaatggagaattcgacaacgcctggcatgattgagggtgacacatcacggcagatgatggctgaggagacattgcccagaagtctcatcttaggtggttgagtaggaagtttgtgaagcaggtggtgggtgagatggagtgggtagagattcaggtatggagatgtcagtgtctaactttcttctagtctttgcaatttcacaaggaaaatcactaaaatgtgcgtctcttcattta

SEQ ID NO: 244305 - DNA, 1598 bp, Homo sapiens
gcacccagcaccatgcccggctaatgttttgtatttttagtagagacggggtttcaccatgttggccaggctgatctcgaacacttgacctcaggtgatgacctgcctcggcctcccaaagtgctgggattacaggtgtgtgccaccatacctggcctgggctagtttaaataagcgtattggcccacttaattggcttacttgcccatctattatatttaaatgctccgttaattgatttgatagactacctttcatttttttagacttgacacttccctaacccattgggctccagatttagaaataactatataaccttttttttgtattctcgggatttgattgatttgtcaatttttaaattttactcttgtcaacttgcaaaaacattttaaaatgtattacagcaatacactgcagaaattttaagaaatgtatataaccccagaaggaaacttaagtcaacattatggtaatctcttttcagattttgctgtttataaatgggtctactattatactgtactgtggtatgataccaatctggaactgttaatatttgaacatatttccatattaatatacaaatctacattaacataagtggctgcaataggattctatcatgtgactcatgatactggcctctctgacccccagggttccacccaagaatgtagtacattgaaaggtaaaaataagtttccttggccagttgttgaacttaataaatctgtgtttaccccttagtgggcccatgcctaaggtttatactttgaggtgttcttgataccaatagcatacagagtaagtcttaacgttgttgataggttcttggaaactgggacttctagcagaatgacctcaaataatgtcatgcaggtcctcaaataatgtcatgtcactgtaacacagctgaggggaaaaaaattggtcttgttatgtgcatttcatttaaagcaatttccaagaacctatcaacaatggactgtaagtgagaacttgaaattaatgccctaactatatagcaagtgaaggcatttgtgctgtgcctactcttactctgtattcaggaaaacctagctgagtttaattgcttccctagcataacaagttattttgcctcaatacacgattaaagacagattgtttaattttgtcagtgtatgatactgatagcgctttaagtccttatttaagaggtacgtactgaagtatttgtgggttaatggatatagttggagtttgcttgaaagtgtatgtggggggcatgcgtaggggtgtaatacatgaaatattagtcatgagttagtaactgctgaagccaaattggatggatatgtaggaattcattgtactgttggctctgtttatacaggattaatattttccatacgtaaaggtgaaacatgattgctctgttaggtaaccagagtgatcttgggaaataatcaggagataactgctttggtgtaatactctacaaacacaggttttcttacatgagttatgttctaagagacgttgcccaaacccttactgaactaaaatatgtgggtcagaggtgaggggcacgaagtctcagtttaaaaaaa

SEQ ID NO: 244306 - DNA, 1470 bp, Homo sapiens
ctcaaactcttgacctcaaatgatctgcctgccttggcctcctaaaatgctgggattacaggtgtgtgccaccatacctggcctgggctagtttaaataagcgtattggcccacttaattggcttacttgcccatctattatatttaaatgctccgttaattgatttgatagactacctttcatttttttagacttgacacttccctaacccattgggctccagatttagaaataactatataaccttttttttgtattctcgggatttgattgatttgtcaatttttaaattttactcttgtcaacttgcaaaaacattttaaaggaaacttaagtcaacattatggtaatctcttttcagattttgctgtttataaatgggtctactattatactgtactgtggtatgataccaatctggaactgttaatatttgaacatatttccatattaatatacaaatctacattaacataagtggctgcaataggattctatcatgtgactcatgatactggcctctctgacccccagggttccacccaagaatgtagtacattgaaaggtaaaaataagtttccttggccagttgttgaacttaataaatctgtgtttaccccttagtgggcccatgcctaaggtttatactttgaggtgttcttgataccaatagcatacagagtaagtcttaacgttgttgataggttcttggaaactgggacttctagcagaatgacctcaaataatgtcatgcaggtcctcaaataatgtcatgtcactgtaacacagctgaggggaaaaaaattggtcttgttatgtgcatttcatttaaagcaatttccaagaacctatcaacaatggactgtaagtgagaacttgaaattaatgccctaactatatagcaagtgaaggcatttgtgctgtgcctactcttactctgtattcaggaaaacctagctgagtttaattgcttccctagcataacaagttattttgcctcaatacacgattaaagacagattgtttaattttgtcagtgtatgatactgatagcgctttaagtccttatttaagaggtacgtactgaagtatttgtgggttaatggatatagttggagtttgcttgaaagtgtatgtggggggcatgcgtaggggtgtaatacatgaaatattagtcatgagttagtaactgctgaagccaaattggatggatatgtaggaattcattgtactgttggctctgtttatacaggattaatattttccatacgtaaaggtgaaacatgattgctctgttaggtaaccagagtgatcttgggaaataatcaggagataactgctttggtgtaatactctacaaacacaggttttcttacatgagttatgttctaagagacgttgcccaaacccttactgaactaaaatatgtgggtcagaggtgaggggcacgaagtctcagtttaaaaaaa

SEQ ID NO: 244307 - DNA, 335 bp, Homo sapiens
taacatgatctagcctaggttgtcagattcttcatcaatctcagaaaagataataaaaaagaagacatcaagttcatgtttggctatagggagagcaagtaactttcagggaaaaaaaaaattataccagtacatcagggcagggctcaagaccttacagtggaagagttatgctctccataaacaatatgaccttccaggagagaagaaagaatagcgatgacgactgaagacatcaattcttcaaatagatacttcgtgtctgtagaacgcaggtctcctatttcctagtttgtgtttcttccaataaactccttgaaagctcactatttccc

SEQ ID NO: 244308 - DNA, 637 bp, Homo sapiens
tggactctcatgggttttgccaaaagtacaggttcaaattccattgctttgaaatgcaacatgtttgtgactcagtattgctcttttctgatttttctttccctcacttctcatctccatgctttgttcaaagccaaaacctgagtgctaagtgaggaagctcaactattttctcgcaatggaggggagggggttacattctgctcccctattcgagtcaggtctggaaattccacatgaaagctaaacaggtcctttcggacccatgaaacatgccccttctgtgtgttcctgggctgagcactcacagggacaggacggaaggatgccctgggcctggggtttaacaggtggctaagagcccgaggggataccagctttaactcttccctccctattctgcagaaaggacacttacaagccaaggttcattactcatctacttaaatatgtcaccactgtccttactggaaacattgtctttcttaatcagttattatgtattagcaaaaaactgtggacaggcattatgaggaagagtctggcttatgtcacctatttccatagagtccacatgagtggtgtagacccctgattctcccattttatcctgtaccagaattccctgaggagtctg

SEQ ID NO: 244309 - DNA, 517 bp, Homo sapiens
gatgagtgaataaacttgtccttaagccgtaaatctgctgagtggatgtattccgtaaactaaaccatagatagcatcagatgctgtttgaatctgaaattatgtgtgtcatctcaacatgcaactagatagtagattcactgccatatccctgctctttctttccctttacagttttatactgggtctatttcagagacctaatggtggtaaataaatagtaaactctcagtgttacagctcatggttttccttccctgtagaacttgtaaacaaaaggaaaatggcaaggatctattgaagggcgaagttactgttaagatctactgtgctgtgtcaaatgtgtagcactccacagtgattaaacaggatgacaattatttttagctcagatttgttcacagcactccatagaagcaaaagttgcttttctccattgtcttccaaaacgcttagcacaaaagtcgcattctagtggagaaacaaactgtaattttcttacttgaagtagaaaaaa

SEQ ID NO: 244310 - DNA, 400 bp, Homo sapiens
ccccccacaaaaaaagaaaagagtgttagtgataagatgcatgtttttgtttatcttatgtatgtgaatgttatatttatatggctgtttgcccatagaaaataagtgtcggctgggcatggtggcttatgcctgtaatcccagccctttgggaggccgaggcgggcagatcacttgaggttaggagtttgagaccagcctggccaacatggtgaaaccctgtctctgctaaaaatacaaaaattatctgggtatggtggcgtgtgcctgtaatcccagctactcaggagactgaggcaggagaatcgcttgaactggggaggtggaggttgcagtgagccgatattgtaccactgcactccagtctgggtgacagagtaagactctgtctcaaaaaaaa

SEQ ID NO: 244311 - DNA, 310 bp, Homo sapiens
aacaggctctgaagaaaaatgacatttcagggaattaagagcacgtgttcctccctctaccttctctttcttcccccagtgaccttggaggctacttgttgataagttggttgaatctgaagagcccttggatacggaaggctgactgtgtatggctactctgaagaatgcaagaaacagtgtgtgatacgcttagggcttagcacattttgccatctatggagcatgtggtatgagtcagaaatggtgtttttgcccaattcagagactagtgcagaagacagacaaagaaaaagacaactcaggtcta

SEQ ID NO: 244312 - DNA, 4366 bp, Homo sapiens
cggctcccccaacgtcgtttttctgaaaataaaatactctgagccgaacgtttcgaagaaggaaagtccgcccttaagagagagacagagtcttgtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggacatgctaggagatttgtttactcccatagagacaccagaagctcaaaacagaggctttctcaagggactgtttggtggaagcggacaaacatttgacagagaagagctctttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggttaaaatcccaaaatacggctgaatttgccttttcccatgtggaatggagctatcatcttggcatgtcattcgataaggatttatatttagtaactacggggagtcctcttgatttgaaaattcctgtacaaacaaaagcattaatgcacttaatgaaaaaaaatctttgcatgataaattaacatcttaaggggaaaagaaaaaaaagcatgttgtgatagaagaaaaaaagattcatggtaaactatttctatcaattgggccacactcaacaatttaaaaaatctgcatttgaagatgtcagtgcatttcaaatatatttgccatacccaactgaaacggaaaacaaaacaaaacaagaacccagagttttctcctcatctgtaactttcattgtactagaaccttattgaattcttatggcaagagtctgattaatgttctctctccatgttttacatcattcacagttgtgtcaaaatcaaatattgccagtatagtaaattattcccaacac

SEQ ID NO: 244313 - DNA, 427 bp, Homo sapiens
gacatgctaggagatttgtttactcccatagagacaccagaagctcaaaacagaggctttctcaagggactgtttggtggaagcggacaaacatttgacagagaagagctctgtgagtaaattcctgattatagaaatgtattgcaaaatagaagacgtttctgtgtatgtgtatttgtgtgtgtaacttaatgtaatatgtgatctcaaattctagactacgtattttttgcatctatcttaaagtttgaatatttgtttccttctgtaccataaaaatcatttccatttaccaacatggaaagtggtcacttcatattaggaaattgtttaacaaaagtgatacatataattcatacaaataatgagcaagctaataaatatctcatttgcaagtagatcatacctgcatggcaatgtgaaggta

SEQ ID NO: 244314 - DNA, 4386 bp, Homo sapiens
acctcggagagcgccaggcgccgcgaccagagggcccagagaagcggccggagcccgcctacctcggccccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggacatgctaggagatttgtttactcccatagagacaccagaagctcaaaacagaggctttctcaagggactgtttggtggaagcggacaaacatttgacagagaagagctctttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggttaaaatcccaaaatacggctgaatttgccttttcccatgtggaatggagctatcatcttggcatgtcattcgataaggatttatatttagtaactacggggagtcctcttgatttgaaaattcctgtacaaacaaaagcattaatgcacttaatgaaaaaaaatctttgcatgataaattaacatcttaaggggaaaagaaaaaaaagcatgttgtgatagaagaaaaaaagattcatggtaaactatttctatcaattgggccacactcaacaatttaaaaaatctgcatttgaagatgtcagtgcatttcaaatatatttgccatacccaactgaaacggaaaacaaaacaaaacaagaacccagagttttctcctcatctgtaactttcattgtactagaaccttattgaattcttatggcaagagtctgattaatgttctctctccatgttttacatcattcacagttgtgtcaaaatcaaatattgccagtatagtaaattattcccaacac

SEQ ID NO: 244315 - DNA, 382 bp, Homo sapiens
aaagggagattgacaatgggggcccattgtcaaattgaggatcacggattactttcatcactgctcttttctttaatctcgaactgtttctgttttttatgaccttgacatttttaaagggtataggcctgtttcatagaatgtctcaatctccagatattttagatgacctgctttcaatatttagacaacaaaatttaaaatgtctaatgtatgttaaaaattgggttttacacacttatttgtgagagaaaaggtatgcttccctgggtgaaattaattggtgatagttcgtcctttcagtgaattagtttctggagaatatttttttctttttctctttttttttttttggtgggggggttgttgttgttgttgtttt

SEQ ID NO: 244316 - DNA, 344 bp, Homo sapiens
gcaagcagccagggtccaaaacaaagaacagtctgattctacaaacaagcctttggactaacagtatttggaaaagagactattacttcctcatagttgtaggaaaagagtgaaaaatagaaataattacaaacacacacacacacaacacacacacacattaagaatttattttctttctttcttttcctttttttttttttttgagacggagttttgctcttgttgcccaggctggaatgcaatggcacgctctcggctcactgcaaacctccgcctcccatgttcaagcaattctacctcaacctcctgagtagctgcgattacaggcgcctgccgccatg

SEQ ID NO: 244317 - DNA, 238 bp, Homo sapiens
gcaccccccatctcccataccctgtctcacactgtccacttttgtcttcatagtatggatgactgctatctgaaatgaggtattttgcctacttgaaattatgtttcaacttgttagctgtcttctcccaccataatgtaagcctcacaggagtaaggactgtatctgtcttgttactatttgtcctcccagtgttcgacacatagtaggtgctcaataaatatctactagtgagtgt

SEQ ID NO: 244318 - DNA, 368 bp, Homo sapiens
gtaagtgcacactgtggttccggatccgccaggtttcccaagtgtcttccgtcccttgcacagatctgaggaccgattgtgcccaaggaaaggagggacccactttgccctcggagctccttccagtctcaaggagagagaggggcagactcacacacgatgcacattccagctgagctgctggagggagtcaaaagaaactcgaaggctggagcatgtggagatgctggctatgctgatttaatgactgtcactcttgagagcacagtgactggaaacccttggcgcagttagagagacagagtccacactgacaggagagcagcagaatggacgcccgtttgctctgacagcactcagtgcggccg

SEQ ID NO: 244319 - DNA, 364 bp, Homo sapiens
gaggagatggaaagggagaagggcactgcctccctcttcccccaggaaaggcaacatcgtggggaaaatcgatcttagaacctgggttccattttgggggaggaggtgtcccttcagctcagaatccactgaaccaggtgctgggctaagcccttggcacaaatcatctcattttaccctcccaagagtcctgtgaaatttgtagtattcgaggctgagtatggtggttcatacttgtagtcccagctactcatgaggctgagtcgggaggatcacttgggcccaggagttcaaggctgcagtgagctgtgaattcaccactgcgctccagcctgggcaatagagcaagaccctgtctcaaaaa

SEQ ID NO: 244320 - DNA, 484 bp, Homo sapiens
gcgtgacttcagtcagttcctctcctctccaggcctcagctgccctgtctgtgagtgtgactgcatctcttccttcgtggggctgcagtgaggagtgatcggttagggcccatcaacccacacacagctggcacttgctggtcatgttctacctgcatcagccaccttgaagctgcagttgcgtggactcaggggctcctctccgggactcacctgatgcccatcccagcaccaccctcgcgcttcacacacctgaccagcctagcattgccctcacactattatttaccctggcacccaggacctggtgtgttggctggcacagagctggccctgcctcttgcctgcttcttgtctgccccaagaaccccagcttatatccaccctgcctgtcaccggccggcacccctccctccgcacctgagcctgcctgtcaccggccggcaccccctccctccgcacctgagcctgcctgtcaccaacc

SEQ ID NO: 244321 - DNA, 395 bp, Homo sapiens
ctctcagcacacacttccttccctgacagtttgtcgcctagcagctattttggcttcccaagggaaatcttgtcctttgcccttgtggggcttactgcaaatcaactcatcatgaggaagattaatcagagaaaagacatacaattttttttttttaaactgtgagcatgaagagaatcacagagtgtatactcaatctcccaatgggggcaaaatacttctgtaacctcctttcaggtggcgagaggggacatgggaatgtaggtaattctgttgagcggtaataagtgatgactaggaagattgaatggatacttgggagaatgaatagggggaggaaacagagattgacttattaatggttccctttggaaattaaatactccttggagacc

SEQ ID NO: 244322 - DNA, 477 bp, Homo sapiens
gctcttcccagagaaggtagtagatgaataataagatgctagtttcctaaggggaacaaagatttttacatctgtgtgcaagtaggatatcaaagtgcaaacccacccctctttgagagaagtagtagttgggagtgaagtaatggaacctctggcttgttattcaatataatctgccagatgatgaaagtacactttagtatacctgactccaatgattttagtaatcatttaacaattgtacaataggatatgacttctgtttcatgttggtgagaaggatagaatgctatttcttgatccaggataacataattcaagataacagaataacatggagaaaacatttcgtgtgttacaaattagaaaaagggaggaaaagttttatgtaaataatatgaaaggtaaagatttcagagatagttctttatatatttgagggtaaaataccttcttaatgtacacacaaaaaagcaa

SEQ ID NO: 244323 - DNA, 543 bp, Homo sapiens
aaatagcgtatttttttcaatgagctattcctattctattgcatgtgcttcttttctcacttagctgaaaataaagccacagcctttcagctacagagtcaatgcaaggaagggcgttaactgcttggaggtgattattacgggtggtgacttagattgtttataaaagaagggcaaagaatgaattgacttctcaaaatatttatgttttcattcaatgatttcattttgtgcttaacatgcaagtgcttagaagagccagatttgtttattcgttactaactagctgtcagatttttagacaaatgttttactgtttctagttcttatcttcctcctttgtaaaatgaaaggatggtactaaggtatctctaatgtcccttttaggtttatctgtcattgtgtgatattttaaaatctttaaattaactggtttatggataaaacagaggacatttttatttgaatcttcaatatatttaaagtgctgttatatctaaagttcataaatacctaatgtaataaagaagtcatattttgtca

SEQ ID NO: 244324 - DNA, 385 bp, Homo sapiens
attatggccgggggaaggtctcgaatcctgaagacagacttcgaggggatgatgcagcaagaagacccacaccagatgagggcgccttgatattggatttcccagcctccagaactcaaataaaaatgcagtctggattttaagggccacacagcagcaagaactaaaacctgggtctccaaggtccaagtccaggacttctctatgacaccctactgcagccctttgctggataccatacaaagcaaattgagcagatgtgttctctgccctctgaaagtttggactcaaatggacagccacaattctggcaaacatttctgttttcatcattagtgcctgtcctccctgctagctcatgggctcccccagagcaggcatgttt

SEQ ID NO: 244325 - DNA, 464 bp, Homo sapiens
cagctaaataattcaacatcaacattcatcttgttaaagcaaaattaaagtggagagtgggcctgaaaatgttctgagcaaacaaaaccaaccaactaggcattaaaaatagctttaatgttgcttaaattcaaaacataagcaaaacttaacttgggttatttctggtaaactaatttaacttgagtcatttctgtctttcttagacagaaacaaaacctaatctcagtcattcataagcagccaatcaacatatgattatgtgactatgaactttccagcaaggtaaagagaaaaggtaaattcataacagcaaccaatcaaataatttttaaattctgcttctgcattcatcctatagatacttgcctctgatgctttgtcatcagcgtgctgaacctcttttggtttgtgtgtttaccaattcatgaattgcttgttactcaaataaacttgaaaatttt

SEQ ID NO: 244326 - DNA, 576 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (433)..(433): n is a, c, g, or t
cnangcnccatcttgtaccacttgtcgtggagcaggtcgatgaagccggaggacttgtagcggctgatgaactcggacaggttggaggaggtccccagagaccccggcgccccgcctcgcccaggtgcctctcaccctcaatggcgaagggctttcccacggtcagcagtttgcagtcggcgtcgatggagacctcgtagtccaggagcgacttgtccatgatgaaggcgttgagcttgggggggtcgctcctgctggggccgggggcgggggtcagccatcgccccgcccaccccacgccccgcccccgcctcaccccgcgcccgggctcacgtgagcatggcgacgccgcggggcgtggtgggcgcgctgtggcgccgcatgtgtgcgtgcatgtcggggaagctcttcttgatgtacgcctcggcgctgntctcccacacggtgccgaagcggaagccctgcgccgggtggtgcagctgcgcgggggaccccgtcagcgcctctgctgcccctcaggacccctgaccattgaggggcgcgccgttctccggggtggggccgtcctgggcactg

SEQ ID NO: 244327 - DNA, 339 bp, Homo sapiens
aggagacggggtttcaccatgttgcccaggtgggtcttggaactcctggcctcaagtgatccacccacctcagccccccaaagtactgggattacaggcgtgggccaccatacccagctggatggcatctgcattttaaacaaggcccctggtgactccagcctcaggttgtctagttttttcaaatgctgcagcgggtgcagaggggcaggaggcgccagcacagggattcctcctgctttgcagccgtgcagtgggactctggaagccacgccatattatccgggaggctccggtgctattgcctcttgttctgtgacactcttgggtgtaaaattg

SEQ ID NO: 244328 - DNA, 206 bp, Homo sapiens
agtccattgttctttccactagatgtccatggacttcaatatcagaagcccccagattaagatgatctggctcctatgtaaactttatcttagccgggcgcggtggctcaagcctgtaatcccagcactttggaaggccaaggcgggtggatcacgaggtcaggagaccgagaccatccctaacacggtgaaaccccgtctctact

SEQ ID NO: 244329 - DNA, 483 bp, Homo sapiens
tgcactgactagggcagattttcaaaccagtcctagctctagcaaggctggcctggggttctgtggggttggtggggaagaggcaccctccagctatcccagccaccctcaggtgatccttctccagccctcctagggaagcctcttttaaaatgaggctgggctggccgggcgtggtggctcacgcctgtaatcccagcactttgggaggccgaggcgggcagatcaccgtgtcaggagtttgagaccagcctggtgaacatggtgaaaccccatctctactaaaaatacaaaaattagctgggcgtggtggcaggtgcctgtaaccccagctactagggaggatgaggcaggagaatcgcttgaacccgggaggcggaggttgcagtgagccgagattgcgccattgcactccagcatgtgtgacagggtgagactccatctcaaaaataaataaataaataaataaataaataaataaat

SEQ ID NO: 244330 - DNA, 211 bp, Homo sapiens
gatggtagttgtttcctctcaacggagctaaaaattaacttcatcctatggcatgatgtattaaaatcaggagtgtttggcccggcgtggtggctcacgcgtgtaatcccagcactttgggaggccgaggtgggcggctcacgaggtcaggatatcacgaccatcctggctaacacggtgaaaccccgtctctactaagaatacaaaaaaa

SEQ ID NO: 244331 - DNA, 1276 bp, Homo sapiens
acctaggtggttgtgggctagacctgtggccttcactgggttcttgactcattcctggagtgtgagggttttgttcttttttaactggaggtggcagatgactgtccttctggacttcctatatgctcacctgacccctgcgggacctgagatcattggggttcccaggtctttatggtatcacgcccccattgtgacaacaagaaggatgaccaaaagtatgccggtggttgaggaagataaaaaagaggagtggagttgcagggaggaggctcgacaagatcacctccagcctggggcagctggattggcgagtcaggggctggctcctgcctgggcaagacaataagccatgatgaacaatgccattatcctccttttcattgggggtacctgggcatatctgaaaaccttgaaaaagtgtttgcattttcagagcttaagaaaaggaagaagcagcagctacagtgggtttttcatgccttctagtggcattgaagaacctgcactgaatgccacctggaaaacagcctggacctgcacctttgggccggggcacccatgggagctcagcccttgccgcctcaaccctttttggattcttttctccccagactgtcccagagttcaggtcttctcgtctcttgtctgcccagtgaaggtacaagggtggaaaggtgagggtgtggagtcaggagctttgttccactgctgggcatagtgagaagtcaaaagagaggttatgatctcattgtgcttgaaggggagaggccaaagcctaagacattctgcctttttaggggaattacctttcaaggcttatttggtcttcactagcctttacatctgaggatgaaggagttgaggctctgttacatggatgtctaaagagatcataactctcacattgaatgacacagagactgatagctctagcacagtacctaggtaatgtgactctcttttgctacgtgtgcccttcctacataaggaaatgtgacataccactgggccaagcacccaggaaatgtgactctcccgcctgtgccctgcctgtattgggcaatgttgtgacacatctcagagctgagcacctaggtgatgtaactccttttttgggagctgtcaatggaagggattgtgacatatgtttggccaatcacccagatgatgtgactctcttgcctataactcaaattggggagaaattatatcttgacaatattgagattttatgttcatgcacattaaatgtctttctatttaaaaaaatctt

SEQ ID NO: 244332 - DNA, 652 bp, Homo sapiens
aaggactgtctagtttatatggtaattaatcacaacctcaaagactttgaggaggtctggaggctccactggggaccaactaggattttaaaaacaaaaacaaaaaacaaaaaaacttcccccagtccctactaccacactgcataatctccttgcctttcctcccagcatacgcccaggcccaagtcccccaacactgcccccaactagcccagtattctcaaaaagagtgataggagggcatagggttgggaatgtggtagagctgtcaaatatacacaaatctacaatgtcagttcaaaaatggaagtcatgatccttcgcgttgtcctgcaacaggataaaaatagctcatctttcatcaagacagaagaaaacctaccactatcgtatctggtaatctataacaccaccctctatctccaagttgaaccctgctgtgctgaaatcgaagctatatgcagcattttggtttaaagtcagatagacctaagtttgtattccagatttgccacatgtggctgtgtgaccttgaccttggccaagtaatttgacttctccgagcttctgcttcgtcttttttttttttaatgtggatcctgacagtgctaactctataaggttaagaggattaaattacataacacacata

SEQ ID NO: 244333 - DNA, 441 bp, Homo sapiens
gcccccctgttggccaggccccactggcctgcctggggtccctgccacctccgcaggcacctgggtctgcctttctgctgttctgtcacgaggtgtgccactcagcttggctttgaagccaggctgtgtttgtgcattgaatgcacgccaagcccaggcctccactgatggctaaataccttttctgaattgtaggcaatataagataaaaacgtgctgcgggaagtgagaaaaactacatgcccccccatgctgagtgcccacaggaggcgcacgggtagtgcaggaaaaaggcaaatggccatagttcctgaaaccagcataaattaaaacaaaatacaaatcataccctggcaaatggcaagtaacagcctattgccagtatgcgaatcacgttgtgattttttaaaatttgttttgtaataaataatttgtttgaaa

SEQ ID NO: 244334 - DNA, 378 bp, Homo sapiens
ctgtaggtgacagggaagatgatgccatcagatctgtgcttcacatagagaagtccggcttcgagatggagtcaccggagcatggtgtgcgggcactcagtaaagtggagatgtgattactagatcattatggcaatataagataaaaacgtgctgcgggaagtgagaaaaactacatgcccccccatgctgagtgcccacaggaggcgcacgggtagtgcaggaaaaaggcaaatggccatagttcctgaaaccagcataaattaaaacaaaatacaaatcataccctggcaaatggcaagtaacagcctattgccagtatgcgaatcacgttgtgattttttaaaatttgttttgtaataaataatttgtttgaaa

SEQ ID NO: 244335 - DNA, 689 bp, Homo sapiens
accaaaactcaggcatccaagactcatggtctgtttcaagcttcccccggcagtgcattggctcaagttcgtcccaagacatctgtctgtggacaggggaggaatcgaacacagggttctgtgtctgccctgctctgcccccagaagctagcaacagaccaccagccatccatcctcggtgagccagtaggtggtttgccacaggatcgagacggtgacctggccaggagcttctcccagggctttgtgacctacagtcaggagaacaattccgaaagctctctgcaaagttctagttccctcagcctttccactatgtctgtggccagcctgcctgccgtcaacaagatagatgagtcacgggaaagcagtttagaaggggaccttgcggtgaagtctgtttttcctccggagtccatggggacactccagaggtttaaggatacgcaagagactgaaaccggctataggtacatgaccctacacttcccctaccggcccactccagcctcggagaaagtgcccagtttccaacacagctcagtgtctaactgcttgaccttgcgtgttcactggggctcagaggctgagatccacaagttctccttaggcaagagctctgtgaatctgattgaggtgtcccaggcaaccgtcaagacagagctgaggaggactctgtctttaggtac

SEQ ID NO: 244336 - DNA, 792 bp, Homo sapiens
ggcacatccccagtccagtaggggttccaggcaccctgcaactttgctaatttgcaaaaaccaagttgagagacaacctaatctgagcaacaagtagtggggaaagtttctaagaatccccaaaggaaccaaaggagagacacgttctggtaccactggagtcggcagaagaacaatgccttgaaacacaagtggataaacatgtggttccctgcttggtggaggcacttgggtcctaaccatgaggtaaacaagtctaacaaaacacacatcactcccggcaaagtaccaaatcctgaagtcgtcccactggcccctggaaaacagatcaaagcccatggcaagctccactgttcacaaactccccctccacgcagcaactgtgagccagcgaatcatcttactagaagccagtgggtaaaacaataggcagatgcttatctaacagagacaatttgtcaaaccagaaggaatgacctgagaactcacattgaactgacactgatcagggtggtgtcttagtgcagggggagaaggccctgttggaacctggtccttgaggcccttagtagattttaagcccctcgaaagaggagataggaatcaaaatagtattgatttacagggtgcatacaaaaacgtgtcaaaaccaaacaaaacctgatccattttgttcctggctgcctccctattcaagagaagtgggggtggctaagaaaagctggactgagagatttaggcagtaacagaaaacttgtttagaaaaagatggagcaggagcacttaggtgtt

SEQ ID NO: 244337 - DNA, 412 bp, Homo sapiens
gctgaagggagagtggtgagcaacagcctacagctgtcacctccttcccaattggacgcagcgaaagagacttcctcatctaaagtcatgcctttctcaggagcaggctgcaactggtgactgagtgaggcaggagtagaaaggcccgctattttggcccaaacatgggacactctgattggctatattcattcaagagctccttgcaggattaaggttttgtcagctctgcattgtggtttgactttttcctttgccaaattccttcccatcgcagctgatggttattgataaacaacttgccctttgaactctctgtctcagtgtctgcttctagagacagcaacctgtgatcattggtactagcaatggcccaacaagcaattgataagatggaatttgggagctgatc

SEQ ID NO: 244338 - DNA, 574 bp, Homo sapiens
atcagaggggaaagcatgaactattcaataaatggcaacgatacaaaagaaaaccccacgaattgccattcttgacccactcaatgtatgactgcgtgcaagtcactcatcctctcttatctacaaaatggggatggtaattcctcctctgccttactcacagttttgctgtgatgattaaatgggataacagatgtaaaaggtcatggaagagctgtcactgtatagtaaatgctaatcttactatagtaagtgtactaataggatattagtaatatataataaatgtgctaataggatagcacatttaaaaatattacaaaacaacagcatcttataagaatctttaaggatgttacaccaagaaggtttgattatctatacatggttaatggcacaaaagaaattatgaagcctaagattacatactcaggaaatataaaaatatacaaattaaaaacaacctccttattgtaaacgagttgtaagcataaattacatctaacttgtcagactgctaaactgagaaatggctaaatttcctgaaaactaaggataactttaaggtcagcca

SEQ ID NO: 244339 - DNA, 426 bp, Homo sapiens
caatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggtaaagctaaaattgtgaatatgtaaataaaaataccatgagaacatgggagagggagctggggtgttttgctttcataggatgggagccaatgcctacatgttttctattgtatcttttggacaggtagaatgattgcaattgttaa

SEQ ID NO: 244340 - DNA, 480 bp, Homo sapiens
gaagaacttggagaagtggatgaaaatcagaaggaaaaacaggacaagaatttacgaaaacagcaatgagaattaggaaggatatgacttaatggtggcagaaacacatgaaaatttcccagaagtagatagcagaaaaagcagtaaaatgttcagaggaagtgcacaggaaaatgtaaaagactggggccaatgaaaaaacccaagattatactagaaagtgtgttaagctaagctgctgtggcaaagagactccaaaacatttaggcttaccccgaagctcatttctgtttgcatgatagtttatagataggtagtgctacagagctggttaggtggctgtgccattcttatcatgtggctcccacctatggctctaaagcagttagtccagctcttatcatctctcagtcagtgggatggagaagagggactagtggagtacatgtccagttgctttaagggtaaggtctgtgagtg

SEQ ID NO: 244341 - DNA, 499 bp, Homo sapiens
acttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagcccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaa

SEQ ID NO: 244342 - DNA, 381 bp, Homo sapiens
agtgattattgtccattttaaatcatgagattagcagtgtaaagattcagtcccagttctggtttaaaagaaggcagtttaaagaaaatgctagaattgtccgggcacggtgtctcacgccagtaatcccagcactttgggaggccgaggtgggtggatcacttgaggtcaggggtgcgagaccagcctggccaacatggggaaaccccgtctctactaaaaacacaaaaatcagtcaggtgtggtggcatgtgcctgtaatcccagctactcaggaggctgaggcaggagaaccccctgaactcaggaggcggaggttgcattgagccaagatcatgccactgcactccagcctgggcaacagaacaaaactcttgtctc

SEQ ID NO: 244343 - DNA, 592 bp, Homo sapiens
acataactttttttcccccagaaatataataggcttttgtagttcattcacagttttatctatctctgttttattatttgtattttcattcattctcatatttctggtacatggatttcacctggatgtagaaaacacatttgcaattttgttctttttacagatttgttgggcgaatcaatatctacagtaatagtcttgaggctgttgccaggtaagtttgctgtttctttaatttgtcctttggttgggggggggggtctatttttctgttaaatcaactaaaatagccaaatacctttctattatagaaaggaatataggccgggtgcggtagctcacgcctgtaatcccagcactttgggaggctgaggtgggtggatcacctgaggtcaggagtttgaagccagcctggccaacggggtgaaacccaatctctattaaaaatacaaatttagctgggcgtggtggcacacatctgtaatcccaactactcaggaggctgaggcaggagaatctcttgaacccgggaggcgaaggtcgcagtgagccaagattgagccattgcactgtaccctgggcaacaagagca

SEQ ID NO: 244344 - DNA, 1692 bp, Homo sapiens
caccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcag

SEQ ID NO: 244345 - DNA, 1620 bp, Homo sapiens
caccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaagatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcag

SEQ ID NO: 244346 - DNA, 894 bp, Homo sapiens
gaggggaaggaaggccaaggtaagacattcttggagtttatcctatttgtagccatgaggtaaactggagtttcacttctgagggagggaaggacgtgaactggcttaaaaccagttccttttgcatgattcagcaaaacagtctttatggactcacagtggaaaaagaactcctaacttttctaatttatcctccttttaacgatagaggaggaaacgccctgttccatttcttctcaacttctggagaccttctgttaagtctcatctaaccattaaatagatcgttttccatagaatctaaggcctagattttactcatagtgatattatctacttcaaaagatatactctatgttcttccttttgcccttcatagtaaagtgaacatagtgcacacctccacaatcttaaaaaaaaatactaactttcctcccagtcttgccatagggccctccatcctttttgtaagaagatctttttccttcttgaaaccttgggagttgagtggcagccgtaagtaggaaggaggtgcccttgtctttgcttgttctctgtgctcagggaaacttcagaaaggtcaacttggcatctaggctagatttagttatctactagtttaggatcctgcctaaatcatctggtttaggatggtttaagttgatggggatgtggagaactgagtgttaaattttccttttcagttgaaagagtagtttctgttgccaagaagaaggaaatggtacttcagctttcttcgtgacagcttgaaatgtgctcaaaattataaaatcttagacaatgatgacttagatattagtatttacctaagaatttgctgttgtagaaatctacattgcaggctatcaaaattctacctgcttggtctgaaga

SEQ ID NO: 244347 - DNA, 211 bp, Homo sapiens
gaatattaggtttgaaaatattacccattagttaaatttctcctccttttacaatgatgtttgcctttaaaggggtcaccagagaataatttgtttcacagagcagccatgctattaatactactgtttagagatatagaaacgactttgcaactgtgaattgctaagaattgtagaaataaagggaaaataaaattttcttttctaattt

SEQ ID NO: 244348 - DNA, 404 bp, Homo sapiens
aagggcttaggaattcgaagataattcaaaggaagcaaaaaggaatttacatttattacgtaccagatgttttttatttttcacctgagttgacatgtgattgatttgggtttaccaaagataattttcccccagataacataaaatatagcaaagctgagatttgacccatgcacctctgctctgccatgtgccagacacatactaggcattcgtggtctatgttgtcaccaaaccacagtatactgacagtacagtaaaacaggtattctctttttcactgttgaaaagacttagggttcaaagcagttaataacgaagaatcatcacacaactggccaactgagaagaaggggaacagatgggaataaaatcaaggctagaagtctgcagtctctagattc

SEQ ID NO: 244349 - DNA, 461 bp, Homo sapiens
caggtgatccgattgtttttctaaagagcaagggctaggacgtcctacgtgttcatatgcacaattttttgaactccatcaagaacacgaaccccatgcccacatcttcactgctcaattcacattgtctgatatgcaccttccagggagaaggaggttttcatggagaaagaggcaacgttgactatacgtgtttactcaaggcttttttataccggactatatgccatccaggtttaagagaagtccaggcaggctctagcattatgtttttcacagaaaaagccggtgcagtagcccggatgcccagatccactcatttcccaaaccggttcccacacccgctgcccaccacctggcgaggaaggagcgggcgaggttcgctcgaatcgtcgtcacgggtttccgtgggtacagttattactcgttacataatattaaacaattaagattaaaaatgg

SEQ ID NO: 244350 - DNA, 542 bp, Homo sapiens
cttcaattcatttgtgaatgtctttatcccattagattgggttacttcacaattagaaaggtcatacagcaatttcttccaagatttaatgacacacttcagagtaataaaatcagtttgtccagaaaaaaaaaatccagcttttaaaactccatgtacctagaaaatcaaatacatttaaaatccagaaaatactgtgagattgtagtagattttatttagacacaatacatcttcatcttcacaatatcagataatgttagaacgtggaatattctcaagataaataaaaagagaaacacatttaaaaattgttcctacccaccccatccccaaccctggtaagtaactatccacatattctacaaagcaaagcttcttcatgcagtgtccaccagaaacaagcaccaccacctgttcctaaaatagctcgtggtgaaagagaagaaaatgagaaagctggcgacgtgactaacacactgtgcagggaagtgctctacaactactggcatgcagtgaccgtcaagcaggtgaacagaggc

SEQ ID NO: 244351 - DNA, 438 bp, Homo sapiens
ctgacaaacttcagtaaagaaaacagagagccctacccttccataatatatgaagagtggggcaaggtgaaagagaatggggagggtgtagcttataattttaaatagggtaattgcctcactgagaagggacatttgaataaagatctcaaagatgtgagaaaattagccctcgggatatctggaggaaaaattcaaaggtcctatagtatagggatgtgttggaataatagcaaacaggccagtctggctaatgtattgctgagagactggtaggaagagatttcagaggataagcctggttgggttacacattctttatctttttttaatttaatttttgtttgtcaaataataattatatgtatttatggagtataatgtaatgtgatatatgtataaattgtggaatgattaaatcaatctaattaacatgtc

SEQ ID NO: 244352 - DNA, 552 bp, Homo sapiens
aaatattttcattctatctttcatgcaactctggctgcaagctgtgctctttctgtgcccagatgaccaagtaaagccccaagtcacaagacaccctctctctctctctgccctgtgtggaaacactcctgcagaccaagcatcggtggttattgtgaatggcattgtttccattgtatttttcagtaggccattactgatatgcaataaagcactaagcctttttaaatatttattttgtatctggctaccttaataatctcttattagttctcctgcattttcagctcattctctccattttttttcggtatgccatctgttatggttgaattgtgttctctaaaaggtatatgttggagctgtaacccccagtacttcagaatgtgactgtatttagagttaggaccttgaaagaggggattaaattcaaacgaggctgttagagttggccttaatccaatctgactgatgctgttataagaagaggaaatttgggcacatggggacaatcatatgcagaggcaacaagaggtggacatctgcaagcca

SEQ ID NO: 244353 - DNA, 488 bp, Homo sapiens
taggggcaaattctttaggtaggaccttgtaggtcttggaaggcactatggtttttattatgagtgaaataggaagtcattgaagggtttagagcagagacttaaattttaacaggatcagtggctgctcattagattgtggggaggcaaaggtgaaagccggaagaccagttaaaaggctgttgtaataatccagattaatagaggaggagatggtaaatttgagatatggtttgaaggtgaagccaacatcatttgctaatggtttggaggtagattgtaaaagaaaaagagaacttaaggacgacttcaagattttaaaaatctatgttggccaggttggtcttgaactcctggcttcaagcagtcctcctgtgtcggtctcccaaagtgctagaacaggctctgagccaccgcgcccagccgacttcaagatttttaacgtgagcatttgctgagatagggaagactgggaagagcaggtttgg

SEQ ID NO: 244354 - DNA, 367 bp, Homo sapiens
gatcacacgtgtttatttaaccagtcagagtatgtcagattagtgggcacccttgtaacttattttcaacaaagaaatatccttgatgagacttggtaatccaggatgtgttgtgtgtgtgtgtctgtgtatatgtatgtatatgcattattaggaaaaactaactgtaattgaacttctatgttctcgacacttctgtatcatcgcgtcatgtaatccctacaatctcatgagataggtgttgtcaggatgttactcccattttataaatgagcatactgaagtaaagagatgaatagatcatacaataagtgacagaggaggattttaagaacaggtatttcttttttcaaagcccatatctcat

SEQ ID NO: 244355 - DNA, 364 bp, Homo sapiens
tgggtggttgagggagctcctgttgaaatgtgctgaggcttctgctgaggtttctacctcagctccacggcctgtccagttcaatggattgaagaaaatgttcacggaaggaagatgattaattgatccagagggcctgtagcaactctgtttaacatgctagatgagccagtcttattcagtgatgactaaggatctagagagttcctaggatgtgtatcctgtatgctggtcaccggaagataggcaaatttttgctttgttgctggttctgggacaacagccatgatgacttcttggcagtcatttgcagactaaggtagctttgaaggtgaagaatctttgtgttcattctcatcctgat

SEQ ID NO: 244356 - DNA, 777 bp, Homo sapiens
agaaccatcgagttagtgctagcatagaatctaacaagaaatggccctgcatccattctcttttcttctaataacagccccagatttccatttttggacctaccttttcctttttatcaggctaagtgttcatggtggggctctgtccttagttccagggataaagcctgtgacccaaacttaaaccgcagatcattttccccaggccatggagattgtttcaaatgtgggcacatggcctgaatgggtcatatcagagtaaatcttagggcttctgggttatgccaccatcacaggctcttgctttcctcactgaacttgaacctagacggatgtaagctggagctgtggcagccatcattgccctgtgaacctggaagtcagagctgacaggtgagaaacaacaaacaactcacacctgattgtattgcttgaattctgaattcagcagtgcttgaagccagattgagtcctgaccattttagtatacgatcattaagcaatcttttgcttacgacatgtgcggttgaaagagtcccaattataataggctgagagactaggtatagtaactagcacttaagtgggttgtctaggctgtaggccccagatatttaggagctgcactcagaggctcctgagcaaggtatgtgtctggggtgaccccaagtgcacttgccaatctgaactgtgaggaaataccatgtaatgggggagaggagagtgtggcaggcattcagatactttggggaaactcacttcaagcaagtgttctgt

SEQ ID NO: 244357 - DNA, 385 bp, Homo sapiens
acattgtgtgccaggatgtgagtcagtaatgaagaaaagcctggaagaaaaagagatctgtgttgagaagggagaaagagaagaaagaatgaataaactgtgttgtcatgtgattttttaaaaagacccttttttgtggttgttatgagtcacattttaaacaatgtagcctgggtgtgcattcttttcttttcttttttaaagcagtggctataaacatggtgccgtcatgtatctttttctaggatttgagctttaacaaatgaaaaaccgtgtgtataaaggggggaaaaagaaccgaaaagtggtgtaattaaggtgatggattatttcctcttacccaatactttcttttttcaataaaggaaacaagaacaataaagaa

SEQ ID NO: 244358 - DNA, 264 bp, Homo sapiens
gcttgaactcgggaggtggaggttgcagtgagccaagatctcaccattgcactccagcctgcctgggtgacagagggagactccatctcaaaaaaaaaaaaaaaaaaaacacagcttttaattaaaaaaaggtcaagacaatagtaaaaaagacaagtaggaatataagtggtacgtcagatgtaatctttccttttcttttttagatagtcttgctctctctcccaggctggagcgcagtggcacaatcttggctcactgcag

SEQ ID NO: 244359 - DNA, 380 bp, Homo sapiens
tatatccataaatatttcaatttgtatctctataagtagagacttttaaaaatgaccagaataccattagcacacctaatcttttattttaatatcaaacatctagcaagtggttaaatttcctgttgtttcatggatactcctcacccttttcttgtttttttttcccattgtagtttatttgttgtttgtcttacagtttcctaccttctggatttttaaatttttattttattttattattttttgagatggagttttgctcttgttgcccaggctggagtgcaatggcatgatctcggcgcaccgcaacctccacctcccgggttcaagtgattctcctgcctcagcctcccgagtagctgggattacaggcatgc

SEQ ID NO: 244360 - DNA, 356 bp, Homo sapiens
gagccggggccccaggcctgtttcagctctgagactcctgagggaaaggccccgggattttctcttgcataatggtgtgctctctccttggaccactcctgccctcttaatccagtcttcaaacagaggtcagagcaacatcaaattttttttttttataatttcttgttgatgcttaacataccagggaagagggcacagccgtctctgtaccggcagagagattttcacaaagcgccgtagccccggtcacagcagagcctggccggcccccagaagccccccaggcccctctcactgcccccgcaccccccaaggtagtcatttccggacttctaagggcacaggctgggttt

SEQ ID NO: 244361 - DNA, 510 bp, Homo sapiens
gcctaaaaataaaactcccacaaatccgccgctaattgaggaactagaataattctcaggtttttaaagttgcccaatcctatgattgtctccccctgtataaataaccagtatctttaatatgatgtttgatttaatggtattatattgtgtacagtttgccgatagcattatagttctcttattcatctttatcgtatgtagctggagttaatttgtttgcacagtattatagttcattatgtgaatattgcacatgaacttcagaaggaatgtcagactaatttcccaaacttctcatagtagtttacacttccacccaattgtgcccattgctcttgcgttttacatcagcctagtgtaattttgaaatatataatgaaatgaaacttttctaaaataaaatatttccagaagtaatcattgaaactattggcatatatttattttacagcatgatatataaagaaagccatagttaaaagcagaatgctactccacaaaaaaaaa

SEQ ID NO: 244362 - DNA, 459 bp, Homo sapiens
accaaatcaacagaattttcatctttttgttttaatatgtaaaaattggaagagaaatataaaagagtcagttcaaatattaattcaagcactggctgaaatcagtgtcagcaaagtaacaaggcatttatttgtttcatagaagaaacttgacaattctggaggatattcagcatgtttacaataacactgttcctgacatttttttcctccttgtttattggctcttggactaagtatcaatctttggacactgttcttttctttcttggcttgaaagtgagcaggaatgggggtgaaaggtaacttttatggctgatgaggtaagaggaagatcacaaaatcattcttgtaaggcttctctcatttcttaactgaagtatatgtcttcccttttgaagtacagaccatggctaatgagtgaattaataaaaaattcttgtggaaagttgactacat

SEQ ID NO: 244363 - DNA, 440 bp, Homo sapiens
aatgcagttatcacctttaccttcccttcactagccactccctacacagcaagcttgtctaactgtgtgcttacttagaagctccagagccagaaccctctcccactaggagattgtctcaggagacaacagtctgtttacatttacaagctaaaagtatgcccacgacagaactctctcctacctgggcagtatctcagacaatggccactttacaacctagctctgcctgcgataccaccagcttgacttcttggtagatagaaggcaccaatgccagtcacacagaaccccacctgctcgcttcgtctcctgcatgctgctcatcccaagtcccctgctttctgccccaaacgtgaaacagtacccttaaaggcaggagcctgtacttcttccgctaagctcgctttggaataaaaagtcactttctttatagcaga

SEQ ID NO: 244364 - DNA, 440 bp, Homo sapiens
gaggaggaggagaagaacttggtcttgctctctcaggggtgacagaggtggaagaagaggtagagaaggtggaagagaagccacaaagtgaaggcatctaagacttatatgtggagctacacagttcaatctcgtatcgttcaagggtcaactgtacttcattgataactgaaaattccaggaggacatcctggattttgttctataccaactcttcaaaacagttcctggcacacaggagccattagaggaatatttgttacttagatgaataactgaatgaatggaaatggaaggccagaagaataaaatgatcttcccaaaggcatcactaagaggcagaactggactgtgtgatgccaggttcccagtccaaactttttccatcactttattgtttttaggtgagtttcattaaaccagaaataagccatctaaaa

SEQ ID NO: 244365 - DNA, 197 bp, Homo sapiens
gtgaaataacttgctcatagtgacacagcactgggccaggaaccctgctgtcctgcctggagtccatgtcccatgccctggatcagtgtggactgtaaaagtggtatttattaatttatatttgaatcatggcattgaaaaagaaaaccggctgatccagcattttccaaaatgtatcctaagactctaggtcctca

SEQ ID NO: 244366 - DNA, 413 bp, Homo sapiens
aggaaaatcaaagctaccagatctgccttccctcttccatcgcaagctgtcttgcaattatcaaaaaagtgtgggcagcagatgagtttattgtgtttactttgttttgtttgttttgtgggattatcccaggagagggaattgcctagtgataacagtaagtttgtttctctgtaattttcactctgttttaggtgccttcaagtgcactatctctaaaatgggcacaaaacattattggctacttacttcacaaaagactttttactctatctttatgatattaagagaaaggctgagatttaaggatcttgacacagaacaccaattaccacaattcttgcatttttttattaccctcgttgtcttctctctatatatcaattcttcaattcttcaagaacatttaagtt

SEQ ID NO: 244367 - DNA, 123 bp, Homo sapiens
tctcatgtgggagatgggcaccatgggccagaaatgggctgaggaagctcccagccccagacctcagtttccccatctgtacaatgaagggcctttttttcatggttccaaaagccacacgtt

SEQ ID NO: 244368 - DNA, 390 bp, Homo sapiens
tagtttttgccttgctcaccctttaagaatgactagtgcaccacaagaactctaaagcaacattctcccttaatttattctaattatatgtgccttggactgttttgacacctggagatttcacaaaatagttgcttgttttctctgagactgtcaccattttctaaaacttgagaaactaggcatgaaacaaaatcaccgcctgcatttctaagtcatcatccatctatacctttgtttaataaaagtctatatattggaaatagttctcagaccttcacataattcaactgtcctaatctataactaggaatgaaccacactccttaaaatgcagaattccgattttttttttagagagacacggtcttgccatgttgcccagtctgg

SEQ ID NO: 244369 - DNA, 377 bp, Homo sapiens
atgtgtcattttcttaatgttgctgtaatctaagttatacttaatctaagcctttagcaatgatgacaggtgtttgtatgcaggtgatatttatattcctacggagtctaacttttggaaaattagtttgcatgtatttttatttcatgacatacagtaaaggtaaccttctctataaatgtttgatgtcttacagaaaatttcagtgtattagttataacctctcaatctatgcataccacatgcatgtagattcatttagagtttgggaacaaaatacaactgaaactgttaaagagaatgttctgattagactcttcaagacatagtggtcttcattcaaggagtaaatctcctgccaagagtttctatcataa

SEQ ID NO: 244370 - DNA, 393 bp, Homo sapiens
aaaaacacacctagaaagctgtgcacctcaggtgacaagagagaatggtttctgctgagaactcaaaaatagagactgcagttcatacaaatgcagatcaccgatgccaccatcagtagtgaattttctcaagacagttacctcgaacccaggtatttggtctttgtctaggggttttcattcaccagaactgtcatgcaggccaagtttgccatgctttctgcctttatatcagcagctcctctcccccgcccccaccacaaccttcacacacattgcagcaaggcatccagtcctggatcgcaactcatgctccttaacattcctacctcagtccagtcttcaaaggagagatcaccaacaacatgtgcataatatatttgacatatggga

SEQ ID NO: 244371 - DNA, 467 bp, Homo sapiens
caagaaggagtgcttcagatattagcagaaataagaacacaaccaaacctgtgcctttgtttaccttgctgagcgttgagcagcagggagggttagtgataaggttaaaatggttggcagatgctagaatttcagaagaaaaattactatagattcgtattttttctctccatgcttgataattaactgcttattaaaaaccactttccactttacatctagatttaaatgacacattttactaaatgattcagaaacaagacaggaacaaggaaaaaatttaaagctacattttaactgcatttagtcttacagtaagaaaacagctcaatagtatcatcatgatcatgtaaaagtttttaaaacctcttctattaaagagggaattctgaaaaggaaaaatgtgcattgttcctttcctttgagaaatcaaagtactttcacatttatcctcattttatcccaca

SEQ ID NO: 244372 - DNA, 583 bp, Homo sapiens
tgggtccatgcccaggagggttcatgtccagaaaggtccatgcctaggagggcccatacacaacagagccctgtgcccaggaaggaccatgtcaaggagaaccccatgcccatgagggtccatgcccagtaagggccatgcccatgagatcctcatgcccaggaaggcccatgcccaggagggtccaagcccaggccagttcatgcacaggagggccccatgcctaaaagtgtccatgcccaggaaggtccatgtccagaagagtccatacccaggagggctgatatggttaggctttgtgtctccacccaaatctcatcttgaattgtaatccctataataaccatagtccccatgtgtcaagggagagaccaggtggaggcaattggatcatgggggctgtttcccacatgctgttctcatgatagtgagtgagttctcatgagatctgatggttttataaggggctcttcccttcacttctccttcctactgtcttatgaagaaggttccttgcttccccttcaccttctgccatgattgtaagtttcctgaggcctccctagccatgctgaagtgtgag

SEQ ID NO: 244373 - DNA, 361 bp, Homo sapiens
gcgggttcgtagttatcagacttcagtactgcagaactggtgaaaacagaactaaagtcacaaagattcagtcagttctgttgaaaattgaatttattttgttgtagaaaggaaggaaagcataaatgagtatgagtgtcatttacttcacttagatgattactaatgctttttacctgatgtataattatatactaatgtatatggatatttcttcagtttttttaaaagatttttttttaaattgggcaatctttctgacttttaagctaagtttctaaaggatactgttggctgcaggaaacttaggtcatttattcagagtttatcagttttgacactttcttttgaaattgttaaa

SEQ ID NO: 244374 - DNA, 327 bp, Homo sapiens
ataaataataacccaaggttcttaggttattagtatgtctatttcttgtcacctgagccagtcataatctatgaaaatcaggacattcacgtggtcagtttacagaatcacttatgaaataaaataaataataaacacagtttgattcatctttaaaaacagacacatacacacacagctttgtcttatcttttcaaaggtttcaattccatagttaaaaattgccattggttgcacataaaacagtcaactgtaggctgaatttggggaaagaataaaacctgaagaaaaggaaacagtgaaaattactttgtttcccaaacttca

SEQ ID NO: 244375 - DNA, 398 bp, Homo sapiens
ccttaatataaaagtataaagtggcattcttttgatggcaaaatattctaaattgtatttcctaatagtaatagaaatattttagggatacccaattcattggttatatagtttcttcatgagtacagactagaatatatgacttcataaattttatgtttttatttcattttattttgccaaacaaaattagcaaaaagtgaagataagttttggcttatcaattagagataatcatacacataatttggaaatttgttttgtcacatagtgcacattttccaaagctatttaaaatggaaaatagcataaccttattatcagtgagtgtgaaaaccaaattcaaagccatgtacacaaataaataatcacttgaataaagtttgatttttcccatt

SEQ ID NO: 244376 - DNA, 578 bp, Homo sapiens
tactttcagctcaagttaagagccttgagcagcaagtggtaggatgtcaagactgtagatacccaggtgtgaacagattgtagcaggctgaagattcaggagcagatacagataaacccagtgtggccccagccaagaggtccggatcacttccctcttctcacagaatcctgcagagatggcagctgttcttcagggggtgttatactgtcttcattgaggcttatctgaatgtggggaatctggtgattatgtggtttgttccaaccttcaaataagtcattggcacacactcagttgacagtcattggatctgatgttgtgcttgggaagaaatcttacagatgatctggcccaagcttctattttttgtttttccagatgacagaatggtttggcttaagttctaaaagtagtaagagccaagatttgattcattagacctactgctctttctgagattacagaaaagttgcatttgtgtctcaagtgcctatttattcagtaggactagagttgacgctcaattttttttttttttttcttttggagatggagtctcactctgtcacccaggc

SEQ ID NO: 244377 - DNA, 559 bp, Homo sapiens
ttctcagtgatgttcttccccagtgcctgcattaacagatcatcttctcttaagaaatcaaaggtcccagtcaatttagaaagtttattttactgctgggtgcggtggctcacgcctgttgacaccgagacaaacagagagagacagcagagacaaagaccaggggagagatctcttgcttccagccccttgggaagcctgcccgtgggttccatgaggcaccccaattcttctcacaaaaatcttttcactctacttaaaatagacgaagctagcttctatttcatgaaagtccatcgttcagggctgagtgtagtggttcacgcctgtaatcccagcactttgggaggccgaggcaggcatattacttgaggtcaggagatcgagaccaacctggccaacatggtgaaaccctgtctctactaaaaatacaagaattagccgggtgtggtggcgcacccctttaatttcagctactctggaggctgaggcaggagaattgcttgaacaggggggcggaggttgcagtaagcagagatggccccactgcactccagcc

SEQ ID NO: 244378 - DNA, 583 bp, Homo sapiens
tgaatggcccttaaaatatgtttcattcagatgaggaaaggaagagaaaagaaccggattaatccaataaagagaccttaatacaaactcaatcagaagactgttgcactgtttttattgagttctgacattttctgtgtagactgtgcagcgaaggcacagcattactcattggcaataaatccatttaggtgtgcaggtgatgcccagatgatgtttattctaaggaatcttaatgtcttggcctcttcaaaaactgcacaaataaacttggctcaatattaaccacagttagtgaaccttaggataaagaaatgggattagtcatcccgtgatgcattctgcattcacccgtggcatcatgccaagggtaccccatgctactgtgtattcactccattcttaataacttgaaaaaatggagatgttagctgcctttaagaattatgcattttctatgaggatttaaggttgctgagaaggcaactatgaacaatcaatagctacttaataaacgctgtataaatgtatagtaagtaaatattcatgtctttttataaagtagacttcaacagagctctag

SEQ ID NO: 244379 - DNA, 660 bp, Homo sapiens
cactgaaatgaatcaataaccaagtgaacaagcctggcaggcttgggctgttgaaaccctgcacattccgaggataggactggcccttgcccagctccagcccttgctgtgtgagcctcaagctgctgaacatgtgcatgagaagagaaggctcagagactatacctcacccatttaaaaagacttatttttggtgcaccagtaaaaaggtagcctttttcatttagacaagtttataaattctggtgagagtcaaaatgtaaaatataaagtttataaatctaaaatggaaatctcaaatataagtcagatgaattcctcacaccaagaaaaccatgctggttcttttcttctaagagaagctgccctgagacaggctggctgccagcacacgattaccatatagcgcttgctgaaggtgaaactggagcaaaaaatgctccagtcctagcgcacttgcagcacgtatgggcttgccttcaaactgggctgagcctggatccttccctcatgccagaggcaaaatgatccccaaaacgctggagaggtgtgaaatgacatagcagacaacttgaggggctctcacctgccaaattatgcccattaaagcatcaaaaacaaatataaattgtattaatatctataaaattataaaaacta

SEQ ID NO: 244380 - DNA, 554 bp, Homo sapiens
aagcgcacgatggcgcgtccctctcagaaagcggagcgcttccctgcgttaggacccgatactggctccctccccggaggttcgcatgtgtgttccggagagggtgaaatcaggctggcaccgcgggaagaggctagagtcactaaatcaccttgtcctcttgaggctgctgtccgtatgcagcgacattctgcccgttagaggactcagctcagggcctggtacgctcaagatctgttagctaccagcaccatcaccacgaccaccgtcatcaccagcagtatccctcagcctcgtctaccttgctcgtcaagcagggtgctccaggagtgggtgtaggccactttcgccctgcctggcagatgcaactttccaacttccacctccacttggacctgctctctctactcaagtctagctggtggctgctggagtttgcgtgtgtgtttcttactatatcttctgacttcggacgcctaacccaagcttattatctcccctaaaatgggacctccttaaaatatatattacctttctttttcctgttcttaaaa

SEQ ID NO: 244381 - DNA, 397 bp, Homo sapiens
tcatagctactcaggaggctgaggcatgagaatcgtttgaacccgggaggcggaggttgcattgagccgagatcatgctactgcactccagcctgggcgacagagcgagactctgtccccacccaaaaaaaaagataattcacttctcagtttccagattgcatttatatagattatgtagttatattgataggtgttttccctgtaattagttacaataataggcaaatgtcaacacctgttattttaattttgacaagttttctttaaaatttgctataaagtctttgattgatagaaagagaaatctataaattggaagccaaaagctggagataatattaggccctcctaagcactgggtccaggaatacccacctaattcagagagtgagct

SEQ ID NO: 244382 - DNA, 487 bp, Homo sapiens
aagcctgggaagtcaaggctgcagtgagctgagatcacgccactgcactctggtctaggtgacagagtgagaccctgtctcagagaagaaaaaaaagccaaatatcttaagtggttcttaggcacattatagtgctataggttttggggagccactgtttaaaattgaaatctagacaggatcacatttcaattttaggaagctcactctggcagcgtgtagaagatggagagagatagaggtgctctggaggccttttaggatgcttctgcataaaactaagttaagaaatgtcaaaggcctgaactaaggggtggggataaaaaggaaggagtggggattctaaagatagacgtcaaaacaggttgacctgcacactgaatttagccaacagttatgtttaatttggcccacacttgctttctttcaaaaattagtatctctagccgggtgcggtggctcacgcctgtaatctcagttactttgg

SEQ ID NO: 244383 - DNA, 722 bp, Homo sapiens
gagagatgctgctccatttatgatgggtttctgttcctgatagacctattgtagtcaaaaatacatttaatacacttaacctactgaacatcatagcttagcctagcctaccttaaatgtgctcagaacacttagattaattcgcctgtacttgagcaaaatcatctggcagtgcagtagagaattggttgttcactgtttgtttgtttttttttttttttttttttgagacggagtctcgttttgttgcccaggctggagtgcagagatcacgccactgcactctggtctaggtgacagagtgagaccctgtctcagagaagaaaaaaaagccaaatatcttaagtggttcttaggcacattatagtgctataggttttggggagccactgtttaaaattgaaatctagacaggatcacatttcaattttaggaagctcactctggcagcgtgtagaagatggagagagatagaggtgctctggaggccttttaggatgcttctgcataaaactaagttaagaaatgtcaaaggcctgaactaaggggtggggataaaaaggaaggagtggggattctaaagatagacgtcaaaacaggttgacctgcacactgaatttagccaacagttatgtttaatttggcccacacttgctttctttcaaaaattagtatctctagccgggtgcggtggctcacgcctgtaatctcagttactttgg

SEQ ID NO: 244384 - DNA, 713 bp, Homo sapiens
tagtaatttaaatgaacatctgtcatctgtcttcccagctaggtaataagttccttaaggagagagattacgtctgtctatctcatggttctagccccagtgcctcgcactttgctatatacataaaagacgtttgattttttttaatgaatgaatgttctcctattaatcattgatattgatgaaaataattgttgcattagcaaaggcttcatagatagaaattatcttcaattgctaattaaattattaaatagaatttcttcctccagtgacttttttctctacctttttcaatggctccttttaggaccacctttgtgatagataaattcacatctattataatcctcatctgtcaccaaaagacaataatctagcagtgtcagcatagttactaacgttaaaaccataccacttaagccaattttaataatttttcaaacacaggtatataagattggtttaaagaacatattcactagatgccctagctagtagagacaccaacactccctttggtcctctaaataataagatttgactagtttctttctaaggtgagtttcatttttaaagtgtattgtaataggtaatatatactatacaatattgtaatatgtaaatagacacttggtgttagaactttgtcactgagtatattgtcaggaactttagaaaattgtagcatacaacactgatggagagtcacc

SEQ ID NO: 244385 - DNA, 366 bp, Homo sapiens
ctcctggttctcctgtctgtaggcttctgaaagctttgctgccctaaattcctgtccttggtctctgttgggaccatgcctactgactgatgctaacctcggggtctcttctgtcccctagtgattcaaaccagctatcctgaaactgcttccacctgggcagaccagggaccacaggaaccagagaaatgaaaagtatcacttgagaactaaattggggtgttttgcttttcccctcctcctaggttgtgtgtgtgtgtgtgtgtgtgtgtgtttcttgctaaaatgcagcaaaggaaggggaaacaaatacaacagtgcacggcagagtccctgctaataaatgtatataaaagaactgagtgc

SEQ ID NO: 244386 - DNA, 290 bp, Homo sapiens
gaactctttatatcttgttttctcctatctttctgcttttagaatcttttccctatctttgaacttcgagtgtttgattataatgtgtcttcaggtattttcatttgggttgaattggactgatgacttttgacctttttgcacttgcatgtatttcttccttcaggtttggtaattttttatgttattatttatttgaataagttttctagtcctttaactttttaagttctctcttttattctaataacctaaatatttgctcttttgatactgccccataagtccca

SEQ ID NO: 244387 - DNA, 598 bp, Homo sapiens
attcttttaaagttgtgtttcgtcatacagaaatgttaactcctctggattttgtaggaaaataactctataagaatcaatgagaattttgaaaaatgtgggtagtgaaggtcttaccagatatttaaagcagaagttctcaagcattagtgtacaaaaacctgcatggttgcattttaaaaatgaatctgtcacaggagttttcaatttttaggtattggggcagtaaggaacatagggaggcatatctgaggaatcttcattttaaatgacctctaaggtaattctgatatgattggtccatgggccacatttaagaaacattgcactttgggaggccgaggcgggcggatcacgaggtaggagatcgagaccatcccggctaacacagtgaaaccctgtctctactaaagatacaaaaacaaaattagccgggcgcagtggcgggcgcctgtagtcccagctactcgggaggctgaggcaggagaatggcgtgaacccgggaggcggagcttgcagtgagccgagattgcgccactgcactccagcctgggcaaaagagtgagactctgtctcaaaaaacaaaaacaaacaaacg

SEQ ID NO: 244388 - DNA, 441 bp, Homo sapiens
gttgttcttctcatggacctgcaggttgcagcagcagcatctgagcaaaacagagctgttctgagcagtagggcggggagcagcacgtctttgtgtggaccagaatgcaccagcctgtgggtgtatcatctcacactctacttcctagactaaggccctttcttgggcctttcagtgaatccaacccaggttggtattttgtgttgtcccccaacccaaacaaaaaattcatttgcacttaaggaagaacaagagtgacttgattaaggtatcaagttggtaaaaatggaaaaacaatttgatttagagagttaatgaacgaacatctttctttgattcttttcattaacattacacatattaggtaaactgtgtataggtgtttatttttctttatggaagtcacacatgatctatatagaaaaaatttcaaatacatca

SEQ ID NO: 244389 - DNA, 1442 bp, Homo sapiens
gatattgcaggcttaatccatgttgctcacaccttcatatagcagtgcctcttacagaataaactattgttaaataggaacccatcttgtcaatcagttgcttcatgcccagggaagagagtatgttttataggctttgtgtgcagcctgttaggccagcgtttaattgacatagactgttgtttctcaaacaacagttctattacgtacgtatgcaagtaatttctgtgcttcaaggagcttcagagagattgccttgttcaaagccctatggttattcaaatggtagagccaaaaatttgatctatgttctgacttaactccatgggctttggaccttggcagaggaaatggtgtctttgaactgtagtctgtagtcctagaaattgaataaactatttcctaaatagaggtaagagactaggatcctagcaacttctctaagttaacaaaaggggaaaaatatccccataccatttttctcttcattctattaatgagggctagagtcgtttcatagattgaatagtttcaagagcatattgagcagtgcctggctaacagctgaaagtctgccatttcatgcaactttgttaggctttagaagtgaagcaggaatatagagaaaatacagcttctcccacccacaacgtgtattttaaaccatttcttctggcccagaagacaaacttttccaaatatcttgggaaaaccacagtttctactctttggagacaagagtctcactctcacacccaggctggagtgcagtctcaactcactgcaacccctgctctcaggttcaagtggttctcctgcctcagcctcgtgagtagcactcgacaccacacctggctaatttttttgtgttttttgtagagatggggtttcgcgtgttggtcaggctggtcttgatctctggccacctcagccttccaaagtgctggtattacaggtgtgagccactgtgtctagccaagtttctactcttgatgcctgccatggactattacaagcacctggcagtgacattgcacgagttctaaagaaagacttggtctttcccacagggacattaatgtgaaagaggtccagtgacaaagattcagtcacttttgcagaccctcacaagccacaataatgaagttgcagtgaatttgggacatagccttccctccccaaaattcttgatccaagaatccacccgtcaagttcaatgactcagactccatttctagtgtggtcgttggttaacaactttactagtttccatccaggcttaacctttctatggaccataatgtcttggtgtctgctgcatttattgtccctccctgttttaaggatacttaagtttttaaagaggcataaatacttcaaagtccccattggccctcctgggggaaattacctcaaaccacagggtagtctgctaaataacc

SEQ ID NO: 244390 - DNA, 275 bp, Homo sapiens
tgaaagtaaaataaataattttattcttaattgatgtaacagtttgttcaaaataataatagcagcaatgtatttgattttacatacacacatacacacacatatattatactcccatacctgtgggttccccgttagtggattcaaccaactgtggatcaaaaatattcacacacaaaaaagaaggccaggcacagtggctcacacctttaatctcaagtgctttgggaggccagtgtgggaggatcacttgatgctaggagttcaagaccacc

SEQ ID NO: 244391 - DNA, 1004 bp, Homo sapiens
tggaggtttagctgaatcctaggatcaggaaagaatctgaagtatccttacattacacacctcttccctagcgtcagtctcccaggccctgccagtattaatacacctgaggaagaaaatagggatgggaaatccagggcccaataggaaagggaaccgaggtctacctaactatcactaaaccctagccagtgattttgaaatgcactttttcaatattctcagatatactgagagaatatgagagatctatttatagactgctgtaaggttgaccttttaaccttttgtgtgttcacactcataaaccagtctataaaatagatcttttatattcaactatgcatttaatctgttctcaggtaataccttaccaaaaatttaaaaaggttttttaaaaaaacacaccaatcgttgtcaataaagtttatgaaaagaattaagtgataacattattttaggccaggcgggtcctcacactctgggaggccgaggcgggcggttcacttaaacccaggaattcgagaccagcctgagcaataagagggaacctcgtctctacaaaaaatacaaaaattagctaggcgtagtggtccttgcctgtagtcccagctactcaggaggtttaggtaggagaatcgcttgaggccgagagattgagatccaggctgcagggagccaaattcatgccactgcactgcagcctgggtgacagagcaagacactgtctcaaaaaaaaaaaaaaaaaaaaaaaaaaaaacacaaattatttaacatctcagattcctgtttttgtttgtatgcaaaactaccatctgattgcctaagcctgtagtaattattgtttaatatttgacatttcctgcatttccaccaagtgctttatgactttagttactttctacctagtaagtttgagacttgtggaagccaattgagaatgacagacgtgcatggggagttcttcaaaagctgtgtgtaaattaaatatttttaaaacgtta

SEQ ID NO: 244392 - DNA, 396 bp, Homo sapiens
aagcctgccactgacattgaagaaccaatatatacaatggacaaacaatccagtgccggcggggtgaagaggagcgtcccctgtgattccaacgaggccaacgagatgatgccggagaccccaactggggactcagacccgcaacctgctcctaaaaaaatgaaaacatctgagtcctcgaccatactagtggttcgctacaggaggaactttaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctgatggctgtgtata

SEQ ID NO: 244393 - DNA, 540 bp, Homo sapiens
ctgcactccagcctgggcgacagaacaagacaccctctgaaagaaagaaaagaaagaaagagaaggaaggaaggaaggaaggaagggaaggaaggaaggaaggaaggaaccattcttgacttgtgggttatacaaaaacaggcagggttccactcctggcactaggtttgttcttgtgtttgttctctgttcagggttatgccacgcagagggtaggaggggaattagtccatggttatgtgtcctcacagatgaccactgagaaggccaccatgcctagtcgtcacgactctaggcccagcaacttgctgaagactctgcagtgctggggacccaggcatttttgtgaggctgtccacaccctatctgcctgtgaggactgggcagtccatctgggggtctggctgcctctcctgcgtgctgctgggaggctaggcctgactgtcattgctctacggccacatccccagccacgctcttctttttcttctttcagccacgtcccagtctttttttaaaagtcagcttccattctaaaga

SEQ ID NO: 244394 - DNA, 586 bp, Homo sapiens
atctgtggcctggaccccaggatccaaccccctaaactccttctaggcaaccatcttgggcaacttcacccaatgacaacctatgctcctcctgttattgacagccctgaaaaaatggagttcaaggtcataggccccattggacctgatatcttcaccaggctcctgagaacccaactgagcagccctgtcctcagattccagctcggacataacattgggggtcagaaaactgactcccaaggtacaaactggaacagccagggtgagtgccagcacacaggatggcttcctcatcataggccagagtctggccctgggttagcaagttcagggcagcctacaagaggaatgagctggaaagagctgtggccaacccagggaggccccaaatacaccaagtcccaggtcctcctgctcttgtcacctttctacagtggtaagacaagacacattgtctgaacagtcccagttcagaacttctgtcgtggagcctgtagtgctgcaaaggttgaagacagtggcttatacccagctcagttctttattttctctctttctctccttccttccttccttccttctc

SEQ ID NO: 244395 - DNA, 843 bp, Homo sapiens
  misc_feature (817)..(817): n is a, c, g, or t
  misc_feature (831)..(831): n is a, c, g, or t
ctgcactccagcctgggcgacagaacaagacaccctctgaaagaaagaaaagaaagaaagagaaggaaggaaggaaggaaggaagggaaggaaggaaggaaggaaggaaccattcttgacttgtgggttatacaaaaacaggcagggttccactcctggcactaggtttgttcttgtgtttgttctctgttcagggttatgccacgcagagggtaggaggggaattagtccatggttatgtgtcctcacagatgaccactgagaaggccaccatgcctagtcgtcacgactctaggcccagcaacttgctgaagactctgcagtgctggggacccaggcatttttgtgaggctgtccacaccctatctgcctgtgaggactgggcagtccatctgggggtctggctgcctctcctgcgtgctgctgggaggctaggcctgactgtcattgctctacggccacatccccagccacgctcttctttttcttctttcagccagagggagccctgaattcatgcagaggagtttttctaccttccatctgcttctgcatatcatcttgtctacttaatgcccctccttccggatttatagaacagtatgcataatatgaccccaactgcattccaaaaaatagatgtagatgtaagcttagagatgcaaagaaactttttgagagaattcactatgcttctcgcgggtggtgacacagttcaaggaggttccatggggtgtaatgtttatctttctcttttgtccttctgatcattgaaatgatgctttgtgtgtgtgaacatgtattacttttataattnaaatagaaaaattnatttgaatggga

SEQ ID NO: 244396 - DNA, 1011 bp, Homo sapiens
  misc_feature (985)..(985): n is a, c, g, or t
  misc_feature (999)..(999): n is a, c, g, or t
ggacataaaataggaaatatttattattcacctaataaaaacataccaaaatatgtgaagcaaaatctgacagaactgcagagaagtaaatccaatttaatattcagagatgtcaacaatcctcttaaaataattgctagaaccaaaaccacagaatgtcaataaagatagaaaaaacttaaataacatcaaccatttttacctaatcaacacttgtagaaccccttcatcaaacgagagtacagtatacatttcaagtgaacatgtaactcataccaagatagcccatattctgggccacaaagcaaatctcaataaatgtaaataattcaagtcttaatgtactctgaccacaatggaattattgcagaaactaccagaaagataagctcccctatttactcgtgccgaattcggcacgagccactgagaaggccaccatgcctagtcgtcacgactctaggcccagcaacttgctgaagactctgcagtgctggggacccaggcatttttgtgaggctgtccacaccctatctgcctgtgaggactgggcagtccatctgggggtctggctgcctctcctgcgtgctgctgggaggctaggcctgactgtcattgctctacggccacatccccagccacgctcttctttttcttctttcagccagagggagccctgaattcatgcagaggagtttttctaccttccatctgcttctgcatatcatcttgtctacttaatgcccctccttccggatttatagaacagtatgcataatatgaccccaactgcattccaaaaaatagatgtagatgtaagcttagagatgcaaagaaactttttgagagaattcactatgcttctcgcgggtggtgacacagttcaaggaggttccatggggtgtaatgtttatctttctcttttgtccttctgatcattgaaatgatgctttgtgtgtgtgaacatgtattacttttataattnaaatagaaaaattnatttgaatggga

SEQ ID NO: 244397 - DNA, 897 bp, Homo sapiens
tgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtcaaagtctgaaataagcctgtcttttaatttcactgactccca

SEQ ID NO: 244398 - DNA, 459 bp, Homo sapiens
gtaatgttaatccttttgcaccaaaatatctctttaagtctaaattatccacttttttttttaattcttcgtagagatagaggtttcgctttgttgcccaggctgttcttgacttcctaacttcaagcaatccttctgcctcagcctcccagagtgctgggattataggcatttgccaccgtgcctggtgtacccagtttctgttatcaacagaatgcagtggtgtatggttgctaaagggtcccaagatcaggacctacgttaaggtggattttgaattatttaaaattctgattttgttttatttttaattaatctttgggggaaggatgggaggggggtgagggttgaagaagtaaacattgtacctattggatacaatgtttaatatttgtgtgatgggcacactggaagcccaaacctcactattacacaatacattcatgtaacaagcctgca

SEQ ID NO: 244399 - DNA, 244 bp, Homo sapiens
cccttagggagggcaatttggtaatatctgttaagattacaaatgcatataccctttgacccagctatttcacttctgggaatgtatcctagagttatcctaggacgcatgcaaaatgatatacctgaatatctattgcagcattgttaataatagcaaaagattggaagcaacccaaaacttccatcaataggaggcagttttttcatttcattagcttgcttttatggcttcacagtgggga

SEQ ID NO: 244400 - DNA, 307 bp, Homo sapiens
ttacaccactgcactccagcctgggtgacaaagtgagactctgcctcaaaaaatgaaagaaaagaagaaaaattaaaaaggctcacataatctataagtgtccgaagtgtcctttggaataaaataattttcacattgcagttggtattaaaggtaaaataaccccccctgtttcatttaaattaaatatatctcattaagaatgtttttaaaggaattttcttcttagaaaatgtctttggaacaattcttacagaagagtttaggatgttacattttccataatggctaacttatattgaatgtc

SEQ ID NO: 244401 - DNA, 507 bp, Homo sapiens
aaatatctcatgattttgatttgcatttccctaatgacttatcatgagtatttttcattgctatgataattgactatatatatgttctttgaaaaaatgcctatttaaatgtgtactgggttgaattgtattctctcagaatctcatgtccaccctgaaactcagagtgcaatttggaagtagagttttcagagttatgatgaggtcacactgcactagatttgaccctaaatctgattacttgtgtccttataagaaagccacgtgaagaaacacttctgcatacacgggaaagatgggtatgtagagatggaagcagaaattgtagtcatacagccacaagccaagaaatgctgaagaattgtcagcaacagctagaatcttagaagaggcaaggaaggatgctcccctagaacctttggaaggtgcatggccctgtctatgccttgatttctgacttttagcatacagcactgtgagagaataaatattttttgttgaaaaaaa

SEQ ID NO: 244402 - DNA, 317 bp, Homo sapiens
tgtgctaggcaataagggtgtgcagatggacaagatagtctgccacaggaacttatcaaggtggcctccacaataggtatgggtatatggaaacatatatccaaatctcaccaatctgaagtaattctttaccacagatttgtatcaccaacataacatgtatttggatagttcaaagaactggaagagctgggcatggtggcatgtgcctgtagtcccagctactcaggacggcaaggtaggaggttcgcttgggcccaagacattttgagttcagcctgggcaacatagcgagaccctgtgtccaaaataaaaaa

SEQ ID NO: 244403 - DNA, 455 bp, Homo sapiens
gtacatgtttattgatttctgtatgagcctggtaataagctcactaaattaatgccacctaaattgttccttggtttactaacaaagaataaccatatttttatggtccaaatgccaggtttacataagaggctcatcaagaaggaaaggaaaaaatggttgcaacttaagtgattttccccttccacttagtcctccgttcatagggcccaatagcttcctatcaagcatctcaaaatctttctgacacctggatttcaagattttccattacttaatgcatcctcttgaaagtatccccacacttttccactacccatcagcgggatgccattcagtaatggaagctacattccatgagagcaagaacctcatctgtatctctgtgcctgaaggagcctgacacatagtatttaataagtactcaataaaaatctgctttatgaaaatagcct

SEQ ID NO: 244404 - DNA, 659 bp, Homo sapiens
tcaggaataaatgtatatataatttgtgttacaattataataaactgcagctgttctttgatagatttaccctatataatttaacactgattatatggaagaatgtatatctacttcatctagctataaaatatttatattcataatcttttgatcttatgctttcttcttgaagtaggtaggatattctattgaattaaaataaatcctgtggggtttgactttgaatttgacctacaagtcaaaaaaaaaatacaaatattactctttttttggggagagtggtataaattaaatttcagagaagataaatttccttcagttcagctctgattttgattatttcttgtcttttgctggctttgggattgttcttgcttctctaatttttttcagttgtgatgttaggttgttaatttgaggtctttctaactttttgatatgggcatttagtgttatgaatttccctcaacacagcctaacactcatgacatgagtttacctatataacaaacttgcacatgcacccccaaaacctaaaatgaaaatgaaaaaaaggaagagaaataaaataaaaggcttagctttttttttggtaatctgcacaattttgctatgttcctgcaataaaataaataaattttatttctaatgaaatt

SEQ ID NO: 244405 - DNA, 395 bp, Homo sapiens
tgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatg

SEQ ID NO: 244406 - DNA, 585 bp, Homo sapiens
tgcttcaggccatctggatgtatacgtgcaggtcacaggggatatgatggcttagcttgggctcagaggcctgacaaaattatctatcacatgtaaaatatatttcaaaaaaaagtaaaatacagtagtgccctcacatccatggtttcactttccacagtttcagttaccctcagtcgattacattgcatgctgttctgagtagcatgataaaatctcgcaccattcagctccaccccacctgggatgtgaatcatccctttgcccagcatatccaagtggtacatcccacccacccgttagtcagttagtagctatctttgttattagaatgactgtgatgggtactgtgatgggtactgctcgtgttcaagtcatccttagtttacttaatgatggccccaaagcgcaagaggagtgaagtggcgattcagatgtgcatacaagtgcttcctttaaatgaaaaggtggaagttcccaactttaagggaaaaaaatggcatgctgaggttgctaagatctacagtaacaatgaattttctatccgtgaaattgtgaagaaagaaaaaggggctgggtgtggtg

SEQ ID NO: 244407 - DNA, 505 bp, Homo sapiens
gcttgcaaaagcttaatattattctgaagtcatcgtgcagctcagcgcattaggaaagaaagctcaacgtgcaaggtttggttaaaacatgacattagcctggaaaaggaaagaccttagggacccaggtcagttgcactctattatttccaaccctatattgctcaaattgtgctcttgccctcatattctgagacagccatcatcagtgtggaatcacccaacaatgattcatgcctcagctctgacacttttcttttctcctaaggtagggatttgagctctgagagctttcctgccccacatgaagaggtgcagctaagcagaagagaggactttttttcccccatagaaggaccacttaacaaatgatgaactctaaactctgacacaatgcactgtttatttatggtatctatctaggctattcatggtgttttcatactttaaaggcaagagccatttagagaaagcagatgatttataaacctggggacaactcaac

SEQ ID NO: 244408 - DNA, 270 bp, Homo sapiens
gatggattgagttttttttgctttttggctggtgtgaattgtggttaaatgaacattcttgcacaagttttatatggacacttgttttcacttatgttgggtgagtacctgagagcggaactgctgggtcatatggtaattctatgtttaacttattggggaaagccaactgttaactatggcggctacactatttctattcccacctcaatgtatactggtgtcattttttctatatctctgtcaagacttgttattttccatcgcttt

SEQ ID NO: 244409 - DNA, 402 bp, Homo sapiens
cagtaatataagtatttttgtcatccatgactaacttttaaaatggcaaaattataaatatctgtaaagtctatgcgcagttgttactgattattgtggcaataatacataaagaacatgttttttgttttattttccacccttatgttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaac

SEQ ID NO: 244410 - DNA, 451 bp, Homo sapiens
tgacatgaaatgaggctggcgagggtctgtgtgttacgtaacatcttctcgttccgcagtgtgggtggctaggcagatgtgatgactgctgttggcgtcggtcccctgacattgttggtgtgtctcaattgtgtgccagtccctgagacacccccacctcaagttgctcagtttggaccctcgggcgtcagtttgtttccctgtcctcacccagctcttccagtgcgtcaacaagcccagatggctttacctccaggttgagtcctcactccttcctctctcttgctccccaccccaacccccgcctcattgtccaggccacggacacgtccttcctggtgatccagccctttcagtagcccatccctcaatgcagtgttgccgccttaccatccatcccctagaccatccagtgcggtcactgctggcctcttgcggctgtttaaattga

SEQ ID NO: 244411 - DNA, 407 bp, Homo sapiens
agtactttaaaagcacatacagaaagatacacggatgtaatacctttaattttttaaaaattttcttttaacctcagtttttttctaaacaaaccaaaacttaataataatggcataggaattatttcaataaaatgtaaaatctgttagtcagttaccaaaaagcaaaacaaaagaccttctgcagtgcacaaaatattatgttggaagaaaacatttcctttagacctgtattgttagcatcaggccacaacaaacagaactcgagggaaaaaaaacttacatgagctgaaaatgagatgaaagtgagcattactattttacacattttaaaaggggagagaaaaccaaaaatggtgagatgcaataaaagttgaactttgggttaaaaaaattaaaatgtctta

SEQ ID NO: 244412 - DNA, 442 bp, Homo sapiens
agtttgttttccttgtttttttctaataagttctttctttttccaagcaagtggtgataaatatttactggtagctttagttagtaaagttctttcaaataacaccttgggtgtttgagcattggtgatttgttttccttgaagatgtcttatgtatctttattacttgaataaatatcatcatgtagttatttacctgaattgataatgctgtgcaaaggagctaaagtatcctctctaaaaatatttttttttcataattttggcctttcattcctttaaccatttcctctcaccaaaaattaaatcttaaaatttatggacagttactctaaacagataaatattctccagggatgattaatgtatgatttttttattttattatagatgcctatattgatggcacagttctcagggaacactctccacccacccaaaa

SEQ ID NO: 244413 - DNA, 325 bp, Homo sapiens
aatgaagagaatgccagtatcatttcacgaaaacttctgggaggaggaagtagctcccagtgaagcatgacttctgcagagaaggaagctaactctaggacatttattttatgtaactatagtctatagataagcaactgccacattataggcagataaaaatagtgtacattcgaaaaccaatttatactgcagagttccttgtgagttcattttatctgtatccgttataatccaaatgcaagagtagcattactttttttaatgaggcatacttctgggcttttttgatttttaagcatttcagagaataaagggaaaagag

SEQ ID NO: 244414 - DNA, 345 bp, Homo sapiens
agaaatcacacacatacactcacacatacaccgccattattgcagaggaacagagatcacacacactcagacacacttacatacacacccccattattgtagaggaacagacagagatcacactcacacacacacacccattattgtagaggaaaagcgatcacacacactcatacatacaaaccctcattattgcgaggaacagagatcacacacactcatacacactcacacatacagacacccattattgtagaggaacaaaaatcacacacactcatacacacacacacacattatggcagaggaacagagatcacacacgcttatacacactcacacaca

SEQ ID NO: 244415 - DNA, 2613 bp, Homo sapiens
ctggaactgcttcctttttgttttattatttttccccagatgagctgactgggccatggaactgcatccttatggttcccatagcaccttaccgaggcgcccttatcaatagagttttagttatgtacctgtgttcttgtctgaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagttatacctacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtatttcttggccatactgacctgtgccattccagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggcgcagtggctcaagcctgtaatcccatcacttcgggaggccgaggtgggcagatcacgaggtcaggagatcaagaccatcctggctaacacggtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaa

SEQ ID NO: 244416 - DNA, 627 bp, Homo sapiens
ggagggagggaggaagcaagcaagtgaacaaatgagtctgggatttaggacttgccagacaaacaaggcccaagaggcaagtgtgcaggtgggtgtagttgggagtcagcagagttgggttggaattcaagctttgccacctgctggctataaaccttggttgggtaagtaacccaaggtaaatgagatcatctctgtaaaactcttagccttgtgcctggcacatagtaaatgcttaataagggttcactgttagtattactgttactgataacatacaaatagattgtattaatggaccataattgcaactgtataaaacaaattccatgtttggccaggcgcagtggctcaagcctgtaatcccatcacttcgggaggccgaggtgggcagatcacgaggtcaggagatcaagaccatcctggctaacacggtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaa

SEQ ID NO: 244417 - DNA, 432 bp, Homo sapiens
agagtggtggagaaacaacggaaaacccacgtaagagagagccagacagattgagagtggcaagaagaaacagaaatggagaaggagcaaaagagagagaaaggttgacggtggacgggcagactaagagtgtgagcaagggacatctttccttgcaaactccatggtccgctgcccagtaactctccaaggctttgccatatttcagccacggaactggggaattgggaaagttttctcatcacaggtccgggacgagtgagcattgttcccattattgctggcattctctgcgaactggacattagccagcaggaaattcctgggacaaatctttccactcagagtttttttaaaacttttatttatttattttaattttttttctttagggacaaaagaaaaaaaagatcaagaggcaaaaagaaaaag

SEQ ID NO: 244418 - DNA, 336 bp, Homo sapiens
cttgcctattcaatactgtttctttgacttctgtgtctgtttttaattgttcagctcttctctttccacccacatccccaaatatgcagtgagtagccgttgggtttcacgttgtaattggaaaaggtaaaagccagcctgaaaataattctggcctgttgggaatgttggcttcatgttttgagaatttccctcgtgtccctgacttcagagttaactatttctttaatgaggactaacatgttagtgttgtctctgaactttatttgcagtaattcactaatggaagctttcacagccaactctggtaatgaatgtagaacagcgaccttctgt

SEQ ID NO: 244419 - DNA, 595 bp, Homo sapiens
actaatacctctttcagggttgtagtgggttgaatagttagtggccctcaaaagatatgtcagcatcctaacccactcaactggtgaatgtaaccttatttggaaaaagggtctttatagatgtaattaaggaacttgagatgatcctggattttccaggtggacactaaatgcagggacaggtgttcttaagggaggaagagcaggcagccatgggaagacagcaagagaatggaggtatgcagccataagccaaggaacacctggagtcaccagacactggaagaagcgaggaaagattctccctagagcctttggagggagcgtggccctgctggattttcaactttagcctccagagctgtgagagaataaatttctcttgttttaagccaccaagtttgtggtaacttgttagagcagcctcagtagccactaaataaagtccagttgattagggaaatctatctggcttaactaatgataaaaacaaatttaagaaaataattcctttgggaggccaaggcagcaggattgcttgaggctagatgtttgaaaccagcttaggcaactaagcaaaacgccatctctgcaa

SEQ ID NO: 244420 - DNA, 536 bp, Homo sapiens
ttcaacttgttaaattcagtgcagccctgttccattgatcagaatcctatttaagtatgccttccacagcgtcacccaagtcatgataaatgcgtatcgaagggacccctctgtcacactcctggagacctcccctcagtggacttgcgatctttgaccgactgactttgggaagagtgattgaagccgcccctagcctagtctctgtccttttgcttctctgacctaagacgcctttctgaagctagataggccatgcccattgcagttctgcatctactatcaagtgcttcatcaaaaaggacatgaacagccttaacgttacgtgttctcagctcctcgagggctccaaggttgctttcagctgttcctggggctgctccccagagattgcaccaggcagcttagcatctcatctgtgaacgttttccgtgctctgggaggtcactttcccgggctaggggacttgaagtcattgcaaatgtctaaatatcctttttaaaaaacaaaacaaaaacactaaacccctatctcca

SEQ ID NO: 244421 - DNA, 597 bp, Homo sapiens
ttttttttcttttgattgctcttcctctttttacttctggatatatgtgagcaccaagaaggttttcatagagccatctcgccgccaatgccaacagctccaggtgctaactcagatgtatgagtttcacattgcacaactttagctcaagcatctcttctgagctctaaaccacattttcacctgcctatttggtgtctttttgtggatgtacaaacctcacctcaaactccactccatacttccaaaactctacattttccttgtctcacagttcggctcctcagatcaccaagcaccatgatttttgctttaagcagctaaagcacttagagaaacacctccacaggtttccattgcacttaactgtcacactttcatcgaagagatggtcataaaaagaaaatgtctaagcatctgtaaattcatttttgaaggcactcatcatgttgtttcaagatcttgctaagcttaggtgcttgaacattattcctgaatccaggaataagaaaatttgaggttgagtttcaactctaaaatttagcaagctttgcaagtttaaagtattatttttttgcctttgaaattcagtttcct

SEQ ID NO: 244422 - DNA, 1591 bp, Homo sapiens
  misc_feature (5)..(5): n is a, c, g, or t
ctgcngtattcacaatagcaaagactctggaccaacccaaatgtccaacaatgataaagtggattaagaaaatgtggcgaagatggccgaataggaacagctccggtctacagctcccagcgtgagcgacgcagaagacagttatctggcactggaactcaaatccagattggaacccttatctggcccttggacaaaacagtcaatcctttctgcatgcgtagaaacctttgtctgatcttcagttgacttacttttttgggtatttggtggcgagttcaacttctggcctaacactgtgtagaaatttgcactgaggcatggcgaggacatattttcttcctatgtttctggctgtagtctctaaggctgggttataattccaggctgcttttgaaagacatctcctgggctggctgtttatcttcctggctccctgttttcagtgggaattcacttcctaactcctgtgctggaatgttcactctggcttcttgtgagacctcttcattctatttgaacttactcttcccacaggaactccacagttaaaccccttttgggttcctactctctatatatactatgacactaaccatgtctgcttctattttaggcaaaatgactttactgtggataattcggaactgcaatggtttatttgaaaatcttaagatctgcctaaagtggctcttataggactgctcccttcccatttccttcttttttccttctttcttttaccatcttaactttttccattgaactcccctgacactttgatatgcacctcttttccattaaacacccctgacttttgatatatacccatccttttacccctaccagatgtttcacttacctctttagcccctcgactccctatagtcactggaacgtatgcctcctgattcacagggggttctcgagagactgatgcacacacaaagcaacacacggggcttcctggaaacagagatataatctacagcctgtgtaagattacattttaggtgaaaaacccacaaataccccaaaatatgttactaattaaaatctgtcctcactaccttaaccagtgtctgggctttacctttgaaactggtgtccttatttaaaaaaagttggacatgcacccaggaatattatcttttgaagataaaggaatagattgaagtaatgctacttcaagccaaggaatgccaaaggttgtcatcaaactaccagaatgctatggtacgcatagcaaatgaatacatcagctttcaacaacatcatcaaaaattacaagtcatggtagcaggcaaaaaatatgctttaaaaagaaaaacaaaattagaaaaggacttggacatggcaagccaatcatgtgatttcttgatgtttcttctgtgttttctgcctagaaaaacccactgcactcactgctgggtggatctatctgaacctcttatggctctgagtgccatctgaaaaagatgatggttccctttaccttgagtcgttttccccagatacactagaacccattatttcagttcttttaggtctcttctgtgctattcgattatcagaaaagatttcaatgacc

SEQ ID NO: 244423 - DNA, 300 bp, Homo sapiens
gaaatctttacaaaatacctagtaagactttttacttcctaagtttgttatgttttctgtttactctttacttttaacattgttgtgaaggagtgagtatacttccagaaatctgaacagtaatgaaaaatttcagatttttagatgtttttgcctcaaaaattatactgctgttacaacttgtttattggcttttaataatgtgtctaatatagattattacaatattatactctatattaataaatatagagtaatttatattaatgaatatttttccatttgtgcaagcgcagtgcc

SEQ ID NO: 244424 - DNA, 1008 bp, Homo sapiens
cgcagtggctcatgcctgtaatcacagcactttaggaggccgaggcgggcaggtgatcacctgaggcgggagttgagaccagcctggccaatatggtgaaacctagtttctatttaaaatacgaaaaattagccaggcgtggtggctgtaatcccagctacttgggagactaaggtgggagaatcacctgaaaccgggaggcggaggttgcagtgagccaagatagcgccactgcactccagcctgagtacaacagagactgtacttaaaagaggtatcattccaaaaccaccaagctcactagaaaaggtgcaataagatgctttactgataattaaatatgtggactttcagcctaaagacagtttacttggggagtcactggtaatcagaacaccgatgctattttggactatatggtggtcctgtaattgttagagaacaattattaacataaataaaatctaggaggttggtttagcagttagactgttttgtatttacttatcaggttcattcatctattagcattgagaattttgactagaatttcaaaactaagaaacttagaataaatgaacacctattctaaaactttttaaaatggagttactcccacaaaagtagattcatgtattagctaacatctatgtgattcaggttaactcccaattcatgcattaacatggtaatttagggaaatttgggaataacttggaataatgctttgtggactaatgagagcttgatagttttcctcctcagaatataagaaaatatatgcttcagtgttagcttcctcaactttcaagagtcatatttaccgtctttccctcaaagagctatcacaaaaataatgtaccaaatgttcatacatgtaaggtattacagggtgaagtaagtctactttttaatgcaacatttattcttttgtgaaaataaatctccacataaaagcatgaatgaaataacgtcaaaagtcctctaggcagaattttcccaaaaaaa

SEQ ID NO: 244425 - DNA, 944 bp, Homo sapiens
agtaacttcctttttttaagaagaaaagcatgcaaccaagtaacttttttaagtaaataagatcataacctaatatacagctcaaaattaacagtgggtttgaattctagcttatttttttttcagtgtttcagaaggaaaagaaaagatttaagcaggccaaaacagtgactgccttttcgttggagtcaagtaaacttgagtgcctctgtgttaagctcttctacatactttttttcgtcgattcctaaaaaatctgtagtgagtcattatttccattttacatttagagaaactcaggctcaaagacagtaacttgccccataccgcacaattagtgacagacctggattttgagcccaggctctttcaatctaagggccctgtgctctttctaccagcctttcccttttactgtcactggcaataccaatagctcaaaatgacaaaaattaaagttttatattctccccaataggattccttaattgtcttttcatgggctctactctttttctgaatttcttctgttgttcaaacaatactaccatccaacgaagctcacttttcagttctatcagacatttgcattataaatgcatccagctaagagaagttaataagagactaagaagctgtaagacaaaactgacagaagcagtaatctaattagtcagaaagacaagactaaggtcaggcaattcaaaaacccttcttttttcctttattagaggccaactaaggcaaggaatataccttttagatgatccctaatatttacagattaaatccaccaagatatctatttgcctgtgcaagagtcacagtgcacacatgaaacatctctagtgaatccaaagtggtctgaggtccctccgtgccttcctctcactgttcacaacatctgctgacttgttacctacagcctcccctattgccagctc

SEQ ID NO: 244426 - DNA, 318 bp, Homo sapiens
tgattttttcttttgcttgtggcactggctcatgcttggacatttacactctttatttagcaagaaagcatttgaaaggtacctttcaaatattggaggtaaacaaaggtcagtctttcctaagcaagagtagcaaaattaaaaatatgttaattttaacttgccggttcacagattgatgtatcctccattcacttgattactttttttgacccacacctgaaaacaaagctcttccagtcacttgaagatgaagaaaaagaaaattttaggtacagaggcgttctggtggtatgagaatgagctgtgccatggttt

SEQ ID NO: 244427 - DNA, 666 bp, Homo sapiens
ctctcttgcacttacagcttttgtcaaagtttcctccttctactggtcagaattagtgaccaaactggacatagatccctgtagaggtcttagtttctcaaagagtgggagaagaccatctgctccagggaagctaaatgaaatgaagattccagggcctatccagaaccaacgaatcagaagccctaaaactagggatgcgagatgtgcatcttatcaaaccactggcccacgagctcctaaaacaaccttaggagagccagatttctcttaccagaacattctttgtgatttcaagtcaggggtctgtctcatgcctccttcttggtctggggtaggaagaagaattgtttgttgggggacatctcataactaaaatcttgcaaacccagggcaaagttggagcctggcctcatttgcatgcaggggatggcatcagacctagcttgctatcttaatgagaagtcagtgtccctttcttcctcttaccccaccctttcctgggccctttcgaagggttgccaggacaccaggactggtatgagatgactgctcagttgtggttggtggccaggattctcgattgcaagcattctcaaatctaaggatacttctggaattgctggcatacatttatgtttattattgcattcatttttccaaaat

SEQ ID NO: 244428 - DNA, 516 bp, Homo sapiens
atgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaagggacgtggatggagctggaagccattatcctcagcaaactaatgcagaaacagaaaaccaagccctgcatgttataaatgggagctgaacaatgagaacacatggacacaaggaggggaacaacacacactggggcctgtaggaaaaagggtgcggggagacagagcattaggaaaaacagctaatgcgtgctgggcttaatacttaggtggtgggttggtaggtgcagcaaaccaccatggcacgtgtttacctttgtaacaaacctgtatatcctgcatatgtaccctggtactt

SEQ ID NO: 244429 - DNA, 476 bp, Homo sapiens
agattgaaaagtcatttctgagaaataaatataggagcacaaaagactcaatttcttcaatagatgaaaggcatgaagaaaagagaggaactgctgtggtttaaaagagacttaagagacacatcacccaaatgctacgtggaccttctttgggtcttgattcacacatgataagaccattaaaagatattctggagacctgaagtcaatgaaaatagacttgatatttgattttattaaggaattactattatgttggggtgataatgacatggttgttttaaagccacttacttgttaggaatgcacattgaattgtcctatgttctatgtttggtgacttccaattatggtaacactatgtgccacgtgcttgctgaacaagacattcgaggtccttgcccccatggagctcatggattggtggaagagacagatgttaaataaacatttgcccagggaagcatttaattgaa

SEQ ID NO: 244430 - DNA, 449 bp, Homo sapiens
caatgaatactacacagctataaaaaataacatcatttcacttgcagcaatatggaaggataattttacactttatgtcttagtctgttttgtgctgctgtaacaaaatacctgagactgggtaatttataaaaaatagaaaattattttctgatagttctgtaggcaaggaagtcaatgatcaagataccagcatgtaatgagggccttctgttgcactctcagatagcattagtttaaatggcaagagaaaggcagaactctatttgagagggctgttgcaaccttacagcatgatacatcttgtgaaatatggttttgaacatttttattaaaaatgtaggcatcaaaatctctaccatttgtgtcatgttataataataactataaaactgcattattcagaatatgtaacaataaaaattaatattaaaaagttttaaaatgta

SEQ ID NO: 244431 - DNA, 248 bp, Homo sapiens
tcgtccacctagaacgggccccaggcctccagatggtgagcgtttatgggatcccgaggctcccctcccccacacccttattttccagatggggaaaatgaaggccagaaacaccctgttggaagttacgctgcggatttgtggcagggccagtatgagccctgtcactaaccccttcacccgctgtcccacccacctgtgactgtcctcagacagaggctgccccgggggagagggctcccaccacc

SEQ ID NO: 244432 - DNA, 153 bp, Homo sapiens
acttcattctatattaaaacatcaatgttgtacaccttaaatatatgcaattttagaagaagattctttgagtagctatcattaaaataaaggctttgcttttatatcctcagctagatttttcttttttttttttgagatggagtctcactc

SEQ ID NO: 244433 - DNA, 787 bp, Homo sapiens
acagggtctcactgtgttgcccaggctggttttcctggcctcaagctatcatcctccaggcctgggtctccagtagtgtggggattttctgaggaataaatcaagattctaattctgcacagtcaactccatatttttaacatttaagggttctactcatgtatagtagaaccataccccctggtagaaacatacctccctttttaaggcaaacacaaagaaaatggatcaatactcactgtatcggtttaatttccacaactgttatttcagttaacatagatctaacattccaataataaccaactctgaatttgcactactcccattatctttgaggtgtatcacagaattctcaagcccaaatttatttaaatccattttaattcagtatgcccctcatgcttcacagcattttctgggaagataagtgaagtgagaaaaatgatggcaatgacagattgtcaccagttcagaagaataatgaacaagcatgattggcagaaaggctgcgagctctgagtcagaacgactgaggctggaccaccccaatggttcatagtggttagttaagagcacagagaccttcctgaaccaggctactggagtgctccattcccagctccttcagttactcacaggatgaccttgaggaaaggacttcacctctctgtgcctcacttctccctattataatagggataataataccaactacctcgcaggatttttaagaagactaaatgaataaagtgctttaaaaaaatgtttgctgtctcgggcaact

SEQ ID NO: 244434 - DNA, 544 bp, Homo sapiens
  misc_feature (39)..(39): n is a, c, g, or t
gtggctctcttcaggcactggagatagatttctttcagnctgagcttcatttgcagataaccctgtgaagaaggtattactcccattatctttgaggtgtatcacagaattctcaagcccaaatttatttaaatccattttaattcagtatgcccctcatgcttcacagcattttctgggaagataagtgaagtgagaaaaatgatggcaatgacagattgtcaccagttcagaagaataatgaacaagcatgattggcagaaaggctgcgagctctgagtcagaacgactgaggctggaccaccccaatggttcatagtggttagttaagagcacagagaccttcctgaaccaggctactggagtgctccattcccagctccttcagttactcacaggatgaccttgaggaaaggacttcacctctctgtgcctcacttctccctattataatagggataataataccaactacctcgcaggatttttaagaagactaaatgaataaagtgctttaaaaaaatgtttgctgtctcgggcaact

SEQ ID NO: 244435 - DNA, 270 bp, Homo sapiens
taccccactttccctacaagacaaagatcacctctgttgggttcctttttcatagtagctccagctactaatagaatgatctgcgtaagactgatgatcaggatgctcagtatttgtgaaatgactaccttctttcccctctttaagacttcattccctccctttacataactattaactctaagagaatggattttaaccccagatgtccatcagaatggcctacagagactttaaaacacacaaattctgattcagcagttctagggt

SEQ ID NO: 244436 - DNA, 306 bp, Homo sapiens
gtgtaagcaagcccttactgtggaatgtcattttttgattccttactaaccgtcgctacttcctagtctttcaaaatggtattttaggcctgaaaattaattctaagaaaatagttcaaatactagaaaagttgtggccgcaaaagtgttgattccactcttatgatagtgaaaattgttaggaaaaaaacacaaatgcccaacattttggaaattattaaataaattaggtccatcctgaagttggaattatatgaccattaaaaattacgctttatgttcttacacagaaaggtggatggaaaa

SEQ ID NO: 244437 - DNA, 382 bp, Homo sapiens
ctccagcttctcatcagaggttggctctattcaacagcttcagcccagaggcagtgacaatccaaggatctgccctcacgcgggggctagagttggctagtgggaaggcaggagggattaaaaaaaagtcagcaggcaggaaacagctgggctgaagggacattatgtggcaggcaagaggcaagaggtgccactggcccgagctggggagcaagagtgggtgatgcccctcccatcacacgggactggaagacccagagaaagtgaccatctggacacctgagccccgcaaccttggctctgccactaattagaggagtagctcggctttgagaaaaaaaaaaatttttctttgagcaaagtttttctcatctgcaatgac

SEQ ID NO: 244438 - DNA, 516 bp, Homo sapiens
aaattggaagcttggaattctatgcttacatgattgtagagtgattttgctcctcttccttctgttgtaatgatacctgacctacattttaagattttagtttagtaccaattatgataataaataaagggctcaatcttacatgtgcagacaaagcataactttgttaggaagctaactagatttttagacactcaagattatgaacaatttttctactcagccaaagttaccttgtattatgagccccaccctcatcccaacccaacaaacatgaatacgtttagtatcttgcaaatttttgtcttgttaaagacaaggtagagctatttattatatatctttaacccagcacgtagtacccaattcttattagtttactctattgcagtttctacttttctttatttcatagtttcaaaccaggatcccaggtctttcctggtgatactagttcatggactaacgaggaaaaaaaagacaatgagagaaaaaaagactaaaacgattctcttt

SEQ ID NO: 244439 - DNA, 685 bp, Homo sapiens
ttgagactgagtcttgccctgttgcccaggctggagtgcagtggcgcgatctcagctcactgcaagctctgcctcccgggttcacgccattctcctgcctcagtctccccagcagctgggactacaggcgcctaccaccatgactggctaatttttttgtatttttagtagagacggggtttcaccatgttagccaggatggtctcgatctcccgacccacccgccttggcctcccaaagtgctgggattacaagtgtgagccaccttgcccaggctctttttttttttttttaactacttcttaaggagcagggctacaccataggcagtgtgcctagagtagcccaatatcccttttgtgccaaaagaatctttttgagtttaataaagtaggatttttttttttaggaaaaatattaaaagacattctcaagcataaacttgcaaactagagaatgcaccaacggataaacatgaggaatattaaattgctgaaatgaatagaaatccctgtgggaacgttgtcttccactgctctctcctgtaacaaagcaaaaggtagcaaatctgctgatggcttgacttcgtgagtcatgtagcctccttccctgccctggttttggtgctaaccgtgccctcatctcttccaaaagacattcagcttctgacttgagattgcacagg

SEQ ID NO: 244440 - DNA, 402 bp, Homo sapiens
atgctgctgcaacaatactgcaactgtttttctacatctatatctctataataaatttctagtggttgctggataaaagaacatttgcattttaacactgatagctgttgctaacctccttactgtacacacacacaatgccactgtatacaagccatgaataacaagccaaactgaattgccatttatctgcaatctaccttctatcccctaagcctttctttcctctatctattgataaaatgtctccccccatccattctactgccattactaaatacacaaatcctgacaaattctttaaagatttaccttgccaggtgtggtggctcacacctgtaatgccagtatcttggcaggccaagacaggaggatcacttgagcttaggagttcaagaccag

SEQ ID NO: 244441 - DNA, 233 bp, Homo sapiens
tgccaaacattttgcaggagtttctcaccagcaagttcttgtgttagtttattttaccaacatcttttgtccggtttttctttagtaaaagtatttataattctgtattatacttccataggtagatcattgttgaaagtccagaaggttgagcttccatgatgtaatatgatatgaaatcttgtattgctagtggcatttggtaggaaaagggatggggagtggttaaaggt

SEQ ID NO: 244442 - DNA, 437 bp, Homo sapiens
tgaaagatatatacgaatcattgtgatgagttttaagaggttgctgagttcaccgttattttctgtgtcatttctatgtttaccgcctcagatcctgaaagaacaaaaactatcaggtgaggcaccatgacattttgtcacattaaaaaagattcgtaatgttggatcatgaatcagagaaggaaaaggagagaaaaagctggagaggcagaagggatttgagaaagagggtgcagagaaccaacctttgaagcaaaagccataatgagaactttgctcctgcccctaacatgacatctcacttcctatgtttcaccccagcagggctcacataagagaattttaatttgattcatttaaggaccactatcctgattggtcaaagcagaatttgaacttgaattgtactagaattgtttgagaaccacattccttgt

SEQ ID NO: 244443 - DNA, 545 bp, Homo sapiens
caatacagtcagttagggcaagaattatgatgtgcattttacaaacgtatgaactcaggtaaggagcagtcaaattgcccacttagtcacacaatcagtttgtggtatgagtgggaataaaacccagattcctaattccttgtttcctttaacgtggaacaaataagcagttcaagggtaataaatgagtcaatgagtgaataaaataactctcaatgagtcccacaagtgcgtgaaagaaagagcccaggtaagctgagaacctgatactccatctactttaatcaccatcctttccagacttaaagaaggattgcccatgcacaggtagtgactccttaaaggcacaaatcatgactgaatgtgttttcaagtccagaacagaacctgacaaaaatcaagccctggagtttgtgctcaacagatgtgtaatcctctcagtgtttccagttcttaaatctcttccttcccatcctatcactcaggagaaagcacttatgaccaaattctgtaagaatttgggcagaggtgaaaaacaaaaaaac

SEQ ID NO: 244444 - DNA, 407 bp, Homo sapiens
aattggaatatagggcagaactggaactttgcatctaaacttggaggaaaacagagcttggaagaccgacaagtgaacagttgatagtgtcctgttctcctgttgtgtacactgccgagcatctcctggtagatggtgtcagaactgaattagaggacacacagctggtgtctgctgctttgtttgtgggggaaaaaaacccatgcatctggtcacggaagtcttctgtgctgatgattgtagtggtgtgagtgcagaggaaaatcacggttagagaaagttttccctacacaagtaggctaggaattcctgtgtgcaccatctccatcacctttcacgttctcctgccttggaggaactgtggatgaaaatgactacagaataaaggattattacttcagacgaga

SEQ ID NO: 244445 - DNA, 819 bp, Homo sapiens
cttctttttctgtacctcttttactggatctttcccattagaaattgagcataatgaattctctgccatcttacaggggaaaaattcaatctgttctcatctccttttctcctttcagccactgacctgtcttcttcctgtccagaaggccagacttttctccagagttgtctctgttctctttctccattttccacttcttagacccacctcagtcccctgcagcgtgtcttctcctcctattactccactgacatagcactcactaaggtgcccattgacttgatattgctgaatccattgcacgtatttgtctttaattgacctctcaccacctttcagctctgctccctcttgacacttgtacacactgctgattttcctactgactttcaggctgtttctttttggccttctttgatggcttcttctctgcccaaccacagaaatttagtttgtctaggaaatctcattaacttggctttgttaatgctggtgattctcagtctcttatctccagtttggattctctcagaacccagtgaattgcacactctctgctgaaatctgaagtctgtgcatatttcttaactcctccctctcactgttaccaaatccagcctgcaaccaagtgctgtttttttttgtttttttttttgtttttttgagagaagtctcgctcttgtcccccaggcctgagtgcaatggctcgatctcggctcactgcaacctccgcctcctgggttcaaacgattctcctgtctctgcctcccaagtagctgggattaaggcacctgctaccacgcctggctaattttt

SEQ ID NO: 244446 - DNA, 657 bp, Homo sapiens
tactccagttttaattttttacgattctgatatccatagagagatttttcttttgtaacacactagctgtcagttccttgaactttttcctctctaaggatcccaccttattgctacaactccttcatattcacaattgtgtgcatattactctttgactaataccttctatctttctagctcatttcttatttcagcaatccttcaacccttctgagacctaggacccattgatcctgtcaccttttctggcttttataaagcctctgatgtcctctctctcccctgagttccatggtcagtcattctcatcactcctttgcatactgtttccttgcccttcccttgcttcatcatacacacttggcaaagtgatagctgaagtgaatcttactctttatctagtctgcccagtatctatgcagcttaatgtatctggagaaaattacacataccatgctgcctggtgttaaacaaatggctgcaaacctcatatcagcccataatgctgcttggcaatcacaaaacattttcccacttcagttactgtcccactctcctggactagtgcttcacattctatctgtggtaaagtaccagtttcctctccacccaccttgttgtgatcaataaaatacaataaagtggattgttaag

SEQ ID NO: 244447 - DNA, 644 bp, Homo sapiens
cttctaattgccacttggattgtcctttacttataacattagctgttggcggactgttcttgtttgtttgcaaggctgaggtaatttatcatgttggcagaagacaagaatgtaggtagaagagagaaaacaaagagtgccagctggcaaggccactgtcgattcatcaaatacttctttagcaatgcttcatatcaggcagtgtgtccgatgaacatgatatgattccttttaggaactcaccatttgttaggtgacagacaaaaagaaaatgatactatagtaagaaaagagcagcaccagagcatacacaaggtgcagctgctacacaggggtgaccatttctgctttggggatttagggaaggctgcacagaatgagagcactgagctctcttgaaagataaataggatctcatcagtcaggcacggtatagatttgtgtgcctggcagaggcaagagctgatgccaaagggaggagttatgaaagttcatagtttggtagtgctggatgggagggtttgaaataacaggcatcctgctgacccaggcaaagggactcagaccatgaagggccttctatgttatgctaaggaatatgggactattatgtcttcttttttttttttttttgagagagtctc

SEQ ID NO: 244448 - DNA, 478 bp, Homo sapiens
ctcgctctgtcacccaggctggagtgcagtggtggatctcagctcactgcaacctcgccacccgattcaagcaattctcctgcctcaggctcccaaggagctggggctacaggcgacgtgccaccacgcccagctaattttttgtatttttagtggagcattaagatgtattctgaagtcacaattgtacagccctctttttttctgaacatcaaaaataaactgctaatatgtgggggctattttataatacaaagttaaaatgcaaaaacaaagaagttgacaagggattgagagtctagatctcttgccaaattcttcgctactctacattctagataacctattaaacctagattacctagttctgataccatctttctgatctgtatgactataagaatttaattttcctagttattattatcagtactaatttccctccttactccctttcccctgcctgccatctctctga

SEQ ID NO: 244449 - DNA, 413 bp, Homo sapiens
ctagctaaccagcatggagatctgtctaaccagcatggagatctatctaaccagcgtggatacccagctaaccggctccctgcccttgcttttcacctctcctgtggaatggtctgctcatggccctctctagtgatactgctcatcataaaatgtcagccagaacttccagtttactatcctatggctctagttaggcagcggtgaagttactcacagacagcataattcatgacaaacctgtgtaggtgagaatcaaaccagtgattgggaagaccagagggtcccaatgaggccagccacagtggctcatgcctgtaatctcaacagtttgggagattgaggcgggaggattgcttgaggccaggagttcaagaccatcctggacaacatagagagaccctcgactctac

SEQ ID NO: 244450 - DNA, 618 bp, Homo sapiens
gccaggctgatgggagtccctgagccagagttgcccattaaaggaatccccatcaggcaggaatggcctgatttgagtatctccactgtgccaccagtcattggtgggagaggctggaggctattggtcagctacactctccacaagaggttcttctaacaggacacctgaaaagcacatctccatgcccctgccccataacagcatatcaaaaacccattactcatttacagcatttgctgtgaggataagaaacatttccatcatatatctgtacagtctataaaaagtcttatttgagaaagtcttcctaagtgtctcaacaaacttggtccctataaaaacttcttccccaaatacaggcaaaatttcataaggacttggcactctgcatccccatctgaggcaatcttaccaaatgtttttctaattgtcctcaggaacctgttccattttccagttccagttgctgtggaatttgcctttctacctagttcctgctggacgtgaagctgggtatgctttattggctcccaggtctgacttttccccagaatactgtcattgcttctgtatttgtctcatgtccccaaagcctcaggcagccctgccctgttc

SEQ ID NO: 244451 - DNA, 402 bp, Homo sapiens
ttgttttccctaagtcttcaacctggtttcctctgtgcaaaggccccttgtgtcagcggagcaggggagggtctccaggtggatgaaaattgcactgtcaggaatttgtcttcctgggcagctgtgggcaagggtgggggcctggagacacaggttcaggctcagccccagcctctagcctatcatctgtgagccacatgcagggagagcttgtcctttggatgggaagtcattgtctgcttttagctttgtcccttcacaatgcctagtttagtgacggtttggacaatttcagcctggaccacccacagttaattgttgtggtctatgtgtgtgagagagacagagaaagagagagagagactggtgattgttaaagagacatagataggaagacagaaa

SEQ ID NO: 244452 - DNA, 543 bp, Homo sapiens
gcatgaaggtcgaagctcacaccacctctgcagactcatttcacccctcacctgcctacggtcacctgtgtggttgcccgggccagaaacaaatacccaaacgcagcatttgagggatttctacttgtctgttgcctcctcgagaacagcacgtaactgcaatgcagcctgtacaggaggacggagggaaggaaaagccagagccaggtcttgagctgaggagggcagagtcttgcggagggccctcaggactgggtgatgctgtgagggagcatgaaccccgtgtccctgagggtcctgagcgccactcggccattgggtcggatcaccaggtgggtgatgctgccattgttgagggagcaatggagccagccttcgggaggaaactgcagcgctgtgtcctgtcatctgcagcgaatgacactggcgtgacatcggaagatctcctaattatcctccccctgcttggcatcccccgagggatgtagtttcggagcgctccctcgatccggactccatcttcatagcatgcccagcggccgc

SEQ ID NO: 244453 - DNA, 284 bp, Homo sapiens
agaagaaggaagcagcacttaaattagttaatataaagcctattgtaggcaattcaggttctacagttctgcgggacccagattgcttctagctttccattctgccatccgtcaggtgtgacccttatccttatggtccaggatgaagtccagccatcatatccatgttccaagaaggatggaggagaagaagatgagatgaagggtacattctgggtgtattttaaagaaatttcctagaagctgccacataataattttactcacatcttactgaccagagc

SEQ ID NO: 244454 - DNA, 363 bp, Homo sapiens
aggaaccaggtcccttagaatgctctataaatgtgtggaggacctgggaaagcaaatcaaaagagccttgggccaggtgtggtggctcacacctgtaatcctggcactttgggagtctgaggtgtgcggatcttgaagccaggagttcaggaccagcctggccaacatggtgaaaccctgtctctattaaaaatacaaaaattatctgggcatggtagcaggcacctgtaatctcagctactcaggagggtgaggcaagagaatcacctgaacccaggaggcagaggttgcagtgagccaagataatgccactgcactccagcctgggtgacagagtgagactctgtctcaaaaaacaaaaac

SEQ ID NO: 244455 - DNA, 683 bp, Homo sapiens
atactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtgg

SEQ ID NO: 244456 - DNA, 629 bp, Homo sapiens
agaagcgtttttcaaaagtggttcacatgcagcaaacgattcaaaatcacaagcatgcagtacagtctacacccactcgagccagtaccaagtaagacttcagttctcccatgcccagagttatggtcttgaaagcctgctcatcaggctcgtagatggaagaggctgccttgtctcagatgaaactttggacttggacttttgggttaatgctggaatgagttaagacttaagggaactgttgggaaggcatggatggttttgaaacatacaaaggatgtgagattttggagtggccaggaattgaatgatacggtttggctctgtgtccccacccaaatcttattttgagttgtaatccccactatccccacatgttgagggagacacccaaagggaggcaggtaccccagtactgtttcccccattctgttctcatgatagtgagttctcatgagatctgatgattttataaatcattgacagttccttctttacatacactctctctcctgttgccttgtaaagaagatgcctacttccccttcaccttccaccatgattgtaagtttcctgaggcttccccagctatgccagactgtgaattaattaaacctcttttttaaata

SEQ ID NO: 244457 - DNA, 330 bp, Homo sapiens
actcggaggacaggtctaggctaaagatgtaaatgtgttagtcatctactaacaggtgataatagaagccagaggcatggctgatggtgctttggaatagaggatacagtgagtaaagaagacctagaaccagtcttgaagaaatccaacaaatattggttgaataaaggagcatgatcctgcaatggagccagagaagaaccagggaaccagagggatatccaggaagtgaaaacagcatttcaagaagaaagaagaaagaagtgattaacattatcaaataccaatgagaaattaagtaaaattgaggattaaaaaaagtttattgct

SEQ ID NO: 244458 - DNA, 616 bp, Homo sapiens
tcctaagttgttgctttattcagttattgtaaaaggggttgagttcttgatttgattctcagcttgggcgttgttggtgtatagcagtgctactgatttatgtacactgattttatatccagacactactgcattcattgaccagatctggagcttttaggatgagtctttagggttttctaggtgtacgatcatatcatcggtaaacagcaacagtttgaatttctctacagatttggattttttttctctctttaccagtttctttctcttgtctgatcgctctggctaggacttctgatcctatgttgattataagtggtaaaagtgggtggccaggcacggtggctcacgcctgtaatcccagcactttgggaggctgaggcagccggatcacctgaggtcaggagtttgagacccgcctgaccaacatggaaaaaccctgtctctacaaaaaatacaaaattattctggcgtggtggtgcatgcctgtaatcccagctacccaggaggctgaggcaggagaatcgcttgaacccaggaggtggaggttgcggtgagctgagatcacgccattgcactgcagcctgggcaacaagagcaaaacactgtctca

SEQ ID NO: 244459 - DNA, 423 bp, Homo sapiens
ctctgagcttccagcttctaccttgccttttcttcttctagtttaatagaaatcattagtaccaagatagctaaagtgttttttggaagggtaagagtatggaaaatgcagctcatttcctcctaaatcttcattgctccacaccaaatttgggaggcttattattttcaagcctcttcctctacatattttcaccactacaacaccacaaacaaaaagggacctagcataccataggtgcatctgtttgagaaaatgcccaaagttggaggttttggtgtttgcgtccactcagcagaattaatttgcttgattgtgtatttttgatgtcagggactctcttgataattttgtacggtgcctagcacattttcatgtataccaagacacttcaaataaatatttgataatggtattaaggca

SEQ ID NO: 244460 - DNA, 421 bp, Homo sapiens
gagacagagcaagatgccttcaggaggaatctctggccgtcttctttggtaatatccaaagagctttggtcagcgttgatatcaaagcggtgtgaagaaaacataaggccataagactaatctctggagagctgcacactgaaggggaacctaagttcttgagtccctggagtaccccaagtgtggtttcagagagggtgccattcatgagcaacactgctagccattagtggccagcaagaaggggagtgaaaggagtatcttgtagatggtgacttgggtaatatgaaattgctgtcatcaaggtttatcaaaaaaccaaaggttaaatattacatgtaggcaatgtgaggctgccccaaatggtgtgtttcccaggaacttgattcaactctgagaataaatgcatgagtactgagaa

SEQ ID NO: 244461 - DNA, 406 bp, Homo sapiens
tcccaaggggctcaaagatagatctaagcacagtttgggatggagaatcacaaattctgaatcagtggagcctgagttcatggggctttatccatcatagagacactgacgatgaatgcatagtgattaacacacagaacttggcaacttgccactgctgtgtagattttcaagagcagcaggtcccattgccccttttgccattgtgaccaagaacacttgctggctgcctccccaggagtgaagcaacaggggcatcctctgactcagtgggcatgtctacatggcagaccaccatgagcgagctgggttttggttctggctgtgttccactgtgagaatgtgggggaaaaccactcgccttctctgagctcatttacttgtctaataaatatatggggataat

SEQ ID NO: 244462 - DNA, 589 bp, Homo sapiens
tgaatttagacctgaaagtgctattctcatgacacagatgaaaaaatatggtttgttttcatacataggagaaaactgaatgggctacctttgaagtccagggcaccctcctctatcttgttcacttcctcatcaggcactatctatggactgagaagagaaggactttaaaacagtggtaaagaaagcaacaaagacaatgactggcaagacagaagaattgtgcagagaaagaggtagatagaaatggaagtctgttgttcccctctatgtgtctatgtgttttcatcattttgctcccactgatacgtgagaacatgccacatttggttttctgttcctgtgttagtttggtaaggataatgccctccagctctatccatgtccctgcaaagaacgtgatctcattctttttaatgggtgtaaagtattccatggtgtatatgtaccacaacacccctgaacttaacttaaaagttaaaaataaaaaataaaaaaggaaaagctgagttaagctatactatctttgtaactcttctgtaaatctaaaattctatcaaaataaaaagttttaaatgtatttaaaaaa

SEQ ID NO: 244463 - DNA, 449 bp, Homo sapiens
caccggctcctttaagtccacccgtccctgaaggttcctatcgagaggctaggcgtagggaaccgccttcaaccctgtgcccacggtcgtgttgtgctgcgcacgagtgataaggactcagacatcctaatgattgttccaggctctcactgggtgccggacaccgggctccacacacgtcttctcaatgaatacccacaataaccctgagagaaaggcgtggttttttaccctcgttatacaattggggaaactgaggctcaaaagagtgaaggaacctgctgagggtcacagaaaaggatgcggccgaaactcgaagtcagtctggctgcagctctaaggcctcgttactgtcgtagagcagtttgtcaagaagtccttcggttcctagatttctagaggacgctggagttcattgtgaagtgccggggctttgggtccacacaaaa

SEQ ID NO: 244464 - DNA, 463 bp, Homo sapiens
tgcagaaagctttttcttcttcttctttgaaaaagggtcttgctcttttgcccaggctggagtgcaatggtgcaatcacagctcactgcagtctctacctcaagtgattctcctgcctcaggctcccaagtagctgggaccacaagtgtgtgccactatgcctgactaattttttaaatttttttgtggagacaaagactcactgtgtctcccaggctgtcttgaactcctgaccttaagcgatcctcttcagcttcccaaagtgctgggattacaggcatgggagccaccttgcttggtcacaatgaatgtttgctcattcttctgtctgtatagaatcctaaatgtgatgctgtgtggcaatggggaagatcatacaagatacagtttctgtccttgtggagatgacagtctactctggaaaacagaaagttgtacacaaacgtgacccagcaacatggca

SEQ ID NO: 244465 - DNA, 730 bp, Homo sapiens
cagctccagcctgaatgagaagcacgtcctcctgggagttacgtcagcagcctgaccttccatcttcctcctctaaagaagcgtccctgccaccctgagcacgaagccctcgggttcctaaaggccgaggcgcttcttctcatttacttcccttgaggaagaaagaccagcccatccaccctcatttcccaccgaagggcatcgcaaataaagtttgcccacgcaaccaggccaccaccattaatttctctctgccctgctcttacattctcctcaaggttttcagtcccctagagaggctcccttcccttcttttctttccttcctccagccccccttttcacctccctccaccattgtttgaggttaagaagcatgctacggtgttctataaatcacttggcaagagtagacgacaaaagcaaaatataattcagattaaagtcatcctcccgctgaaatgatagtttcttaaataaatggcgatgctgcctatcaatcttgctggcaactggtcctctcatattcatctttctgggggtgatttaggatccacctgggtcctccgagaagattctcccatcatttccttcccgtctctctggatcttgctgctgggcttggcgcagttgacaaattctccaagtaatccctcaaaagattggagaaatgctccgaacgctccattaaacttattttccatgctttaagagacccaaaactatgtcca

SEQ ID NO: 244466 - DNA, 320 bp, Homo sapiens
accatgcccagaaaattttcatatttttagtagagatgaagtttcaccatgctggccagactggtttcgaactcctgacctcaagtgatctgcccacttcggcctcccaaagtgctaggtgtgagccacctcgcccggcctcactcagcataattttttttgagattatgctaccatccatgttgttgcccctatcagtacagctggccctccatatctacatgttcctcatccatggattcaactaaccatggatggagaatatttggaaaaaataaaatatataaaataatacaacaataaaacagtagaaaatttaa

SEQ ID NO: 244467 - DNA, 315 bp, Homo sapiens
ttttttttccaggctgctttttatgttatataaaaataagacactaacccatgggtcaggggctctccaaagacccttcccttgctgtctacctaaggcaagcgaactaactcctttcagaaataggtttttatagcacatatttatgtctatgtgtctggatcttgaaatactgatatttcttcattaggttcttctaaaagtgtttgaaaacactacttttgattgattgatcagtatacagtagtaattcaaattgccagtaagttcagttgtacctttagtgtgtttgttttaaatatgtgactttgcgtg

SEQ ID NO: 244468 - DNA, 457 bp, Homo sapiens
ccaccaggtattcccacccaccagaagctggctgttgtactcacccggaaccatggtgcaccaccacagcggcgaggtcatacaggcagctctccgggccactgttctcaggctacagaacaaggaagaaggagcagtggtcaatgacatcagtatctcgatgacctctaccctctccatgtgatgacaatcttactgaagagccattttttcaccatgctaaaaaggccagttgggtccagcagctttgcctctctacccttttatcaccaaagtatactgctgagaaagaatcaaatgaaaagaaaaaagactcaacaagacctcactcatattaactggactctacaagcagtgagcatccagacctgcatttggttacaaaagaagccttcaagctattttcatcagcttcctaatcaagttaaaaaataaaccacaaaactgagtatccaaa

SEQ ID NO: 244469 - DNA, 410 bp, Homo sapiens
ccaccaggtattcccacccaccagaagctggctgttgtactcacccggaaccatggtgcaccaccacagcggcgaggtcatacaggcagctctccgggccactgttctcaggctacagaacaaggaagaaggagcagtggtcaatgacatcagtatctcgatgacctctaccctctccatgtgatgacaatcttactgaagagccattttttcaccatgctaaaaaggtatactgctgagaaagaatcaaatgaaaagaaaaaagactcaacaagacctcactcatattaactggactctacaagcagtgagcatccagacctgcatttggttacaaaagaagccttcaagctattttcatcagcttcctaatcaagttaaaaaataaaccacaaaactgagtatccaaa

SEQ ID NO: 244470 - DNA, 410 bp, Homo sapiens
ccagcagaggtgggctggacactgctcctggcaaagctggccgggaagatgcagcccgtgggacactccccaccaccactctcacagtctgactgactgcgaagcttcacagaccagaaggttcattcctcacaagaaaaggaaaaccctggtctgatactactgttctgaaatttaacagccagttgggtccagcagctttgcctctctacccttttatcaccaaagtatactgctgagaaagaatcaaatgaaaagaaaaaagactcaacaagacctcactcatattaactggactctacaagcagtgagcatccagacctgcatttggttacaaaagaagccttcaagctattttcatcagcttcctaatcaagttaaaaaataaaccacaaaactgagtatccaaa

SEQ ID NO: 244471 - DNA, 736 bp, Homo sapiens
gaaactccgtctcaaaaaaacaaaaaccaacaaacaaaacccccaaacaccaaaacaccaagacacatacatatacagaagactgcaaagtactaaaatgttaacagtagttatttctggatgatgggattatggaagtttctaaaatacttccttctcattgctagtctgttttctgaattttctaaaatgaacacatattagctttgtagtaagaaaaaagtgtttctttttttaaaaacgccaagtgggaaaaactataggcattagaaaaaagagaaatcattaaggatggacgtagacactgaagttccttccttcctttaaaggaagaagttgattctcattattcagtgtttatgttataaaatcacagtggacaatgaattagtaaacccttgttcctgagggaaataaaaggtaggtaggttcctgcaagcctaaggtcacaacattttcatcaaatgatcaatagataccttgcttttatatgtgtttctgtttaaggacacctcatttgacattatttttgattccttaacattgaactcacagttacaacagcagtacaactcatgccggaatgaagcttatctaatatacacattttcttcataaggcacattacggtctttctgcactcaggaatactagacagcacttcagcactatgctgtttgcattctgaacagcaaaattaagccaagcatggtggcatgtgcttgtattcccagct

SEQ ID NO: 244472 - DNA, 498 bp, Homo sapiens
atcggtctgcgacagactgactcctagataggaaaacacacgtttccggcagcatcgcctgtaactggaaagacacaaggctcaatgccggggactggtccgtcaatcacgggccctgggacagtcctgcggcccccagacagcggcgaagaaagctctgcgcgccccggtttgttccgggagcgcctctgggagccgcaggctctggatatcagagggagggcgcgaccccgtgccgggagccgcagggtgctggggttgcgttcccgccctctctgcgtttcctttagtgactcccgctaagaggggctgaggcggaaacccccgcactgagtgtgaaactcaggagctcgctgaggccccctggtgcttcccggggccgcgtgcattggcctgatttcattttgttccgttgcctgtaagctgagaatttcattttctggtgagaatccgccatagaggctctggttctgggaactgtcatttcaaagagacgca

SEQ ID NO: 244473 - DNA, 696 bp, Homo sapiens
gtaacatctgaaacataacacgtgtcaggaatgttgctattacactaaatgaagtacacctctggaggaaaacggaaattctgacaccgcatcataatgaagaaaaacaaggaaaacaattaaaagaaatgaatggcaactatggccactgtgaggtaaagtagggctcaataaatacaggtttaataaacccataaaattacatttataaaaatgttggcaatggtaggttttagtcttttctgccaaaaataagcaaaatttcaagaaaatcattttcaaatccattaaaattcctatcagcttctgtgaggtttattcttcatatttgtgtgtatccacacaaaacaatataaaatgtatcagagttcatttatttggaatcatccataggaccccacggtaccactggcagtctactcctaaatgactacagaatgtaaaaaatacacattaaaactatgtacatttggctgggcacgatgcctcatgcctataatcccagcactttgggaggccaagacaggtggatcacttgaggtcaggagttcaagaccagcctcgccaacatggtgaaacagtctctactaaaaatacaaaaaagcaggagaatagcttgaacccaagaagcgaagcctgcaatgagccgagatcacaccactgcactgtagcctaggcaacagagcaagactccat

SEQ ID NO: 244474 - DNA, 377 bp, Homo sapiens
cctggaggaggtcgacacatgctaatgtcaccatgggacttcctgctttaatggtttagattgagaattggttgggatgcttttgactcctaagaagtagaaagccctgactcagctggcacagtcataaagacacttagcacctcacccagcaagaaacctggggaaggtgcctcctggtaggttaattgagtgattgactcccaggagcccaagtccttcccctctttcagctctgtcatttccaggctgtaccccttcagagtggcatgatggctactgcatccagataccacagcactcagcaggaggagagacactcctccctgtgcatctacagcagggaagggtccccgtcccagggccccagaagattg

SEQ ID NO: 244475 - DNA, 541 bp, Homo sapiens
agatctcaggaaacagtgttatcactcagagaaaacacacaggacaatggaactgacagagcatcctgggtgtttgtggaacaccaagaagcctagtgcggctggaactgaatgtgcatggaagttggagagatagatggaaacaaattgtgtagtcttttatgccagcgtagagaggttgtaatatgttcctgtgtgttcaaaaatgtacctggggttttttgcagtatggtctgataagaaactcggacatgcaaatgattgccaggaaggaagaactttcaactcacggagttttagaaacagtaggcaaaacacatcctgcagggctatgtgagaagcaccagggtggtataagaagcagaagcagaggagaaagcagaggccagatcctttattgttttccacaggaaaagaaaggcagggctgggtaaccagaagaggatttgctggtttgaataaagttggtagactttggggtctaggagctgtccctgtctgcctagtacctggccctggagtcattagagcaaaaaaaaaa

SEQ ID NO: 244476 - DNA, 1288 bp, Homo sapiens
gagaagtagaaactatatatatgtgtatttatggtatacagcatgatgtgttgaaatgtgtgtccgttgtgggcgggcttcatggctggcacctataatcccagctacatttgaggctgaggtggcaggattgcttgaggccaggcgttcatgatgaaataatatgtatacattgtgggccgttgtccagtgcagtgatgcagtctcggctcactgcaacctccgcctcttaggttcaatcgcttgggttcaagcgattctcctgcctcggcctcctgcctcaggcctcaggtgatccacccgcctcggccttccaaagtgctgggattacaggcgtgagccaccattcccggcctgatatttgttgaagaaatcatttcagtatgtcccatcattttagaaattttattttgaattagtgtctaatcaggaactacacccagcctggctatgaatttcttacagtgagatttgatcaagattaaaagctgttattgataaaaagtgattctaaaattcagttcttttggctactttgtacatggatacacatgaaccattttacaaggaaaatgttatgtgtatttgtcattcacttacaattttaaattttgggaatataataaaaggcaatctatgtaaaaagatgacactgatgtagttggtttactaagtaattcaagaggagcagtggctctctctttttctctaggtattccctagtgctttcatcgtaaaataggattctaacaactattaatgtatttggagtttcttaagggtgtaaaataggtcaagtaaagattttcaagagtcatacagctgcttttctctctgccccaaaaggggagatttgggttggccagcagcttctgacccttgttgttagtgtgtgggccttcctttgttctgttgccttcctcacctcccaaaggtacttttagcaccctatttttttctcctctttgaattataaacattgttctgtagtattgaatttttgaaaatttctagattctagaactctgtccattgtggatggagcttgtatatatgttagtgtgtaccttagtctagaaccttcaagtgggttgagtgccaatgtgagtaccatgtgattgttttctaaattggctatacttgccattttaaatactttgaaatggaatttggcattaagggctacaagtcgaaggcctctgctgattaaactatgtagttgatgacatattctaccatctagctgcttaaatatgagagagtggttttgtatgttttactaagtaaa

SEQ ID NO: 244477 - DNA, 399 bp, Homo sapiens
ttattttctctttgctcatttccctttttgcattctttctggtgattagcaatattaatctgcaaataaggtcttcatttcttcttcttgtggtttatatttcttggtgtccaaattatgtgtttgtcccaacatgggtctatgtcaccatgctcctacaaaccaaggcacatatctgcaggtggaatacaaggatgatagttaagaaatatagagctgcttttctcaaagaattaaagaggagaaatacatctctttcctgtgaaaaagaatccaggttaccactcaaagatgagtttaccctccatatatttatttcaactgaaataaatatcaaatgtttttgtctctttcagggaccatttataaattttttccaatgagccatctgaaggttta

SEQ ID NO: 244478 - DNA, 302 bp, Homo sapiens
aagcacggggcttggctgtcttcaccctggaggagggtggtggggtttatgaacagatgttcgcatccaaggtgagcatgggaagcagcatttctccatcttcttccatgctcatcacaattcctctctggtctttttcggtgtgatgattctgaacggtggacagggtcaggggtctctctggttgcagagactcaggattgggaaatgccaccaagagttctgggaagaaaaggaaaatgtcatttggctttggcaacagagcaagaccctgtctctaaaaaaaccaaacaaatgaaaaa

SEQ ID NO: 244479 - DNA, 352 bp, Homo sapiens
gccaaggaggagctcctgcagtctccagacaagaggagaccccaccttgggagtgaaggggagaagagcagttgaaggaagggagccgggggctggcatgtgggagtgatcagaagcctggggtgactctggtttctgacttggggaactgggaggacagcggtgctgccaagattgtcagggagcagggagcagtagggaagtgtgttgtgcggcatggagaacataaggcaagagaatgagcaaattctgtctcattttccagtgttgctccagtgcctagcatggaagccagagtaggtgtttttttgattgaatggatgacatgctgtgttgcaggtgggggtgaagg

SEQ ID NO: 244480 - DNA, 439 bp, Homo sapiens
attctgtctcattttccagtgttgctccagtgcctagcatggaagccagagtaggtgtttttttgattgaatggatgacatgctgtgttgcaggtgggggtgaaggggctgtgtatgggcagagagcaaagaggcccaggaccaggtctgggccaaagcacggggcttggctgtcttcaccctggaggagggtggtggggtttatgaacagatgttcgcatccaaggtgagcatgggaagcagcatttctccatcttcttccatgctcatcacaattcctctctggtctttttcggtgtgatgattctgaacggtggacagggtcaggggtctctctggttgcagagactcaggattgggaaatgccaccaagagttctgggaagaaaaggaaaatgtcatttggctttggcaacagagaagctttagggaacttgcca

SEQ ID NO: 244481 - DNA, 548 bp, Homo sapiens
aaaactaggaacagttttaaaaaagatatgcttgaagatactagagagataacaaggtagtaaagaactagtgggcctgtagcttcaaaaaaataaaaaaggaatccaaaaaggtgagctcaacatttggactccttctaccttgggagcatttattaattctggaggagttagtggagagcctgatcagtgttttagacagtctcaaaggagtggggtaaaaagtcagaatctaggactcatcaagggaaatagcctagcgttgggatgagaacctaaataattgcagcacagtaataagattggactgcaacagaccagttctcacagagatttcagcctcaaatcagctcagtctctggaattggattaaagcaataccaatttgctagaattccctggtgcctggcctaaacaaacgtaaatcctccctagagaaggaaaacatcttcctaggcctcaagttatttctatacaaacaatttttcaaatacaatattcctcagataataaaaataatcagacacttgaggaaacaggaaaacata

SEQ ID NO: 244482 - DNA, 333 bp, Homo sapiens
ccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagct

SEQ ID NO: 244483 - DNA, 496 bp, Homo sapiens
tcttccttacccgtgatatataaggctgtgatctagcataggaaaggccatcaccctgaccctgaacaagacttcgttctcagcaaaccaaaaacctgcaacctacctaggtatattttccttagaaggcatggaggaaattgtaaattttcttgtgattatggtagtatcattatataatttcagatctgaatttttgttatatatgagaaaaatgacttgatttttaaatcattgtacattacatagatgtcaaattacaatataaaatgatttttatattgtaaaaattataaaatatacaacataaaaattataaatatacaatataaaatatataattttatattgtaaaattttgtatattgtatgtatttataattataatatcaaataattttttaaattatgtacccagaaggaaaaatattaatttgaagtcatattttttccagctttactgaggtataattgagaaataaaatgtatatataat

SEQ ID NO: 244484 - DNA, 223 bp, Homo sapiens
gtcagagggagcaagaagactacaaaacacttaacacacacacacacacaaaaagaattgtaattaggataaatacctattttttttgtctttccatgtaggctgtttacaaaaccaaggtagtatttttcttttaataggtaaataattatgcaatctggtataatctggaatattttgatattgtttcctgaattgtatttgctccttccaaaattaatag

SEQ ID NO: 244485 - DNA, 417 bp, Homo sapiens
agggaaatcgcaaagtgccttttaccttctctcttaatcctgaatggtaagaaagtcttctttcctaacacattaatagtttcagccgtggtattttaggtaagctatgaaagattggaaagtgttttctgtcaagaagaaataattatccctttcaaaaaattgtatattccaaacatcttctctctttgttaggttattgaaagtctgctatttaaatagttatttcctgttacttattaactcagaaaattttctatatggttgtatttgggaagatttatttaaaagttttcttttagagttaacatcaataatctgcatgttttctacagtggaggtgttaatgttgaaacataagagaatgaacatactcagcgaatggaaatcttaacatctaatccaaaaaagaaaaca

SEQ ID NO: 244486 - DNA, 326 bp, Homo sapiens
tgagccttaccttacaccatactcaaaaatcaatcatagacctaagctgtaaaagtataatacttttagaagaaattaagggaggggggcacaatggctcactcctgtaatcccagcacttggggaggccctggctggcagatcacttgaggtcaggagttcaagaccagcctggccaacatggtgaaaccctgtctctactaaaaatacaaaaattagctgggcgtggtggcaggctcctgtaatctcagctatgtggggaggctgaggcaggagaatctcttgaacccaggaggcagaggttgcagtaagccaagatctcacca

SEQ ID NO: 244487 - DNA, 973 bp, Homo sapiens
acctgcccttctgtctttcccagtgtcctctcctcttttctctctcccatcccagggtccaggttaattgcagtgcaatatttgcatagacgtgagacctcacccggggaaattccccctggtgaccaaccaggtttcctttctgaggtcaggccacatcatcagacactgctccttcctctccggcttgccactgccaccgctggctttcgcccctgtcatctggtgggtttagatcccggcacacagatttaggctcatcctttgaccttgggcactgtccagagggtggggatgtggaggctgggctagggacccagagtaaaacagtgaggggatagatattcagggagaagaggaaagggcagcaggtaggtggtggataggaagcctggattgcaatttgaactcatcagtaactccctggctgcccctgggcacaagccttcccttctctgaaccttagtttccccttctatccagtgagaagattggtcaagataatctctaagctttgttccagatctgatagactaagaagccacttcctttgcttccacttcctttggcagcacagtgttgcaacatctgtacttggatccccttcctttgacaagaatcttgcaacatgccaccctgtattagtttccttggaaagcacaattttgcaaaaggcctccctgaatcccatttttcaaatgctgatagaatgacacatacctcctctccacttagtggcttagcttgcgttttaacttttcctttcacacccatcatacatactgttctgtgactccccgaaagagggattctctctacattctgaaatttgttgtccctatcctggtattgagaagtcaccttcctgatacaaaaagaaggaacaagttgggagaccacagtgactcaacgacagtaagttcctgggatcacctgaatcagaaccagctgttaaaagggcagatttgtctca

SEQ ID NO: 244488 - DNA, 498 bp, Homo sapiens
caaaatgccaatagtgctgaggttgagaaatctgatattggtggataaaggagtcaggtccctgactagccagtgagaaggggtataaaaatactatttgagcataaaggctcctttcccccgattccagcctctcttcttgtattatttccataatttagatttaggtggttaaggctatctggaaaagttagtcatttgctagctgacgaatagagaacatctctctaagttcataatctttggaaagttggctgctggctactcattgtgtaaaggtgccatatccatctaccaaatatcagatacataagtttttttacttaaaccaccattcaaatcagagtatatctctgtttctaatgttctgagtttgaagttgtgtgtttattgatcaagaacaatatttaggacactagtatgcattagcatactaattcttctttccccatacgtggtaattaatgggttcctcttcttgaagggggatggtattta

SEQ ID NO: 244489 - DNA, 271 bp, Homo sapiens
ggtagtgggaatgtaaaatgttgcattgcttttgaaaagtttgaaagttcttctataatttgatcatacatctttcatatgtgctagcatttcctctcctaagtatgtgtctcagagaaataaaaacacacaaacacacaaaagctttttacataaatgttcatagcagaattattcgtaataggcaaaagcataaaccacccaaatttttatccactgatttacaaataaataaaaaaatgatacatccacacagtaaaataatatttgg

SEQ ID NO: 244490 - DNA, 373 bp, Homo sapiens
atacccttgagacttagaaattttttttaactcatcttaacagccaaattatcaaaaacagaatctcttgttttcattatgattttgtaccttatgtccaaccaattgattgctccgtcaaggaacctgtattctcagatgatataaacaaaaacctggcttttgtgaggtggagactgaagtttataaaggcttctcataagccctagtcagtgaccatcaggagcacctgcccctcatgtctgcagggcacaagagtcatctgcttgagaaccactgatctagcacatcaatacctaaaatgggcaaggattttcccattatgggaatttctgtataatattacattctaaataaaggttttagcactaaa

SEQ ID NO: 244491 - DNA, 481 bp, Homo sapiens
acaattctgtagagtcatgcgattagtggtttagtggtaggattaaaattagcctcggtaaattaccctggtgacagaaaagcagaatctgttaatggtttcacaggaagattggcttatcagttattttctaggttgatgaaagattatgggctgctaagaatttgaactttagaaagtaaggttgattttcctaatatttacatattttaaagtataggtattgattaaaaagaaagttattacagttagaatttgggattttatatgtgtgtgggagatgatttacaaaccaggttttttgcttagctgtgaacattaagggggccgtcgagagtgtgtgttttaggcaatccttaaatcccgtccaggggaatagtagaccattttggaaagcattttacatgttttggacccacgaaaactccatttagattcctacaaggtggtaggtgatgaaactgcaccttcttggcccgag

SEQ ID NO: 244492 - DNA, 440 bp, Homo sapiens
tctaatcccagtttatcttaagcctgtgagttaggacaggtcatatagcctcctgcaaagcttactcatctgtaatgcataactgacctgccaaccttataaagctgttgtgaagatgaaatggaagtgcttattaaattgtaaagttttgaacatgcttttaagtatgaggaaataaattacaaatcgtatcccttttcccagaacctttagaagtatttgaggtaatagctctaaatgagtttttgtttcctactctaatcaagttatttttggtctaaatctacctcatgtaatttctggtaacaagataactactatactgaccaattttctttaactgaaaggaatgcctgactgtaatcaaagttaatggtactgttatcaatagtttaatacccaacaaaagtgaacgattaacttcccttcagtctaccaaa

SEQ ID NO: 244493 - DNA, 694 bp, Homo sapiens
tcccagtggaaaggaagccattgtgtctatagaattgtacctaaaaccgtatcttattgtgatgagaggagaggagtgggaattgtggccttgggcaggctttcacctgaggctgatatactagtaccttggagagtgtgtgggaccaggctctcggggaccccttgggctttgaggaaggggcagccctcacgctgtgctcacttctgtccccatgagacggtcaccttcctatgttcctttaactgtgggcccgtcctcacatgctgctggtgggaccatacatagatgcaacactctgggaaactgctggcagtatctgctagagccaaacacaccctgtgatcccgcagccctctccggggctagacccggcagacacgcaccttgtgtaatgaacaaagacatgtatgagaacgttcagagagcctattcataacagcccagacctgaagcccccccagcgcccatccacataaagtgggtatgtgaattgtggtgtagtcacacaatgataggtaataacgggcatgaacactctgactacattccacacaaatgcaccgtgaaacatgacttgcggggagggaagccagaccaggaagagtgcctaccgttcaattccatgtacagaaacttcagagaacatgcaaaacgtgtctgcactgtagcaagtcaggatagtggctcccct

SEQ ID NO: 244494 - DNA, 739 bp, Homo sapiens
ctcccactgcagcctccccagtagctgggattacaggtacacaacaccatgcccagcaatttttttgttttggtagaaacagtgtctcgctgaccaggctgaccaaactcctggcctcaagcgatcctctagccttggcctcccaaagtgctgagattacaggtgagagccactgtgtccgggctatgtgggtagtctgataagggcaggggctatgtctgttttgcttaccaatgtttactacctactcagcacggtatctggcacacagttgggactcaacataattatataactgaataacctaaatcaaagcacttatgttcttgtaatatacattatatacatattagaactttgtagatatgctatgaaaaattgctaatgcgcctggcacagtggctcacgcctgtaatccttgcagtttggaaggccaagacaggcggatagcttgagctcaggagtttgagaccagcctgggcaacatggtgaaaccccgtctctataaaagatacaaaaattagccagaagtggtgatgtacacctgtagtcccagctacctcggggactgaggcagcaggatcgcttgagcccaggaggttgagctacagtgagacgagatcacaccactacactccagactgggtgacaaagtgaaagaaaaagaaaaaagaaaaactgctaatgatttggattaaataacaataagaaaaagaaaaactgctgtctcaaaaagaaa

SEQ ID NO: 244495 - DNA, 470 bp, Homo sapiens
ctccgcctccccaagtgctgggattacaggcatgagccatcactcccggcctcatgatatagatcttgtacatattttgttagatttatacctaagcatttcatttttgcgggtgcttattatgttttaattttaatgccaattgttcctgatatatgagaatacagttgacttttgtacattaattttgtatcctgcaactttactataattgcttattagttctaactgtttatttgtggttgattccttgaggttttcttcacaggcagtaatgttattggcgagcaaagacagttttattttttctgtaccaatctgtatacttgctattcacatcccttatttttttttggcatattgcatcttacacaattttgctttgtagcatctattttctcaccattaaatgtgatgttagctgtagagttttttattgtactttatcaagctgaagaagtaaatttgaa

SEQ ID NO: 244496 - DNA, 673 bp, Homo sapiens
ctaatatctaataagcatctaattaatgcatatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttctgttgcaaagtaagaaatgttcttcagaatgttattaatccctgtgttaaaagagaaattggaagatgctcactttagctcctaaaagccatggtatgtactgtgaatgcaaagattctgaa

SEQ ID NO: 244497 - DNA, 477 bp, Homo sapiens
ctcagcctcccaaagtgctgggattacaggcttgagccaccgtgcctggcctcaagcgattctcttaactcagcctcttgagtagctgggattacaggaacgcgccaccacgcccagctaattcctgtatttttagtagagacagggtttcaccatgttggccaggctggtctcaaattcctgaccccaggtgatctgcccaccttggccttaaaaagtgctgggattaaaggcgtgagccaccatgcccagcctcctacccttttctttgcccagccagataagcaggactttatggggcaaagcctatgtcagctctctccaagggcactgggaattttcctgaggtgtaatcgcttctcactgtatgttctggaacataaagctagcaatgaaggtatttctttgaactggtgttggctggtttcttctaaaaacctgcatgctttcatacctctcctgcagttcttttttttt

SEQ ID NO: 244498 - DNA, 284 bp, Homo sapiens
gctaattctgtatgtgttgtcacaaggttcttctaacttttcaactctattcttgaattgctgtcctataaaagaaaaatttcccgatagcaaagatttttctggaaggtggatcaagaggaagacaacattataaaaagaaggagcaatacttaactgacatcatagagtttgaagtatcatttgagagagaaaagtaaaactcagtgatcttttgtcttggctgaaaggaattgtggactaaatttatttttaatcacaataaatattaatattagactaga

SEQ ID NO: 244499 - DNA, 427 bp, Homo sapiens
aaataaataaactcctgtttattgagtgattaatatgtgcactgctctgtgctgagtagggaaatatccttatctttttgtgtgtgtaggtgtgtatatacacaaacatatatatgtataccgaatatttaaagaaatatctgttatatataggtatatataaagagatatgtaagtaatatcaaacaaccattagttacttagctgtgtgaccctgtgtaagtttcttaaattctttgtattcattttccttatttgtaatacaggtttgttgataataactgcctcatagggttgttttaagaatcaagagtatggatggacgcctgtaatcccagcactttgggaggctgaggcaggcagggtgcttgagctcaggagttcaagaccagcctggacaacatggtgaaacctcatctctacttaa

SEQ ID NO: 244500 - DNA, 258 bp, Homo sapiens
ccctgcttctttgaatgaaatacttgtctgccaaaaatgcagaatgggcaagcatcagttgtgggaagaatggcacatggaaaggtgagtcatgggccagagactgtcagagggctgctttcctggagctggagtggaagtaacagtaaaagtagtatggttgagaggacaatgagtgtgaaggatgaagcaaatgataaactgaggattgcaatccagaaatctgacccaatttcagaagagaacaacaatcttaat

SEQ ID NO: 244501 - DNA, 233 bp, Homo sapiens
ctcgctatgtttcctaggctaatctcaaattcctggcctgaagtggtcctcctgcttgggcctcctgagtcgctgggattacaatactgtctagtatgaaggaagtttgtcttgatatgtttcctgctcaaaacaaaatgcaacttgtcattttcaaactctaaaattcttctggtgtgttttaaaatgtctatactgtaatagcaaataaattaacttttatgacagggaat

SEQ ID NO: 244502 - DNA, 387 bp, Homo sapiens
tagttccaagagtaccaattctcttatttcttgtgtctattgactcactcttacgtggttcattttctcttgcaacttgtttttttatcataagatcatcttaggctgtgcgcagtggctcacgcctgtaatcccagcactttgggaggccgaggcagaaggatcacctgaagtcaggagttcgagaccagcctggccaacatggtgaaaccctgtatctactaaaaatacacaaattagttgggcgtgatggcacacacctgtaagaccagctacccgggaggctgaggcaggagagtcacttgagcccaggaggcagaggatgcaatgagctgagatcgtgccattgcactccagcctgggtgacagaacaagaccccatctcag

SEQ ID NO: 244503 - DNA, 511 bp, Homo sapiens
ggaggccgaggagggatgattgcttgaggcctggagtttgagaccagcctgggcaacgtagtgagaccccatttccaaaaatttaaaactcaaccgagtgtggtggcacacacctgtggttccaggtactcaggaggctgaggcaggacaatcacttgaacccaggagtttgaggctgcagtgagccgagatcacgccactgcactccaccctgggcaacagagcaagatcttgtctcgaaaaagaaaaaagaaaagaaacacacagtgtttgtatcaactccaccaccttcagcaggcagtgctttcagtctgagcctctacaaaacgggtgtgtttagcacacctctcaggctttgtgtggctgagacaagcatatgcaatgcccaccctgggcacacagcatggcacaaagtatgaaactcgctaactcaggtttctgcccttgcatccccatggttcctagcacagtccctgggacatgaaaggcatcggatcaacgtttgctccag

SEQ ID NO: 244504 - DNA, 446 bp, Homo sapiens
ggggagtttgaagaatggggtcctgaccttgctaggcaccatttgaagtgctcacatgtcctttgtcttattcagtctccatttgttttcatttatgagtgaaaggagatgaaattgagatggacttgccttgctcttggtgcagagctgtgattacagagttgatgagaaagctgttccaactgtgcatggagatgcattccgtggtcaatctgcacatggctgtcaggaactagctggagtcagcaggagagagagcaatgccttgttcatccatccaggtggggctccgagagcttccaaaccaatggataagaaggaggagccacagaggctagaaaagactgccgaccacagtttgtcccatgtagaactttctggaacattcagctgcagaaagtgaatgggctcaaagctttctgtctccttctgaacaggctgtctat

SEQ ID NO: 244505 - DNA, 350 bp, Homo sapiens
ttgttttgttttttgagacacagtctcactctgtcacccaggctggagtgcagtggcacaatcctggctcactgcaacctctgtctcctgggctcaagtgacctcagccttgcaagtacccagactacaggtgcatgccaccatgcccagctaatttttgtattttttgtagagatggagtctcaccatgttgcccaggctggtcgtctcaaactcctgggctcaagcaatctgctcaccttggtctcccaaagtgttgagattataggcatgagtcactgcgcctggccaaaaggcatttttatagaatcattctataaatgtcaccatgtggtctaaaaccagtaagc

SEQ ID NO: 244506 - DNA, 426 bp, Homo sapiens
agatagatcttaaagtaattctaaagttttgccacagagatagctgaaacagcttagtcgccttggacttgggtatccccaaatagccccattttctagagtggttcaagcaatctagcataagttaaaatcttgcccttttggaatagatctgggttttttttgtttgtttgtttgttttgtttttgtttttttgagacagggtcttgctctgtcatccaggctagagtacagtggcatgatcatgggtcactgcagcctcatgccccgagcccaatcgatcctcccacctcactatttgggcggctgaggcaggagaatcacttgaaccttggaggtggaggttgcagtgagcagagatcacgccactgctctccagcccggaccacagagtgagagtctgtctcaaaaaatcaaagaaaaaga

SEQ ID NO: 244507 - DNA, 647 bp, Homo sapiens
ggagcagccctgggcctgttgcacaattcacacactgtatgtggagcggagtgctgtgctggcagatgcaataggttgactggtgggttctattgcaccagtgggctttgggctatcaaagagagactcttctggaaccaaaaatgtaaaagaaaccaacacaatttctgaaagaacccatctcagctacagaacaaatgcaaacatccttccaaaaatataagcaaacagatgaacaataattggacacaaaaatacttagcaattcaaaaggagaggactagtctctgtgctcagacagggctgttgtcagaaacaggagaaaacaaaagatacggccttgctgataaaacaagaataagctatcataaaaaaggaacaataagaaaataactttcttagaggtgaaaaatgcaattgcccaagtaaaacacccaatgaagataatgaagatggtagctagcagactgtataatgcagtaaacctaattagtgaattagaagatccttacagagtatcagtttaagggctaggtatgggggctcacacctataacccaagcactttgggaggccaaggcaggaggattgcttgaggccaagagttcaagactaacttgggcaacatagtgagactctgtctccac

SEQ ID NO: 244508 - DNA, 408 bp, Homo sapiens
gatgataaacatgctgacaatttccaaggctgtaccctatttaattataaattacaagtattgttgcttgttttaattttcataatgtttgagaaatgcaattgcataaatcacaggagcattgtatatagttttgtccagaaattcacaaaatttttcaccaatacaaaaaaaatcccattctgaacaacatatctgcttacggtattttaagagttattcaacacagcattttctgcatttgatattactgaaatcataatgattcttcagggaatgcaggaattgatgcaatcctctgcctccaagtacagctgtgtttgagcttttctatacttaaatgcaatgtttagaattttttagtagttgtgtaatttattaagaaaataaaagagattttaaaattat

SEQ ID NO: 244509 - DNA, 209 bp, Homo sapiens
caaatatatgtagaaaataaaaataatttggaaattcttatctacaatatggaccaatgatatcatgaacaataaattttcataatatacaatggggtctaaatgtaacagtaggccctcaactctcaagaggaacaaagtgtgtttttaaaaaaactaacaacaaaagcacaatccttgaaacaaacaacaacaaaaaatgataaact

SEQ ID NO: 244510 - DNA, 444 bp, Homo sapiens
agggtgctgttctgttgagcatgctagagtgcaatggtgtaatcaatcatagctagctgcagcttcaaactcctgggtccaagcgatcctccccgctcagcaccccaagtagctgagactacaccaccatgcccagctaattaaaaaaaattttttttagagatggggtctcactatgttgcccaggctggtctcaaattttcggcctcaagtgatcctcccaccctggcctcccgaagcactgagattacagatatgagccacagagcccagtggtttatgagtcttaactcctcttctggaacctaagtttcctgatggcagatatgctatgagatatatctttgtacttctgatgaatccaaaacaatgtggaaggtatttcaggctctcgctcaatacttagaaataaaactggtaggttgaattacttctggtaattca

SEQ ID NO: 244511 - DNA, 614 bp, Homo sapiens
tatccccttatttggtcagaaagtacccttatatacatatgctcaaatacatccaaactcctgccaaatcctgtaggttcatactgctactgtgcttctatcttaaaatctgatccttctcatcttttcctgctagcatggcctagttcatgtcaattttccttccatctatatttggatgtttctgcctatataggttaggtgctgggatattaacctcctctggttttactgtgtcccttcagattaagccacattaaacaagccactaaaattatctctttaaaacctcagtgtgtttaccatctgaatgtagctctgtgatggaaaaatcatgtctctttgattattgtggtgttctagacacttagaagagctcttgggggcacaatagacattatgtatggatgtagaggaaagggagataataaggaagactcccttttggttcttattttgcacaagaggtgaacgcaaataacattcaatggaagtggataaaattaaggacatctcagagatgtctgtcctcaccacatccaaagcctaggcttttgcttttgtaaacatgcatattctctttctcttccttcttttctattactatccaatta

SEQ ID NO: 244512 - DNA, 438 bp, Homo sapiens
gtgttcagatcaaagacttagcatgacatcctgccccaactagcctccatatttaaaatcaaaacttgttaagttgaatttcataaagggctctcgttctttttccacaagggaaggaaggctgacctgctggtgaaaagcccttagggtggactgagttacccactgctgtccatgcccatgtgggatcctgcagctctaactttgcccaggctgtactctcggcctagaccactcttccttctttcctttgttcccaacttcccctcccccaactcctgtgtccctctctccagggagcctcctgtaatgtcctccagggcattgtgacctctccctccctagagcagacagcggttgactggctgccttcttagataactgaacattgatagccaccattcagatttattgcttactttatatggctgggcaaag

SEQ ID NO: 244513 - DNA, 941 bp, Homo sapiens
tacattgccagggtgaaattcaacagaagtgttttagggtaaagatcttgaggcccatgtgggcaaattatgagggtgatatgtagcttctttttctttgtagctatcttatttaggaataaaatgggaggcaggtttgtctgaggcagttcccagcttgactttaacctttgacttagtgattttgggttctgagatttattttcctttgacacaacctaataagtagttatgtcctaacaacttagtagctatttgagaagataacataattgaaagaaaaaaataatatgtttattttgttcttaaacagccataactactaatgggaaatgtatctctgttggtcattacaccagtgtctgaaaccttggaatcagattggacacttccaccctcatttcctgttctaggtagatttttagcattgttcttgttttttattacagcaactgctaacagctgcttaaaagtcagctccacaaagaaataatgtcattgaaaggaatatagcacaatgtaatgttcaagctgtgaaccacctggagctagtagttttgaggtattgagcaaatatcactgtgtttccctcgaaaatttaaaatattccacaacaccctgagagtttgctgcaatgctgtaggccacagttcgggagctgttgcagaactagagagttggttttttgtttattgctagtatttaattatgtgtaacacaggttaagaaataatactcatcagtgagattttggaagcattaaagatggatctttctgttcctctttaaaatatagatggggctgggtttgcttctttggcacttgaggcagaactaattaaaaagtgaggacacaaagagataattaagttgtccttgcttctaagtaagtatttctgttcctgcctggctctgaagttaagtgactataattagaagga

SEQ ID NO: 244514 - DNA, 834 bp, Homo sapiens
  misc_feature (84)..(84): n is a, c, g, or t
  misc_feature (127)..(127): n is a, c, g, or t
ttagcggcagcatttatatattagtaagacagggtggtcaggctggtgtagactcctgaactcaggcgatccatctgtctcggncttcccaagtgctggaattacaggcgtgagaccacaaggccgngctctagaattttaattctatgaagaagacagattaggtgaataattagatactgttctgcttgtaaagacaatacagttttccatattttacaaaagaagaaatgggagaaaggggtttaagtaacttgccctagtcacacagtaaggagaagcctgctacccaaacttctggcttgagtactcaaccacttactttctgtgctttatttccctttacgtggcagcaccattctgcagaaaacttccaagcagtttttttcacttaaaaattaaaaccctgtttactgccacctcttgactctttgccatgtgttgggctgtacatttgcttctaataaagataattggtctgttctttttctctttgaatcgggtcttgctcttttgccaggctggagtacagtggcatcgcagtcatggctcacgacagcctcaaactcctatgctgaagccatcttcctccctcagtctctcaggcagctgagactatgggtgtgtatcaccatgcccagctggggtgcagtggtgcggtctcgctcactgcaacctgcatctcccaggttcaagcgattctcctacgtcagctacttgggaggctgaaccagaggaatcgcttgaacccggggggcagaggttgcagtgagctgagatcatgacgctgtgctccagactgggcaacacagcgagtctctgtcttccaaaaga

SEQ ID NO: 244515 - DNA, 355 bp, Homo sapiens
ccaccctcgagtcggctttcgcccgtggggaaactgaggctgcctggtcgaaggcctccacggggaagcgccgaggcctcctccatgcctgggacctgggggtcttaatgaagggagagtccaccctcccgggcgaggatcccgatccatgaggcgccaacccccgcccgggcgcccgggtccagcctccccggccgagggtcggcctcacactcccctgctttgggtgtttggttttgtttaaaaaatgggactatactatatggtctacctgggtcttgccccctctgtgtgggtgacatatatcttagagattgttcaaaataaaaaacatagagaaaaggagaaaaataga

SEQ ID NO: 244516 - DNA, 481 bp, Homo sapiens
ccttcatctctactcttccaagatagaatcgctacttctgtaagtgccccaaagagcactcagctgagagcatcctatactaccaataaattctccttatgatcaatatcacaaagctctgaataatctggctgatgatgtgttcaaagagtagactccaggtgcagtatacctatgcttggtatcacaccagattgggtccattcctttctctgcattttgtattggatacccatcatcacagttgacttcactatgctgttattcttactgaatgttgaaacagactccaaatgggcatcttatactgatgcttaaactgaatgcttatatgcattactttggcttcaaagaaggcttttatgttttttgctatttattataaacagtatggaattttggcacctataaaagcaattattgcctgctggtcagtgacaactcaaactactttacctcaacatctccattttacacagta

SEQ ID NO: 244517 - DNA, 650 bp, Homo sapiens
aatccccaaataatgagaagggctggtcccacattatccatccagaaccttccatgctccaagccagaatgttggcaagatcgggttttgccttgagctatcctgggatgtgagacaaaccgatttctccatagatgggctgcagggagtgggaggcagtactccaggagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagcaaaaacta

SEQ ID NO: 244518 - DNA, 387 bp, Homo sapiens
ggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggt

SEQ ID NO: 244519 - DNA, 256 bp, Homo sapiens
tcattccatttcatacttctttatatcgcaaatgcaattgtgctaattatcactacacttcatcaaatctaagtctacgttatttaataaaactattgccaatcaaactgtgacattcacattcttattagttagaatttttgttttatcttaaagaatgagctgtttagccctatctacttgtattttataatattacattcttttgtactttgcattctttgttcaaaaaacaaaaatgttgattaaagtatgt

SEQ ID NO: 244520 - DNA, 179 bp, Homo sapiens
accctccagctctctttgcctgtgccagggccacttggataccatggattgagatggcagggccacagaacgcaatccacctggaccctggagtccccaaggagctaccctggagaccagctggaccctcagcagaatttcagaaagttagaaataaaattctgtgtgtgattccactg

SEQ ID NO: 244521 - DNA, 433 bp, Homo sapiens
gtacctttggcctctgccccagttcctggcatggagctcctaacccttagcctttccgggatgccaggagcatcctttgttctactgaggtacccatgggggctcctggatgggggctgcacatcagagagccccccctaggattagaagcctagaactctcagccccagcccctgggaagaagagggctgggacgctgaggtcatcaggggtcatgcttatgtgatgaagcctcaaaagaaatccctaaaagacaaaagacaggacttgggagcatccagggtggaaacacatcagtgccgtgagggcagccacccccactcagtggggacagggctcctgcgctctggaagcttccggaccccaccctacggaccccgtcctgcgagtcctttgtaacatcctctataataaaccagcatgtgtaagtgtt

SEQ ID NO: 244522 - DNA, 575 bp, Homo sapiens
tctcaagcccatagtgaattgtgcccggacatctgacatcaacatctatgcaggctttgaaatggggtttgacacctttctgagggcagtaagagaggttgagaataataatcaaagtgaaaattcaggatgggatccagggaagtttggtagaattgttcttctctatttatcctcttagactcttctcagtttgattcacccttgacttctgcaagtaaggagtgaactaggaagcagcatggagagacctgggacacacttgggtcctttggcctcttggttagattttgagagtgatatttgggttctcttcttaaatcaaaaaccttaaagcagaaccatctgccatccaccttgcctctgtttcttcctttagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaagg

SEQ ID NO: 244523 - DNA, 1959 bp, Homo sapiens
agccgccgcagcctcggccgccgggcaagtagctccgagcggctgcttcccggttgcctcgacgaagacagggggcgccgcgctccgcttgctccgcgcctgagccatgcccagcagccctgtgtaaccaccgagtcccggccggagccgaccgacccagtgtgcgccgtctttcggccgagctgagctttcgtgcacgcaactccctctgccccagccggccccgcgccaccatgccccgggcgactgcacttggggccctggtgtcactgctgctgctgctgccgctgcctcgcggcgccgggggactcggggagcgcccggacgccaccgcagactactcagagctggacggcgaggagggcacggagcagcagctggagcattaccacgacccttgcaaagccgctgtcttttggggagacattgccttagatgaagatgacttgaagctgtttcacattgacaaagccagagactggaccaagcagacagtgggggcaacaggacacagcacaggtgggcttgaagagcaggcatctgagagcagcccagacaccacagccatggacactggcaccaaggaagctggaaaggatggccgggagaataccacactcctgcacagccctgggaccttgcatgccgcagccaagaccttctctccccgggtccgaagagccacaacctcaaggacagagaggatatggcctggaggagtcatcccctacgtcattggagggaacttcactgggagccagagggccatttttaagcaggccatgagacactgggagaagcacacctgtgtgaccttcatagaaaggacggatgaggaaagctttattgtattcagttacagaacctgtggctgttgctcctatgttgggcgccgaggaggaggcccacaggccatatccattgggaagaactgtgacaagtttggcattgtggctcacgagctgggccatgtggttgggttttggcatgaacacacccggccagacagagaccaacatgtcaccatcatcagggaaaacatccagccaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccagcgtgtggggagaccctgcaggacacaacgggaaacttttctgcacctggtttcccaaatgggtacccatcttactcccactgcgtctggaggatctcggtcaccccaggggaaaagatcgtattaaacttcacatccatggatttgtttaaaagccgactgtgctggtatgattacgtggaggtccgggatggttactggagaaaagccccccttttgggcaggttttgtggcgataagatcccggagcccctcgtctccacggacagccggctctgggtggagttccgcagcagcagcaacatcttgggcaagggcttctttgcagcgtacgaagctacctgcgggggagacatgaacaaagatgccggtcagattcaatctcccaactatccggatgactacagaccttccaaggaatgtgtctggaggattacggtttcagaggggtttcacgtgggacttaccttccaagcttttgagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaagg

SEQ ID NO: 244524 - DNA, 6764 bp, Homo sapiens
  misc_feature (3218)..(3218): n is a, c, g, or t
  misc_feature (6410)..(6410): n is a, c, g, or t
agccgccgcagcctcggccgccgggcaagtagctccgagcggctgcttcccggttgcctcgacgaagacagggggcgccgcgctccgcttgctccgcgcctgagccatgcccagcagccctgtgtaaccaccgagtcccggccggagccgaccgacccagtgtgcgccgtctttcggccgagctgagctttcgtgcacgcaactccctctgccccagccggccccgcgccaccatgccccgggcgactgcacttggggccctggtgtcactgctgctgctgctgccgctgcctcgcggcgccgggggactcggggagcgcccggacgccaccgcagactactcagagctggacggcgaggagggcacggagcagcagctggagcattaccacgacccttgcaaagccgctgtcttttggggagacattgccttagatgaagatgacttgaagctgtttcacattgacaaagccagagactggaccaagcagacagtgggggcaacaggacacagcacaggtgggcttgaagagcaggcatctgagagcagcccagacaccacagccatggacactggcaccaaggaagctggaaaggatggccgggagaataccacactcctgcacagccctgggaccttgcatgccgcagccaagaccttctctccccgggtccgaagagccacaacctcaaggacagagaggatatggcctggaggagtcatcccctacgtcattggagggaacttcactgggagccagagggccatttttaagcaggccatgagacactgggagaagcacacctgtgtgaccttcatagaaaggacggatgaggaaagctttattgtattcagttacagaacctgtggctgttgctcctatgttgggcgccgaggaggaggcccacaggccatatccattgggaagaactgtgacaagtttggcattgtggctcacgagctgggccatgtggttgggttttggcatgaacacacccggccagacagagaccaacatgtcaccatcatcagggaaaacatccagccaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccagcgtgtggggagaccctgcaggacacaacgggaaacttttctgcacctggtttcccaaatgggtacccatcttactcccactgcgtctggaggatctcggtcaccccaggggaaaagatcgtattaaacttcacatccatggatttgtttaaaagccgactgtgctggtatgattacgtggaggtccgggatggttactggagaaaagccccccttttgggcaggttttgtggcgataagatcccggagcccctcgtctccacggacagccggctctgggtggagttccgcagcagcagcaacatcttgggcaagggcttctttgcagcgtacgaagctacctgcgggggagacatgaacaaagatgccggtcagattcaatctcccaactatccggatgactacagaccttccaaggaatgtgtctggaggattacggtttcagaggggtttcacgtgggacttaccttccaagcttttgagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaaggaggtggatgagtgttcctggccagatcacggcgggtgcgagcatcgctgtgtgaacacgctgggcagctacaagtgtgcctgtgaccctggctacgagctggccgccgataagaagatgtgtgaagtggcctgtggcggtttcattaccaagctgaatggaaccatcaccagccctgggtggccgaaggagtatcccacaaacaaaaactgtgtctggcaggtggtggcccccgctcagtaccggatctcccttcagtttgaagtgtttgaactggaaggcaatgacgtctgtaagtacgactttgtagaggtgcgcagcggcctgtcccccgacgccaagctgcacggcaggttctgcggctctgagacgccggaggtcatcacctcgcagagcaacaacatgcgcgtggagttcaagtccgacaacaccgtctccaagcgcggcttcagggcccacttcttctcagataaggacgagtgtgccaaggacaacggcgggtgtcagcatgagtgcgtcaacaccttcgggagctacctgtgcaggtgcagaaacggctactggctccacgagaatgggcatgactgcaaagaggctggctgtgcacacaagatcagcagtgtggaggggaccctggcgagccccaactggcctgacaaataccccagccggagggagtgtacctggaacatctcttcgactgcaggccacagagtgaaactcacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacagagtgcgggggcaggctgaaggctgaagtgcagaccaaagagctctattcccacgcccagtttggggacaacaactacccgagcgaggcccgctgtgactgggtgatcgtggcagaggacggctacggcgtggagctgacattccggacctttgaggttgaggaggaggccgactgcggctacgactacatggaagcctacgacggctacgacagctcagcgcccaggctcggccgcttctgtggctctgggccattagaagaaatctactctgcaggtgattccctgatgattcgattccgcacagatgacaccatcaacaanaaaggctttcatgcccgatacaccagcaccaagttccaggatgccctgcacatgaagaaatagtgctgatgttcttgaaagacagaaactgagaattttttttgttttgttttgtttttaacaacaatagcaccttgaaaatctgccctaaaacagtgtacagtatttttctcaaacaaaaactcagaatccagccttagaggtatatatttgaatgaaagtcttgtaagtttggccaacaaggtggagagaaaaatgttcttttgcttctgtctgcaatgttatcattcatgaactgttaaagtgttaaagattaggattgaagtcactgaccattccggctatgcttcttcataccattctccttgtcccttgctcctatgtggcaaaaggtcagccttggggttggccgttcctctaatctggacttgcttgcaaaggtgccaggctgtcttctgtccatgttgggcataagggatgaaaacttggccgagactaatgtgtggcccacagctttggctggaatcattttctttctctctgccagggacatgtcaaccaagaaacctgaaaatatggatggatgtcaggactaaaaaaaggcatcacagtgagcagtgagcacagagggagtttcgagtataagaatcattgtcatgaagttaggagaccacaaagccatttctcagagtcattcactctccttgtccctttggtttccccccctccctaattgcagtgggggctaaggcatccattatgaatacagcagaacatttgctggcgagagtcctgtctgctgagaagacaatattgtggctcgtcctgatattttttcattcattgactttgagaagactccacctgtgcttggaattccatgggcttcaaagaacatttcttcttttagctttggaggcacttgccgtggcacacctggactccttgacatccaattcaaactgcatttgcaaaatgtgcaaagacctcttatgagggaccaattcaggtcccttatggggtgaacactgttgaagactggttaattataagttatgtaagaatcatcgccttgtggaacaagtcaatcagtgactagcttcctgtagccaatcaggttaaagagtgcgttggtaactttgctctgattaactagtattcaatcaccaacttgcaaacagaattcataacacttggcacttgttctagagaagtgtagaggatgatgtttacataattttagcacctcaaggtataatttaaacagtgaggtagttttgaatggcatttcattaaggcatctatgggcattatgagctaaaagctgtggtatgttagctttaaaagagtatttatgttggaataatttttaaataatgtttacataactgtaagtcctgtttggttgttgttggacgcagggcggcacatgagtgtttttggttagagccaagatagctcccatgcaccggaattcctttgggatgaatcagcatcattttaaacaaagtatatgtaaaaggtgaaaggttatattttttacagatcagaatgtggcaccagaggactgtgtctcattaaagtgattgctgggagcaaaaactagaatgatacaaagaaaggtcagagaaatgcatgggaatattttttccttaaaacagaaaaaaattaaagtattattaataatatatgtctgtatatatgtatgtatgtaaaagatcagctgtcaaagccttaatcaatgcagtgtggaaaatgccaacccctggtcctcgctttactgtgggccctgcaggactggctctccatttcctgcctctcctttcaccaagctctgttttggcctttctcggccctggactgaggctcagcctacacgctcatattgtgcatatggcagaccctgcccagcgtgcgctttgatacagcaaatggagcagctgacctcatggctccaatcccacctgcctgttagggtagattccatttatctgatttttgtattttctgaggttttatttggtctcatcttgtctatgagagttgaaactggaactgggaaacctaagatgggtgttatggttctttctccaaggaaataaaaattctgcagttttaacctttagaagtctaagcaagattaacaaatttcatagaaaagtgggagggagtcagaaacagagttggtgctgctcagcaggacggtgaaacaatgatacttctttttatctctttagtatgaacattttcaaaaacacacagcttcaacaattgtcaccatatggccaatttgcaacaatgggactcttatgaaaaacctttatttaggccttctgtgtgacgtatccacagaaaagagaagctctgattcagctggggctagctgggccgctcctctggaagcccacacttgtggggacttaggcatgacacaggttcttgcaaagaaactagaggctggcttcactagagagagtccattcagcagaaagtcccaggcctctgccttggtgcttccaattatcagtgacctgcctgcaagcatccccagaagcaaacagcagaggtagaagatatcactgcagcctgctttgtgctttaattgggtaccaagctttggggatgacagtgagttgcaagaatagttttagttcagagaattgtcttaggacaacaggctaatgaaggatttggggtctgggtttttagcctggctccgttctggtgtaacccggtctagcaaaagctaagcctggattgcagggcaggaaaaaatctggaattaactttagccagtggaatttcttcaaacagagaaagagaggctgttcattgatccactattccctctattttcctctaaggtaaatatttagaggtatttacctgtaaggtgaagtttcctttttatttctactttacaatttctctctaaagcaagcttgtccaacccttggcccaggacggctttgaatatggcccgacacaaattcgtaaactttttaaaaaacattgtaagattctttctgtgatttttttttttctcgtcagctatcgttagtgtattttatgtgtggcccaagataattcttcttccaatgtggcccagggaagccaaaagatgggacacccctgctgtaaagtttcatatcactcatgaattgctcagctgatttaaataatttgtaaaancctgctaactagcaaattcacattgagattttctattgattgggtccctttgatagctttcagattggtattgttagcgttccatttgtgaacaaatgttcccttggctttagcagatgtttttaaagtttcttttgtagaccgaacttctgaagagtaataccaaatgcctaaaattttatttttaaaaaggaaaattgtttaaagtattatatgtaaacatatgggtattttttattttgtgtaattttacatttcatgaaatgatgtcagtttcaaagagaaagtggagaggacctaacatatgtctctacctagaaaggatggtttcattaaagaatgtggatttattga

SEQ ID NO: 244525 - DNA, 4889 bp, Homo sapiens
  misc_feature (1343)..(1343): n is a, c, g, or t
  misc_feature (4535)..(4535): n is a, c, g, or t
ggatggtggctatattgattgcgcgcttttcgctaccatagaatcatcaccagaagtaagagagaaaatgcgcataaatgcttggcatggaataaacactcggcgagagtcagccaccatgagggtgctgcctggagcagcgtgcacctcatacaacctcaccagcgtcatttgtactaaagggtcgtgcagcagagtgcacaggtcaacagcagggtctctgatgccagagcaccagatcatggcccaactctcagtatgtgaccttgggcaagtcatctgacagcgatgagcctcattttcctcacctgtaaagcggggattagacacatcacaggggtgtaaagattaaatgaggcgatacttgtaaagcatttaaaacagctgccgacagagtgggcactcagcccttgctggctcttagccctaagtgagagagaagctgtgtgatgggatggaaggaagacagatttgggctgtgtaaagcctggctctgtcgcttaatagctgtcaaaatgtcaagcatttaatctctgaacccctgctctctcatctgcagtgtggtcattgtagcaatagctcatgtaactacttcatagggccacttgctggaccaaaagcaaggcggaggttgagaccctctctacagatgtcctcaagcatcatcacggccacacaccccctgcacagccagctggacgtctccctgcactgcctcgccccttcctgtcccagaactggaaaggaggcccccaccccagctgaacgccaggcccttgccttactttctgctcttctgtccccagacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacagagtgcgggggcaggctgaaggctgaagtgcagaccaaagagctctattcccacgcccagtttggggacaacaactacccgagcgaggcccgctgtgactgggtgatcgtggcagaggacggctacggcgtggagctgacattccggacctttgaggttgaggaggaggccgactgcggctacgactacatggaagcctacgacggctacgacagctcagcgcccaggctcggccgcttctgtggctctgggccattagaagaaatctactctgcaggtgattccctgatgattcgattccgcacagatgacaccatcaacaanaaaggctttcatgcccgatacaccagcaccaagttccaggatgccctgcacatgaagaaatagtgctgatgttcttgaaagacagaaactgagaattttttttgttttgttttgtttttaacaacaatagcaccttgaaaatctgccctaaaacagtgtacagtatttttctcaaacaaaaactcagaatccagccttagaggtatatatttgaatgaaagtcttgtaagtttggccaacaaggtggagagaaaaatgttcttttgcttctgtctgcaatgttatcattcatgaactgttaaagtgttaaagattaggattgaagtcactgaccattccggctatgcttcttcataccattctccttgtcccttgctcctatgtggcaaaaggtcagccttggggttggccgttcctctaatctggacttgcttgcaaaggtgccaggctgtcttctgtccatgttgggcataagggatgaaaacttggccgagactaatgtgtggcccacagctttggctggaatcattttctttctctctgccagggacatgtcaaccaagaaacctgaaaatatggatggatgtcaggactaaaaaaaggcatcacagtgagcagtgagcacagagggagtttcgagtataagaatcattgtcatgaagttaggagaccacaaagccatttctcagagtcattcactctccttgtccctttggtttccccccctccctaattgcagtgggggctaaggcatccattatgaatacagcagaacatttgctggcgagagtcctgtctgctgagaagacaatattgtggctcgtcctgatattttttcattcattgactttgagaagactccacctgtgcttggaattccatgggcttcaaagaacatttcttcttttagctttggaggcacttgccgtggcacacctggactccttgacatccaattcaaactgcatttgcaaaatgtgcaaagacctcttatgagggaccaattcaggtcccttatggggtgaacactgttgaagactggttaattataagttatgtaagaatcatcgccttgtggaacaagtcaatcagtgactagcttcctgtagccaatcaggttaaagagtgcgttggtaactttgctctgattaactagtattcaatcaccaacttgcaaacagaattcataacacttggcacttgttctagagaagtgtagaggatgatgtttacataattttagcacctcaaggtataatttaaacagtgaggtagttttgaatggcatttcattaaggcatctatgggcattatgagctaaaagctgtggtatgttagctttaaaagagtatttatgttggaataatttttaaataatgtttacataactgtaagtcctgtttggttgttgttggacgcagggcggcacatgagtgtttttggttagagccaagatagctcccatgcaccggaattcctttgggatgaatcagcatcattttaaacaaagtatatgtaaaaggtgaaaggttatattttttacagatcagaatgtggcaccagaggactgtgtctcattaaagtgattgctgggagcaaaaactagaatgatacaaagaaaggtcagagaaatgcatgggaatattttttccttaaaacagaaaaaaattaaagtattattaataatatatgtctgtatatatgtatgtatgtaaaagatcagctgtcaaagccttaatcaatgcagtgtggaaaatgccaacccctggtcctcgctttactgtgggccctgcaggactggctctccatttcctgcctctcctttcaccaagctctgttttggcctttctcggccctggactgaggctcagcctacacgctcatattgtgcatatggcagaccctgcccagcgtgcgctttgatacagcaaatggagcagctgacctcatggctccaatcccacctgcctgttagggtagattccatttatctgatttttgtattttctgaggttttatttggtctcatcttgtctatgagagttgaaactggaactgggaaacctaagatgggtgttatggttctttctccaaggaaataaaaattctgcagttttaacctttagaagtctaagcaagattaacaaatttcatagaaaagtgggagggagtcagaaacagagttggtgctgctcagcaggacggtgaaacaatgatacttctttttatctctttagtatgaacattttcaaaaacacacagcttcaacaattgtcaccatatggccaatttgcaacaatgggactcttatgaaaaacctttatttaggccttctgtgtgacgtatccacagaaaagagaagctctgattcagctggggctagctgggccgctcctctggaagcccacacttgtggggacttaggcatgacacaggttcttgcaaagaaactagaggctggcttcactagagagagtccattcagcagaaagtcccaggcctctgccttggtgcttccaattatcagtgacctgcctgcaagcatccccagaagcaaacagcagaggtagaagatatcactgcagcctgctttgtgctttaattgggtaccaagctttggggatgacagtgagttgcaagaatagttttagttcagagaattgtcttaggacaacaggctaatgaaggatttggggtctgggtttttagcctggctccgttctggtgtaacccggtctagcaaaagctaagcctggattgcagggcaggaaaaaatctggaattaactttagccagtggaatttcttcaaacagagaaagagaggctgttcattgatccactattccctctattttcctctaaggtaaatatttagaggtatttacctgtaaggtgaagtttcctttttatttctactttacaatttctctctaaagcaagcttgtccaacccttggcccaggacggctttgaatatggcccgacacaaattcgtaaactttttaaaaaacattgtaagattctttctgtgatttttttttttctcgtcagctatcgttagtgtattttatgtgtggcccaagataattcttcttccaatgtggcccagggaagccaaaagatgggacacccctgctgtaaagtttcatatcactcatgaattgctcagctgatttaaataatttgtaaaancctgctaactagcaaattcacattgagattttctattgattgggtccctttgatagctttcagattggtattgttagcgttccatttgtgaacaaatgttcccttggctttagcagatgtttttaaagtttcttttgtagaccgaacttctgaagagtaataccaaatgcctaaaattttatttttaaaaaggaaaattgtttaaagtattatatgtaaacatatgggtattttttattttgtgtaattttacatttcatgaaatgatgtcagtttcaaagagaaagtggagaggacctaacatatgtctctacctagaaaggatggtttcattaaagaatgtggatttattga

SEQ ID NO: 244526 - DNA, 1031 bp, Homo sapiens
agagagaagctgtgtgatgggatggaaggaagacagatttgggctgtgtaaagcctggctctgtcgcttaatagctgtcaaaatgtcaagcatttaatctctgaacccctgctctctcatctgcagtgtggtcattgtagcaatagctcatgtaactacttcatagggccacttgctggaccaaaagcaaggcggaggttgagaccctctctacagatgtcctcaagcatcatcacggccacacaccccctgcacagccagctggacgtctccctgcactgcctcgccccttcctgtcccagaactggaaaggaggcccccaccccagctgaacgccaggcccttgccttactttctgctcttctgtccccagacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacaggtacctggggtgggacactggcttccacctgatgagcacttggacaggagacagagaaatggtgaaggcacgacaaggactgccttttattctgactgggggagggcgaggggaggaaggtgcgtgataaaatgtcctattaaaatgaagcatcaagctgggcgtggtggctcatgcctgtaatcccagcactttgggaggccgaggcaggcggatcatctgaggtcaggagttcgagaccagcctgggcaacatggtgaaaccccgtctctactaaaaatacaaaattagctgggcatggtggttggtgcctgtaattccagctactcaggaggctgaggcaggagaattgcttgaacctggaggcagagattgcagtgagccaagatcgtgccattgcactctagcctggacgatagagtgagactttgtctctaaaaaaat

SEQ ID NO: 244527 - DNA, 1893 bp, Homo sapiens
agccgccgcagcctcggccgccgggcaagtagctccgagcggctgcttcccggttgcctcgacgaagacagggggcgccgcgctccgcttgctccgcgcctgagccatgcccagcagccctgtgtaaccaccgagtcccggccggagccgaccgacccagtgtgcgccgtctttcggccgagctgagctttcgtgcacgcaactccctctgccccagccggccccgcgccaccatgccccgggcgactgcacttggggccctggtgtcactgctgctgctgctgccgctgcctcgcggcgccgggggactcggggagcgcccggacgccaccgcagactactcagagctggacggcgaggagggcacggagcagcagctggagcattaccacgacccttgcaaagccgctgtcttttggggagacattgccttagatgaagatgacttgaagctgtttcacattgacaaagccagagactggaccaagcagacagtgggggcaacaggacacagcacaggtgggcttgaagagcaggcatctgagagcagcccagacaccacagccatggacactggcaccaaggaagctggaaaggggagccagagggccatttttaagcaggccatgagacactgggagaagcacacctgtgtgaccttcatagaaaggacggatgaggaaagctttattgtattcagttacagaacctgtggctgttgctcctatgttgggcgccgaggaggaggcccacaggccatatccattgggaagaactgtgacaagtttggcattgtggctcacgagctgggccatgtggttgggttttggcatgaacacacccggccagacagagaccaacatgtcaccatcatcagggaaaacatccagccaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccaggtcctacttgtgcttttgttagccagaaaacatcaatctgcttgctacacttctcaccaacctgttccgagggctttggctggcaaagggcgtgtggggagaccctgcaggacacaacgggaaacttttctgcacctggtttcccaaatgggtacccatcttactcccactgcgtctggaggatctcggtcaccccaggggaaaagatcgtattaaacttcacatccatggatttgtttaaaagccgactgtgctggtatgattacgtggaggtccgggatggttactggagaaaagccccccttttgggcaggttttgtggcgataagatcccggagcccctcgtctccacggacagccggctctgggtggagttccgcagcagcagcaacatcttgggcaagggcttctttgcagcgtacgaagctacctgcgggggagacatgaacaaagatgccggtcagattcaatctcccaactatccggatgactacagaccttccaaggaatgtgtctggaggattacggtttcagaggggtttcacgtgggacttaccttccaagcttttgagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaagg

SEQ ID NO: 244528 - DNA, 5380 bp, Homo sapiens
  misc_feature (1834)..(1834): n is a, c, g, or t
  misc_feature (5026)..(5026): n is a, c, g, or t
tctcaagcccatagtgaattgtgcccggacatctgacatcaacatctatgcaggctttgaaatggggtttgacacctttctgagggcagtaagagaggttgagaataataatcaaagtgaaaattcaggatgggatccagggaagtttggtagaattgttcttctctatttatcctcttagactcttctcagtttgattcacccttgacttctgcaagtaaggagtgaactaggaagcagcatggagagacctgggacacacttgggtcctttggcctcttggttagattttgagagtgatatttgggttctcttcttaaatcaaaaaccttaaagcagaaccatctgccatccaccttgcctctgtttcttcctttagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaaggaggtggatgagtgttcctggccagatcacggcgggtgcgagcatcgctgtgtgaacacgctgggcagctacaagtgtgcctgtgaccctggctacgagctggccgccgataagaagatgtgtgaagtggcctgtggcggtttcattaccaagctgaatggaaccatcaccagccctgggtggccgaaggagtatcccacaaacaaaaactgtgtctggcaggtggtggcccccgctcagtaccggatctcccttcagtttgaagtgtttgaactggaaggcaatgacgtctgtaagtacgactttgtagaggtgcgcagcggcctgtcccccgacgccaagctgcacggcaggttctgcggctctgagacgccggaggtcatcacctcgcagagcaacaacatgcgcgtggagttcaagtccgacaacaccgtctccaagcgcggcttcagggcccacttcttctcagataaggacgagtgtgccaaggacaacggcgggtgtcagcatgagtgcgtcaacaccttcgggagctacctgtgcaggtgcagaaacggctactggctccacgagaatgggcatgactgcaaagaggctggctgtgcacacaagatcagcagtgtggaggggaccctggcgagccccaactggcctgacaaataccccagccggagggagtgtacctggaacatctcttcgactgcaggccacagagtgaaactcacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacagagtgcgggggcaggctgaaggctgaagtgcagaccaaagagctctattcccacgcccagtttggggacaacaactacccgagcgaggcccgctgtgactgggtgatcgtggcagaggacggctacggcgtggagctgacattccggacctttgaggttgaggaggaggccgactgcggctacgactacatggaagcctacgacggctacgacagctcagcgcccaggctcggccgcttctgtggctctgggccattagaagaaatctactctgcaggtgattccctgatgattcgattccgcacagatgacaccatcaacaanaaaggctttcatgcccgatacaccagcaccaagttccaggatgccctgcacatgaagaaatagtgctgatgttcttgaaagacagaaactgagaattttttttgttttgttttgtttttaacaacaatagcaccttgaaaatctgccctaaaacagtgtacagtatttttctcaaacaaaaactcagaatccagccttagaggtatatatttgaatgaaagtcttgtaagtttggccaacaaggtggagagaaaaatgttcttttgcttctgtctgcaatgttatcattcatgaactgttaaagtgttaaagattaggattgaagtcactgaccattccggctatgcttcttcataccattctccttgtcccttgctcctatgtggcaaaaggtcagccttggggttggccgttcctctaatctggacttgcttgcaaaggtgccaggctgtcttctgtccatgttgggcataagggatgaaaacttggccgagactaatgtgtggcccacagctttggctggaatcattttctttctctctgccagggacatgtcaaccaagaaacctgaaaatatggatggatgtcaggactaaaaaaaggcatcacagtgagcagtgagcacagagggagtttcgagtataagaatcattgtcatgaagttaggagaccacaaagccatttctcagagtcattcactctccttgtccctttggtttccccccctccctaattgcagtgggggctaaggcatccattatgaatacagcagaacatttgctggcgagagtcctgtctgctgagaagacaatattgtggctcgtcctgatattttttcattcattgactttgagaagactccacctgtgcttggaattccatgggcttcaaagaacatttcttcttttagctttggaggcacttgccgtggcacacctggactccttgacatccaattcaaactgcatttgcaaaatgtgcaaagacctcttatgagggaccaattcaggtcccttatggggtgaacactgttgaagactggttaattataagttatgtaagaatcatcgccttgtggaacaagtcaatcagtgactagcttcctgtagccaatcaggttaaagagtgcgttggtaactttgctctgattaactagtattcaatcaccaacttgcaaacagaattcataacacttggcacttgttctagagaagtgtagaggatgatgtttacataattttagcacctcaaggtataatttaaacagtgaggtagttttgaatggcatttcattaaggcatctatgggcattatgagctaaaagctgtggtatgttagctttaaaagagtatttatgttggaataatttttaaataatgtttacataactgtaagtcctgtttggttgttgttggacgcagggcggcacatgagtgtttttggttagagccaagatagctcccatgcaccggaattcctttgggatgaatcagcatcattttaaacaaagtatatgtaaaaggtgaaaggttatattttttacagatcagaatgtggcaccagaggactgtgtctcattaaagtgattgctgggagcaaaaactagaatgatacaaagaaaggtcagagaaatgcatgggaatattttttccttaaaacagaaaaaaattaaagtattattaataatatatgtctgtatatatgtatgtatgtaaaagatcagctgtcaaagccttaatcaatgcagtgtggaaaatgccaacccctggtcctcgctttactgtgggccctgcaggactggctctccatttcctgcctctcctttcaccaagctctgttttggcctttctcggccctggactgaggctcagcctacacgctcatattgtgcatatggcagaccctgcccagcgtgcgctttgatacagcaaatggagcagctgacctcatggctccaatcccacctgcctgttagggtagattccatttatctgatttttgtattttctgaggttttatttggtctcatcttgtctatgagagttgaaactggaactgggaaacctaagatgggtgttatggttctttctccaaggaaataaaaattctgcagttttaacctttagaagtctaagcaagattaacaaatttcatagaaaagtgggagggagtcagaaacagagttggtgctgctcagcaggacggtgaaacaatgatacttctttttatctctttagtatgaacattttcaaaaacacacagcttcaacaattgtcaccatatggccaatttgcaacaatgggactcttatgaaaaacctttatttaggccttctgtgtgacgtatccacagaaaagagaagctctgattcagctggggctagctgggccgctcctctggaagcccacacttgtggggacttaggcatgacacaggttcttgcaaagaaactagaggctggcttcactagagagagtccattcagcagaaagtcccaggcctctgccttggtgcttccaattatcagtgacctgcctgcaagcatccccagaagcaaacagcagaggtagaagatatcactgcagcctgctttgtgctttaattgggtaccaagctttggggatgacagtgagttgcaagaatagttttagttcagagaattgtcttaggacaacaggctaatgaaggatttggggtctgggtttttagcctggctccgttctggtgtaacccggtctagcaaaagctaagcctggattgcagggcaggaaaaaatctggaattaactttagccagtggaatttcttcaaacagagaaagagaggctgttcattgatccactattccctctattttcctctaaggtaaatatttagaggtatttacctgtaaggtgaagtttcctttttatttctactttacaatttctctctaaagcaagcttgtccaacccttggcccaggacggctttgaatatggcccgacacaaattcgtaaactttttaaaaaacattgtaagattctttctgtgatttttttttttctcgtcagctatcgttagtgtattttatgtgtggcccaagataattcttcttccaatgtggcccagggaagccaaaagatgggacacccctgctgtaaagtttcatatcactcatgaattgctcagctgatttaaataatttgtaaaancctgctaactagcaaattcacattgagattttctattgattgggtccctttgatagctttcagattggtattgttagcgttccatttgtgaacaaatgttcccttggctttagcagatgtttttaaagtttcttttgtagaccgaacttctgaagagtaataccaaatgcctaaaattttatttttaaaaaggaaaattgtttaaagtattatatgtaaacatatgggtattttttattttgtgtaattttacatttcatgaaatgatgtcagtttcaaagagaaagtggagaggacctaacatatgtctctacctagaaaggatggtttcattaaagaatgtggatttattga

SEQ ID NO: 244529 - DNA, 111 bp, Homo sapiens
tgagttttaaattactttttaaacacgcaaaattccttttaaggatggtgtaatctcaaagttatttcaaaagaatattaaatgtattctctctagcagtgggagttcaga

SEQ ID NO: 244530 - DNA, 173 bp, Homo sapiens
taaatacaataaacgaacgtttccagaaatagatataaatactgtagaagaatgctagcatgtcgtacatctggatcaccttaaagaagcaacataaggctcaaagtcttaaaattattttgtaaaatgttaatgtgtacttagattttattaaaatcttttattgacttctt

SEQ ID NO: 244531 - DNA, 644 bp, Homo sapiens
tggtccttcttttctcacttctaatttttaagaataactgtagaatgtgctggaaatgcaaccttcagggataaagaagaatcagctggaacagcctaggttttattctagtctctcacagaaacaggatatccttcagtgctttagcccagcatatcatgttgccccttaggggtaaacccaaaggtaggctgctttctggagtccttcagctgcagtgcaggtggggaacaggaagatgagtttccatccaccttggacagcttttctgaggcttggggaactatctctgaatgaatcttagactttggttgtcctttgctgagtaagtaataagctcactttatgtaactcattgtttgtgtgttttgtctcaccagactcaggaaagtagtaaatgtgcatcccaagacacagtgggctgaagcgctcagactcctattcctggtggttggcatagtaatgatctttgctatcctatatcctcccttgggattggtaatcagcaaacttattttgctattgtctagcacagtgcctgtttgttgagtgaatatttattgaatgaataaatgttataaaagctttttttttttttttacatttgccctacagctaaaagcctgattgctttgaggcaggta

SEQ ID NO: 244532 - DNA, 268 bp, Homo sapiens
atagagtgatgttaaattttctggtctaaaatttctaaaatctgttttctaccttctgaaaaattgaaccattacatgttattctcctgtcttctgatatcagttctatttttcgtcattcttcaaagattaaggagtttcctatccacatgtccgagtttttccagagctttgagatgccactcatctgtgtctgaatcagagactcatttaaagcagctagctgtttctgtcctctcttctcccacatattgaacttcatttttat

SEQ ID NO: 244533 - DNA, 860 bp, Homo sapiens
agggactttcagtaaaggctgagctgaagctgaatttgaaaagcacattctttacgttccattgaagatctgcacttgctcttctgctaaccgctaaggtgtcatcagtgctgtgctattaaaatcagaagtcaaagaaggtgggtgtggccctcatagccagagttgatagaaatggatttatttatataatggatggtccatagaaaggtgaatgacctggttaacagacagggatggagtggagacctgtctgccctggtcttcaggctggttctgaaatcacagaattaagatgatctcagctgaggggcaaggcaaatcggatggaagagcggaggcccagagaagcgaagccctttcccaatatctcacagcaggtggggagtgggggaaagcagcttccagggggtggattcctgaaccaggtatttgtcactgtcccacgtagctcctcttgtcaccatatgtcccactcagtggagggatacttcctgcaagacaaagagggcctcatggttcccccgtcactcactgccttccactccctgcttctgattattctgtaagaagttgaggccgagcgcagtggctcacgcctgtaatctcagcactttgggaggccgaggcaggcggatcacctgaggtcgggagttcgagaccagcctgaccaacatggagaaaccccatctctactaaaaatacaaaattagccgggcgtggtggcgcatgcctgtaatcccagctactcgggaggctgaggcaggagaattgcttgaacctgggaggcagaggttgcaatgagccgagatcgcaccattgcactccagcctgggcaacaagagcaaaactccatctca

SEQ ID NO: 244534 - DNA, 403 bp, Homo sapiens
tttcatgatgctatattcatgctgtgccagtttggatagtagattggaggtccctaagaccacctctgggttctgtgatttactaaaataactgagactatagttgtacttataacaatattacagtgacaagatacaaaacagaatctgtaaagggaaatggctcatgggcagttgtctagaggaaaccagaagcaagcttaccagagtcctctctgcatggtgttacataagactcaactcctctagcattgaattgtgatactacttgtgaaatgtctacaatggaagctcattagcaaccagcagcacaggttcttattgagattgattatgtaggtatgtgtctagtacatatcaagattcccaactctaagaagaagagcaagtgttccaaataagc

SEQ ID NO: 244535 - DNA, 361 bp, Homo sapiens
cacgcaggaatgggccaagctagctccctccagcccttttataaagttactagtcccattcatgagggcagaacccgcagggcctaccacctcctaaaggccccacctcttactactgccgcgctggggatgaagtttcaatgtgaattttggaggagacacaaacattcaaaccataacagcagcttagaaagaaatactacaactggacctccgtgctcaagaacccaaggcgcttctcataagtattgtcataataatgtccaatacttgtgtatctcataatggtttacaaaaccttttcacatagtctcacttaattttcacaaatacctaaaatagaaaattacactccaattga

SEQ ID NO: 244536 - DNA, 162 bp, Homo sapiens
tccacttaaaaaaaaaaaaaaaagaaattttagccgggcttggtagcaggctactcaggaagaaggtgggagaatcctttgagctctgaaggttgaggctgcactgagccaggattgcacaactgtacttcaacttgggtgacagagcaagaacttgtctca

SEQ ID NO: 244537 - DNA, 518 bp, Homo sapiens
attacaagtgtgagccacagcatccggctgattataatcttaaatcctaaaaacaactcatcctggtagattcattttttctttatttcacaaaagagaaaacaaagttcagaagtgttaagtgacttggctgaggtcaccccactaacagattccagagctggcattcaaaccctgtccacctggccccaaagcctgaactgcttggattacacggcatttcccctacggtctccatcttctggtcatctctgtatgaaagctgaaacaagagggtagagtgacttgttcttagttgtgaacttaaattttttaccactctgtctatttgcaaatgaccatgaaagcacatgagtattgatttggggattacaaataaatttgagcagctaagcaaattcagaaatgcagaatttgtgaatagaaaagattaactgtaaatcacttgaaatcccagataaccaccgtagaacaccatttcaggttactctccacatgtgttttaagtgatttttata

SEQ ID NO: 244538 - DNA, 299 bp, Homo sapiens
ctcggcctcccaagtagctggaattataggcacacaccaccacactcggctgatttttgtatttttagtagagacggagtttctccatgttggccaggctggtctcgaactcctgacctcaggtgatccgcccacctcagcctcccaaactgctgggattacaggtgtgagccaccgcacttggccaaaaagtttttgattgttttgatttgtgtccgttagattctgttagtagagtggagggatggcttaggtaaagttcctgccatcagagatactctgtttctgttgtaggattc

SEQ ID NO: 244539 - DNA, 314 bp, Homo sapiens
actgttactatgccatgtgataggagagactttatatagtagttgatccatcatacagttaccatataaaacttccaggtttcttacttgttttggtttgtgtttagaattttgttgaaagtcagatgttaaagtttgggagtaccaggtgttatgtatttatagaaatacatcatctgatgttgagaaatatgaactgtggcataacttttaaacaaggaggcatagttcttctttatacctcattaaagatttactataaaagtacataaggtggggcaaaaagaagaaaataatttctggtaaatgtaaga

SEQ ID NO: 244540 - DNA, 469 bp, Homo sapiens
ttactggatatgatgccttcattttacctttaagtaaaccaaggcttagagaaagtggtctatttgatctagaaagaatatgctgtagtgtcgctatctacttggaatctgttcaggactccttggtttgtcatctagtctaccatgtaaaccaagtggcaacttatcttctaatttaagatattattggccaggcatggtggctcacgcctgtaatcccagcactttgggtggctcaggtgggcaggtcacttgagcccaggagttcgagatgagcctgggcaacctggtgaaaccccgtctctacaaaaaatacaaaaattagctgggcatggtggcatgcacctgtaaacccaactactaaggaggccgaggtgggaggatcccttgagccggggaggcaagggttgcagtgagcagattgcatcagtgcactccagcctgagtgacagagtgagaccccatctca

SEQ ID NO: 244541 - DNA, 338 bp, Homo sapiens
aaaactgtaggttatttttttgaacttggagcaggttggctgggcagtggggttggagatgacagtgtgggcaatggtggggagagttccttttatcattgtttcctgctgaaattttaaaagctacagtttaaaggggagtatatctttatgcactgtgcccgagatggatttgccctaatggaaagaccaaagctgtatatgctttcttatttttctcaatgcatttttgaaacttttcattaaaaaattgagatttacagagaggaggttatacttgaaaagaaagtatacgcaataagtacgtagaattttatctgtcaatttaaagaaataat

SEQ ID NO: 244542 - DNA, 300 bp, Homo sapiens
agacaagtggcccggggctatccagtaacctaaaagtatcattagcatcccatgctctctctgtcttcctcttttgatatttctagcatgactcacccatgctcacgtttttatcatgtctcaaagtggctgctgcagttccagtgacagaattgatgtgtcagacagaaagaaaaaggaaagtaggaaagacaaaatattataagtcagctaaatggaaaacatggaaaagctttaatccctatcattgatttaaacaaacaaaatctcacacatttaaaataaatgatgcaaaggaaa

SEQ ID NO: 244543 - DNA, 209 bp, Homo sapiens
tagttttctagcacaaatattagaggcaataaagaattttattcaaggttgacagctttagcaaacagtttctgttttatattgatgctctcttattttccatgttttctcagcattctggatatagcaccactaaaaaaattcttttggttaaattctgaatagtttaagctttaaaatgcaacttattggaaagatacaggggtagg

SEQ ID NO: 244544 - DNA, 386 bp, Homo sapiens
ccttggcttcctaaagtgctgggattacaggtgtgagccatcatgcttggtgtatgcttgtttatttttattttcattttattttttaaattttctcatagagacagggtttcaccatgttggtcaggctggtcccgaactcctgacctcaagtgatctgcccgcctcgacctcccaaagtgctgggattacaggtgtgagccaccgtgcctggtcatcatattaaatttataacaaactatcttcaatcaataaaaactgagcttaggctgggagaagtggctcacgcctgtaataccagtactttgggaggccgaggcggatggattgccttaggtcgggagttcaagaccagcctgactgacatggagaaaccccgtctctac

SEQ ID NO: 244545 - DNA, 397 bp, Homo sapiens
aaatttggttctctctgttaaaacaataaggttttcctggacttctggtctgctttcaataagaaattgtataaggttttcctttaccttttaagtaattggcttagggaacaaaaattctgcttatgttttgttttttaagattatatatttatgaagataatttcctgtgcttcacgttgtccttattaagtctttgattacttaataaaatctaaggtttttcctacaactatgtggctttctgtatttgcttttgaagtcttttaattatcactctaattaaatgaataagtattgattcacagtgacctgtgatcctattttaatcaaatgttttaaactttttgacatttttgacaatttccatttttgacatttttgataaattataaat

SEQ ID NO: 244546 - DNA, 419 bp, Homo sapiens
aattgttatcatgctatgcagatgaaaataatctcacaggctggggtagagtgtggacagggttctgagccggacccccaggggttagctctaaggaggggagaggaacgatggaactctctgaagaatttgaggataagtgggaggactgaggctctacttccccttggaatacacaggcggtccccacatgagagtagatacctggatggcatggttcagctgaggactggagagagctcccccagtgtctagtgacccagagggacacagaagagcatcttacctgagatgcaagtgaaagcttagatcattcttaatacatatctgggagccagagtctaaggggagagaaggatggaacatttgacatttgaaagtcttcagggagtactgggcaattaaaaattcaaaaggaa

SEQ ID NO: 244547 - DNA, 498 bp, Homo sapiens
ttagctcatgggccatacaaaaataggtggtggaccataatatctcaaccgctggtctcagcctcactgctgaggataatgagtagctgtgcacaaatagttacttcatcagtgcttccccagctagggacagagctacgctcaccagtcatttagcctgctaggcagaactctggaattctgattcaacttctgccctgatgctttccagctgtgaccttgggctctagtcacacgatatcagagtctcaggctgctcatttccaaaacagtgatacaaaatttttttctgccttcttcatggcactggtgcaaactgcatatgaacgtcttcatagtctgattgctggtttcctctgtggcctccatttgcaaaaagtacattaacattttaatcatccttcaccaaacatttctggaagacctattctatgccagtctgagcccttggggatatacagatgactgagaactagaccttgccctcacagcaaaaaa

SEQ ID NO: 244548 - DNA, 432 bp, Homo sapiens
cattatcatgaccgtcatgtttatggacacatttaaatatgtgaacttgcagatcaggagttcttaaccacaggtgctctgtccctcaggggacacttggcaatatcagagacatttttgattatcacaactgggggtgatggggagtgtgtgctactggcatctagtaagtaggggccagggatgctggaaacatcctgcaaagcacaggacagctccctgcaacaaagaagaatccagcccaaaatgtcaatagcatcaacgttgaggaaccctgatgtaaatgctaaaaatatgtatttaaatcacacctggaattgtcaagcccaggaagctggcctagacaaggagttaataccaaatgacaacaggtcagttagattttaagggcttcactctgggaagggtgttgctttcctttctaatagagca

SEQ ID NO: 244549 - DNA, 1850 bp, Homo sapiens
  misc_feature (1150)..(1150): n is a, c, g, or t
cataagtagccccacagtgtagtagtgggagtgacaaatctctacctaaagtattataaaaagactgtggacagagatatgcctatggcctgtgggagaatatcccataggatatttaaactggacatccagggacatccacactgcctggggaagcctcctgggaccatggtgaaggcaaatgccaatctcacctttaccatcttgggtgatattatgatgcagggtggtatagtggaagtatctcaaggcctgcttgccagaataaactttcacaaaatcctccaaatcctctttatgtcacatcatcctcagaagtatcctgctatccacctaaaacccacagtcccataaatactatgccgcttctttttttttccttcaacttttaggctcgggggtacatgtgcaggatgtgcaggtttgttacatgggtaaacgtgtgccatggtggtttgctgcacagatcaactcatcacctgggcattaagtccagtatccattagctatgcttcctgatgctctcccacccccctcccccactcccctgccctttcttaaaggatgaagaaaggataactcttatatttgacctttgagggtctcacccagtgatctcagccttctactcttgaaggcttttacatgctatgcagtgatagtgattaaaatattccctcttcccccaaatcaggcaatgcccaatatctcagtggggaagataccctattcagagtcacatgtattcttcatagcacatcaggaaaatattcattttctgtagccagtatgaagaaaggaagtatatggggaaatctctgtacctttctttcaattttgctatgaacctaaaagtgctattaaaaaaataaaatcttaaaaaaagtatactttcactttcatcccaaaggagagcttgaagtatctgaaagtgaaaagaaagtgtaggatatcactaagaattctagtcaaactggggaagcagattttagatgtctagtgttgaccttatccccagtgttgactttgtcttcatggtctttaggagtaacatctttttaagtttcctcagtggcaaatgtaagaagttaagtagtttggtggtgttgggaaatacaattctaggaagagttagaggtggcagtggtgngtgggcaggggttattttggaggagaacttgtgttaggccttagacatgcaggtggtggtggaagcaggattccagctgtgacctctagctaccagcaacttgcttcttagattaaatgatctaagcttctgttttgatcttgataactctatcaagcattagacatatctaaaatggaaggcacggtggactctcactccctccgccttggagctggatccacattttatacagtagctaagccggaaataccggcaccatccttagagctactttcatagtacactttgaatcaatctctcaggcattttgattctatttcctaaatatagtttgcttcagtgcattcctcgccctctgtcaatgattaccacgtgtgcctgaatatgaggtgaggttccccttttcctgcaaaattactcctcagagaagagggagtcttgaggtggagtcaatgcaaagcctctgctattactgggtgctttctccaaggctttattttaaatagagcatttgtgaggaagacacattagccccacatgaccctgtttaatgcggttaggtattatggagggcacctgacaaaatctttttaaaaaagggtatggcagctttgaaaatagtgtaggaatttattcttaggaatgtgtcctcacagttgtaaatgcaaagtatctttataaacaaacctttccacta

SEQ ID NO: 244550 - DNA, 336 bp, Homo sapiens
tgtttatactagttttctaggctaatctttgcatataagaaaatagaatttaggacattagccaggcgtagtgtaatctcagcaccttgggaggctaaggtgggatgatcacttgtggccaggagttcaagcccatcctggtcaacataacaagactatgtttttacaaaaaatgttaaaaattagcttgtaatgatggtgcatgcctgtagtctcagttactcttgaggctgaagtgaaagactctcttgggtccaggagcttgaggctgcactgagccatgatcacaccactgtactccagcttggatgacagagtgagaatctgtttctaaaa

SEQ ID NO: 244551 - DNA, 343 bp, Homo sapiens
ggtctgcagccatatactgaatggctgcagttgcacccaggagggcagggatcctgcctgcttctatcctgcttcaatggaataggaggcccgggtccacagctggggtttggatggctgcagcggcacccggggagctcccgcctcaacttggaggggcagggctcccaccagctccacggagcgtgcagccccagctggcttcgctgctgcagccggcgtaatggccgcggcaggccgtctggagcagccactgccatcaaaatcaatagctttcctacatgcagtaataactagctagccaacataacagaatgcaagattctacttcaagatgacacaa

SEQ ID NO: 244552 - DNA, 353 bp, Homo sapiens
gcatctctcccccatctttcccttccttttcccctttctgtcattccttggatgtcatcttgaatgtcccctctttccttcattctgtatttcaccacattgtcctttgagttttttgcattcccttctatctccattgccaacagtgagctcaagcctttgtgtttccttctggattctcatccctccaccagttttgaatcttcctgctacccatcttccatattattatttgcttagttccataaacattgacttttttttcctctgaatttctttttttcttttatttatttatttttttttaaggtggagtctccccctgtcacccaggctggagtgcagtggtgtga

SEQ ID NO: 244553 - DNA, 428 bp, Homo sapiens
caggtgttctgtcacctcagaggccagccagcctgctgctcctggagcatctggttactaataagagacaacagcctatagcaggggagtcatttcacagtggctagagcccagtccactggctggacttttccaaagagatttcctgtttttctagaaccaatgtcatcctcactgagagctcctagtgagcccctagtgggacttttgtaataaagtcctatagctggggggccgtgacaaccggctgctttccaaagtctgtggcttccttctttaggcatttgtttgtttggtttggttttacagacaaagtctctctctgttgctcagccaggagtgcagtgagccaagatcaggccactgcactctagcctgggtgacagagtgagaccctgcctcaaaccaaaccaaaaaaataagtaagg

SEQ ID NO: 244554 - DNA, 368 bp, Homo sapiens
ggaatggtggaagtgatgcggcgtccaggttatttatcctcatttgaattttttataagaaaaatgtgtttgccgggtgcggtggctcaagcctgtaatcccagcactttgggaggccgaggcgggcggatcacgaggtcaggagatcgagaccatcctggctaacaccagtagtgaaaccccatctctactaaaaatacaaaaaattagccgagtgtggtggcgggcacctgtagtcccagctactcaggaggctgaggcaggagaatggcgtgaacccgggaggcggagcttgcagtgagccgagatggtgccactgcacccccgcctgggcaacagagcgagactccgcctcaggaaaaaaaaaa

SEQ ID NO: 244555 - DNA, 426 bp, Homo sapiens
ggacattccttttccagtgttccctgcccccccctttatattttgttcttatctctttattgcagaaattttgggtggttaagtatcagattgcaagcagtacaatatgtgggttcgagcctcacatcatgtattagtaatgtaaaaaaaaaaggaaaaataaaattgtatgagtagatgactttttacagatgggctaaataaaataccaaatgattgagtcgaatatagccagtggcagggggatgaagatcaggaattaagaccctgattaagaaggtgcttgataacaccttctgatgttttcagattagggggtctgctcagttacctccttaagcttctacttctgatgctccctaaaattataggaatgactctacgtgtaaagcttatccaaactttgggcctataatatttctcttt

SEQ ID NO: 244556 - DNA, 801 bp, Homo sapiens
agcctcccccgtagtcatttatctttcaggatgagttaaggcgttaataaataattttacttttatcaaccaagtgaagaactggcatagtaaggaaggggttgccatatctacccttatatttatgaaagtactggaatgttcttttaatatgcaacaaattacagataataaatcacatcacctttttttctggggaaaaaaaaatcttcctaaaatatttgtttatttgcatttttaaaaagcattggaagattacacaaaaagaatttgcaggaaaggagaacaaggacaggttctgaagcaaggctgctcaatgtccactgtttttaaatcactttaatttctgaaccatgtggctatactccctatctaaaaggacatgaatattttttaaagtcccattacgtacataaggggcccaatacaagcaagcataaataatcttgaaaataagagaaatctgagaatgcataattttttagttgatgataaacaatagttttagaacttaaaccataattttcagatgcttgaaaaaattctgatcatcttcaaccatggtatttacatgaaccacaaaaacatacaataacatacactctccaaataacaaattgcactcctacttactcctatttctctactcagtgtccatttcctcaaaaaacttttcccaattagcaccaatgaaggacaacactcagactaccctattctttaaacagacatgaatttgtccaatatacatatatgtatttcctggactattaggtcctaaaatactttagtaaagaaagc

SEQ ID NO: 244557 - DNA, 658 bp, Homo sapiens
ttcccaatattaataggacgcccagcacaaattaggtgttcaaaagattccctttgggcgagaagaaaagagagtagaattcgttaagaggggcccagatttgtgcttgaggaccagccaggaccagtaactaaagaccagttgactaaagatttttgtgtggaatgagtaaggaattggggtaaggatttttgagtcgagtttgatgttatgcccctaaagagatcactggcacgtgtgaccagagggagcgcgtgggtctgaaatggaatgcattaacctcattcaaatcttctggaaaaatggatgttgggaaatgcaccctggattttgtcatttaaaaacactagagtgaaaactattttctcaggactggtcctcacactccaagatgctgctttgtggaagccaaagggatcgtgggctatttagattctgtaattccaaactggcctattgataaattcagtattgacttgatttgtgttaggtagaatcaacaatgcctccgtgagatggcctattcaacagaagtggggaaacactctgagaagttaagcaacttgtccaagatcacacagagagtaagctggacagggctgaatacaattgtatgattcctaattagagctctttcagctacaacacaccaaatccc

SEQ ID NO: 244558 - DNA, 1599 bp, Homo sapiens
tttttttttttaatcagacagggtcttgctctgttgcccaggctggagtgcagtggtgcgatctcggctcactgcaacttcagcctcctggattcaggcaacactcctgcctcagcctcccacgtggctgggattacaggtgcctgcccccatggctaattttttgtattttttgtagagatggggtttcaccatgttggctgggctggtctcactctcctgacctcaagcaatctgcctgtctcagcctcccaaagtgctgggattacaggcgtgagccaccgcccccagcctgagcctttttttttttctaatgcatccaaggttaaggggaagacgcaaataacaggactactctaaaaggaaacctgtttgaactctgtgagatcagtcatcagtctcagtattccacaggcacaccttaatttcattgtaaaaagatatatatattttgtctatttttgtgcttttgggggcctattttgtgcttttttaccttatgtagagatcttattacaaagtgattttctacattaaaaagagactgaaataaattgtatagttacttaactaatgaagacatttcagaactctgggatgattttaatcttgaagtagtaggtggtatagtcataaaaccattcatccccttcttgattgtatcttaattttctggctttaaggtgacatctgagaggtaatgcattcttttttatattgaaatcataaactatcacccgctgcttctctgagttacttttaattttgccttgtggttatggtttggcgtttccttctgtttggttttcagagccccatgtctatatagtcctgagtgcaagtaattactatacttgtaaatgaagatcagtatttctgcctagatctgataaaaaaattttcttgtcttagttataaaaattcaaagaaatgtgttacaaagatacttagtatagctcctcagccataacctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgttccaaattatcaaattcaagtgaatttatttgtgtgttctttacttatataaaaaaagataactttaaggatgtgcaagtacatttccaactgctagcacaaccagtattttgtaattaaacaaatcgctgtatggtatggtcttctacacatttatgtctatagatatctatcgatcatctttctattctgtttcatgactgaataatgtaaaaccagtgttggcaattggtatcatcaatgatactcattttttaataaccaaaggcaggggaaaatcattttacttattaataaatattttatgatgtgaaaaaaaaagccagcacaaacaacaaaaaaggggggccaaatacccggggacatgcccctttgaaggcgcccagagggcaaaaagcccgcgcacaaggcaacac

SEQ ID NO: 244559 - DNA, 276 bp, Homo sapiens
gcggccgcctactactactactgctcgaattcaagcttctaacgatgtacggggacatgactgaataatgtaaaaccagtgttggcaattggtatcatcaatgatactcattttttaataaccaaaggcaggggaaaatcattttacttattaataaatattttatgatgtgaaaaaaaaagccagcacaaacaacaaaaaaggggggccaaatacccggggacatgcccctttgaaggcgcccagagggcaaaaagcccgcgcacaaggcaacac

SEQ ID NO: 244560 - DNA, 1027 bp, Homo sapiens
tgatactttttgaaaagctggttcaagtacattttattaatttttttcaataaaagagaacagtgtattcaaggtatttagtacaaggtggaaagcctacttgatttattttttttaatgagtgaatgaattcaacttctactagattatcctctgtaagttgcgtctattagtttacacatcagtctttcacgggtgattaacctcactaaaaacttcatgttcatcaatattgtgttgaacttgaaactgtattatcatatatgtttattaataggcaatggtgtcagataatcgtgaaattgagaagtcgcccatccatttgggtgggaaaataaccaacatcctcagttgtaatcccactaagaaccgccagggcgagacgaaagcgacatcgcttccatctttacgtgagtcttggaaatggttcagcaccatgacgtccgccgaagacgtaggtgtagacgaggaacaaaagagaagacccctcgtggaggtggcctgtggggcccgccctcctcgggcgcctgtcgtcgtctgtccctgactccgctccccccggcggccgcagcgagtgcgccccgcgatgcagcgggctgtggagggagcctccatggagtctccatcaaccattgaggaccaggagacggtggcaggcggtagagaggcctgggcagggcagcgccccgggctgcggacacaggacggcggcgcccaaggacgccccagggcaggcctcagcccctccaaccggtgggagcccagctccaggggagcccgcagctccctccatcttggttgatggaggcggggagctgcgtctgggtctctccaccgtcgtgcccgtcccctgtggccccgcggacgcagacgccagcagccggggttgttcccttggccgaatggagagtccagttggggcttcccgaggacaagtttcccggccccacggggtttggtttttagggggtcccaagttcccacagtcgttccgacaaaatggaggacgtcgtctcctcctgctgca

SEQ ID NO: 244561 - DNA, 1238 bp, Homo sapiens
attataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaatagtgtcgcaaaaaaggaagacaaggtcccagtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcatagatacagtagggagaggtccgagc

SEQ ID NO: 244562 - DNA, 392 bp, Homo sapiens
cagaagaccagaactgtgttctcttccacccagctgtgtgtactcaatgatagatttcagagacagaaatacctcagcctccagcagatgcaagaactctccaacatcctgaacctcagctacaaacaggtaggcttgttttgtccttggaataaggtgaacaaaaattggactaatttgcatggctaagacctctgtggatgcatgtagatgtgtgtactatgtgtccgtacatcgcctcttgcaaataatttatgaagatgaaatgcttttgtaacttccttcacctctttctttccttaaatattctattatgtgaataattatgtcataatttaaccactttcttgcacagaccaatattgtgaaaatctttccaacgtttccttaat

SEQ ID NO: 244563 - DNA, 446 bp, Homo sapiens
caatcaatctctaccaaaattccaatgacatttttcacagaaatggaaaaaaaatactaaaattcatatggaaccacagaatacctcaaatagccaaagcaatcttgagaaacaacatttgaggcaccacactacctggtttcaaaatattccacaaaggaatagtaataaaaatagcatggcattaaaaacaaacatatggatggatggaaccagaatagagagcccagaaataatatactattaatggctagttagttttcaacaaaggagcctagaacacatattggggaaaggatagtcttttcaataaatagtactgggaaaattgtatatccacatgcagaacaatgatattagacctttatctcataccgtatacaaaaatcaactaagaatggattaaatacataaatgtaagactgaaactataaaactactagaag

SEQ ID NO: 244564 - DNA, 490 bp, Homo sapiens
atatgacttctcagtccctcctctcttctcttggctttacttacaccacattctctggttttcttcccctctcacagtctgctccctttccgccaccttttcagggtcttttctccctccctgacctttatagtttgatgtctgtatgacttcggcttggctctcatcttcctctacattattttcctatgtaatagcatcttctcctgtagtttaaaatactgcctgtatgctggtaacttccaaaatttatatacaattcagacctctctgaacatcagacctgcatatccggttacctgcttaactccatttagaggtctcaaggtctcattgacattgcaaacttaacatttccaaaatggcaggttgctttctattccttctctccagttaaatctatccagttgctcaagctagaaacccaggagttattctccattcatcccttctcttcactcccatgtccaatctaatagcaagacagtcc

SEQ ID NO: 244565 - DNA, 1605 bp, Homo sapiens
aaaagcagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccaggttgcaacctgctcaatgggacacaggaaattgggcccgtgggtatgactgagaactgcaataggaaagattttctgacctgtcatcgggggaccaccattatgacacacggaaacttggctcaagaacccactgattggaccacatcgaataccgagatgtgcgaggtggggcaggtgtgtcaggagacgctgctgctcatagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttc

SEQ ID NO: 244566 - DNA, 729 bp, Homo sapiens
cgtgtgattaggcccacccagataagccaggataatctccctattttaaggtccacaacctgaattgcatatttgaagttcgttttgccatgtaacataacatattcacaggttccagggattaaggcatggacatcttcaggacatctgcatatcagagtcactaaactcaaagatggcatcatgtagagaaaaggcatgcagctacaataccactgcatggaaaacgtatgggcttgaaaatttcccatgatatatacaagataaataccagctcagattttaatcattttagaaggtgaaccaattcccaggtcccaaccaaaaattcattgattaataatccaaaacttgatctacattgagatatatttttattttagatatctaaattcaaaaattgccctgagctgagataatgtctctcaggtctaccacccatttttatagtggatttaagcataggtgttataaactttataatccttataatggtatgtgtcccttaccaaaatgaagcttttagagaaactgacatattagtgattcagttgaaatatttaggaggatttgattgtttttaatcaacgtttaaataatttaacttgttaaatgtatagattttgatttgctggttatagaaatcgtgttcaaatatttagacaatttttccttcagtaggtttgtgaatagattaaacaataaataaagcacaggtgatggtgtgtg

SEQ ID NO: 244567 - DNA, 441 bp, Homo sapiens
ccagccagaataattttggtaggcaggaaaatgcacattatgtacacacattgctcttctctgatttgctttaacactgaaaaactgaagattgtaaatgtagtctcaatttagagtgaattaacaaaagatttgtttttcaaaaaagcaaatgtataaaattaatgggtaacagatgccattagttgctaaaaaatagtatgactaaagttggtaattatctagctatgcaaataacagcccaattaaattaagactctattgggtgcatgtggaaagcattgatgtgcagtgtggtgcctccactcagcatttccttactgtctctttacagagataccaattccccctgaattactcagggtccataatggttttagaaatgtttgttctctggagctgtaaagaaatagcacttgaaaataaatttaatttttctta

SEQ ID NO: 244568 - DNA, 444 bp, Homo sapiens
gctggagacgcggagagacagctgatgttccagtttgaaggccatagggcaggaagagttgttcatgtggacagagtcccaaggccatttgcggagaaccccctcttacttgggggagggtcagccttttcattctgtttgggccctcagctgttggacaaggcctgcccacaggaaggagagggatctactttcctgattaagatgctgatgccctcgcagaaacacccagaacaatttttttttttttttgagatggagccttgctctgtctcccaggatggagtgcagtggcgtaatcttggctcaccgcaacctccacctcctgggctcacgcgtttctcctacctcagccccctgagtagctgggattataggcgtgtgccagcacacccacctaatttttgtatttttagtagagacagggtttccccatgttggcca

SEQ ID NO: 244569 - DNA, 760 bp, Homo sapiens
gagttattccatggcattaactttatttattaaagtcgacatctcacacctacccacacgccatcttaaatcaagggattttggtgtgctttgcactgaagcatgtcaagatatgttttttatttaaatccactttctctttagggaaactgaggtacagaaccatctgagatctagagctaagtgtagatatgcctcatggagcgaggcagcttttcctgtatccacaatggaatacctcttgtgcctcctcctcgacccttaacaaggttacttaacctaacaaattgctcctctgagacagtagaactccatgaaggcccatgatatccaacccctttgatagggggtgttaaaagatggcactcattttcattgttagctgttgggatgaatagtgatactgccattgagcactcaccaggtgccgggcatgagttttataaatacatatgtaaatgtacacacatgcacatatatgcaccacctcacacagacacacatagaaacacatgtacacatatatgcaggtgcacatatacatacacagatgtacacacacatatacacacacgcacatgtatacgcatacacacataaacacatgcacatatatgcacaaacacacacacatacacacatgtaaacacgtagacacatgcacatatatacacacatgtacacgtgcacacactcgcatgaacacatgcacatacatatacacacacatgcacagacacacaaacacatccaatcttca

SEQ ID NO: 244570 - DNA, 318 bp, Homo sapiens
gaccaccataggagaaaatgtgcccagtggcctacagacaaccccgacctttttttcattctggcaacagagaaacaagatttggcttgccagccttacacatagctctctgtagtggtctagagtgagaattgtcctgatcgtccttggagaggacatctgatagagctgctatcatgatgtggaaacacgtaaaccacccaacctgtattgtctccttgatttaacagaattgaccagctgggtgtcatttgatatttgaaatgagataaattccacaaaattaattataaaatatttctctattgactgattttt

SEQ ID NO: 244571 - DNA, 498 bp, Homo sapiens
ctgcccttgccagaggggtgtgtcctctccactgcagacacaagttcctcccttctctgcggccctccgctctgcaacgccatcctctctctggtcctccgtgtctctgccaggcatgggctcctgtccacatcttttctgcccagcacgctgtcctgttgccgtgtccccgcatctttcttccctaacatcggctgtggaactgaggtagcgatggctggcgtattaagaatgtgctccaagcagctctgcctagggctgaacagccccatttggcttcccgtcctcatcagcacctgacctgtggcaacagtgaagccgcaaggctcacctgccgttctctgggtcacaggtgtgtgataggggggccagtcgctccctggcagcaagacccggaacctgcactttaattccatgttccacagcaattccacccccagaataaccagatgcaatcacagcccaaacacacacaggcacgtgcacacacacaggtgc

SEQ ID NO: 244572 - DNA, 331 bp, Homo sapiens
aaatggggttgtttttatcttgctgatttgagttccttgtagattctggatattagtcctttgtcaggtgcatagtttgcaaagattttctcccactctgtgggttgtctttttactctgttgattttttagtttaattaggtcccaactatttatttttgtttttgttgcatttgcttttgggttcttaggcatgaactttttgcctaagccaatgtctagaagagtttttccagtgttctagagtttttatggtttcaggtcttagatttaagtctttgattcatcttgagttgatttttgtataaagtgagagatgaggatccagttc

SEQ ID NO: 244573 - DNA, 1054 bp, Homo sapiens
aactttgtcatcttcatgttgatcttaaacatctctctgatgaacagtataagaaaacaaatgatcacttagaggatcctgtttggtagttaaaaccgtattaaaatagagagggaagaaattaagcctccttgatggtgaagagattgggaaccaccactccagtgttagaaaatgtcaaatgacagaaggtgggctatattaagtgggaatttccaaaccccaccccctggaaggaaggaatgcttggtgacaagccttagaggagagagatgcttgtctagcccattgcctgtgtgcccaggaagagatgtgcataccttgagatatagagaagactctagtggggagaagccccaggccagcttgtcagcacagggcatcggaggcccccaaccagctccaagttctgaacagcacacagccttcaaaggcttgtactgctgctcatacccagcagaggccttgcaccaggcctccccatgcaaatcagtgtccccgcagcgtaggtaaaggagctctagctgtgctccctatgggggaacagatataccgtgggacactgagagactggaagattgcccaacatttatttactgatctgtgttcaccacagaacctaaggtatttattggtattgtttcaaccagtacgagtgattctttcatttagtggtcatctctgcactccaccacagacttttgggaattacaagatgaaaagggccacatcctcaccctggcatagctcagaaaatttggttggggaagtagggacatagacgtgatcactacaccataatttactaagctgtgagaactggaggtgcatcagtgaccagagtgcatttgagccagaggtagaaggtactgtagacaaaaggaacaacatgcgctctaggctgtatcattaggtacaattttctgtccttgggggagtctttttaaccctaagacaaaaattatgaatatagaaagaggccacggttcatctttgcaattctttcaggagaaaatttgctgcaactcactttctaagtttaaaaaaaaaaaga

SEQ ID NO: 244574 - DNA, 573 bp, Homo sapiens
ggaatcagggctcattaacatctctgagcctcagcttcttcatctgtaaaatggggatcatcagagtacctacctcaagcaatgcctgtgagacataaaagccagtgggtatgaaagcccctcaaggcccgcaaagtgccacaaagacatgaattttctctccttcatcacagtggctttttctctttccctttgtctcttcctcattacccatagggcttttcattcttggacatggaagtaaaaattagtttaagatgctgaattcacagcaattatgtcatgcccacctccacgggtttccccacaggcttcctgggtattacacagtacctgattgccacaaggtcttgagaattggggtggcccggacataagggatgctgccattgctgtctaccaacactactgctctgaaccagaaccagaaccagtgcctttcatagaaaagtaaaccaagaagtgatggatagacagagatagagaactcttgaacaaaattaatcaaagctatgctttgccctagttgtctgaatcgcaatcatacacactgacatcaaatatcttattaaa

SEQ ID NO: 244575 - DNA, 230 bp, Homo sapiens
attgattttttaattgtgcttagcagatatttaagaatgttagcacaggtctttgaataaactttgcttctaagagaagttactattcataattaggtagaaaagtctttgaagaggaacctctacttcactttttacactgtgaactgagaatgctgtgttcagagtgattactgaaaacatggttaatacacttcttccatatgataataaaatgttataaatcttac

SEQ ID NO: 244576 - DNA, 475 bp, Homo sapiens
gttgatttcatcacttcacctgtggagtgtaaattcactgacacagcctttttttggagggcagcctggcaatcatttaaacttcaaaatatcttttgatccagcatttccatttctaaggtcgtatgctatggaattacttacagaaaaatggtgcaaagatatgtattaaaaaaaattcttggccgggtgcagtggctgacatctgtaatcccagcactttgggaggccgaggagggtggatcacctgaggtcaggagttcaagaccagcctgaccaacatggcgaaacccgatctctactaaaaatacaaaaattagctgggcgtggtcgtgcacgcctgtaatcccagctacttgggaggatgaggcaggagaattgcttgaacccgggaggcagaggttgcagtgagccgagatcatgccactgcactttagccagagtgacagagcgagattccatctcgaaaaaaaag

SEQ ID NO: 244577 - DNA, 703 bp, Homo sapiens
ctcaaatccctgaggttggtggcaagcagtccaggccctcgatgcagcttgggctcttgactgtcacatgagtgcctgctcccaggccagcagggccaagaaagcgaaatgtcgggagccacctgaactcccagatacactttgcagggtcaatctttatttgggcctgccttagagggcccagcttccagcacagctggtttcaggagtgggtggactcaagtctgaggacctctctccctgtgctgcttcctcctcccaggcctccgtttcccctccggatgggcggtcctgtacaggccttcacagatgcccctgtggagttctggtccagtggggtagatgaggccagggtggtgagaggcagccagcatcagggcctgagcgactgagtgcacctgtggcctcagagacccctgcacactgggtgggctgtgggagggaagccctggtccctggtagcattggggtcctttcctgttgggagcttttaccagctgctctggcagttcccaacagagaatgcccactgtgccagcatgagcctttactgtagttctttccatcttggaggggtggcaggggcagcttggcacagtggctcacgcctttaatcccagcactttgggaagctgaagtagcctgatcgcttgagcccaggagtttgacaccagcctggcaacatagggaggcctggtctcta

SEQ ID NO: 244578 - DNA, 341 bp, Homo sapiens
caggctctggcgggtctggttgcctgcttgcctctccttattcttgtcttactcctcactcttactctgggcatctgtgtaggaccataggggcctcaattcaaagtcttgctttgctgcttgctagctgggtgacttgggggtgactcaccgaaatggtttccctgtttgttagggaataatgatggcccctgtttcagagacagagtgaagagcctggcctggtgtcatgtgtctacctgtgatatgacatatagtagcggcacagtgtcagctccctccctgccctgttcctgtcactctcagacttttctccacagacttctgagatctccgtgtcc

SEQ ID NO: 244579 - DNA, 464 bp, Homo sapiens
catacgcaatttctctctacataattttgctcttaaggatgatagaatgaggtccactttaattaaatgtataaggaacagtaatccactttgaaaggcaccgctaatccacttactggtcaccaagttatgcagatactaacgagactttcaagaagaaaacaggtataagaagaaatgagactttcaagaagaaaacaggcaatttacaggaaatatgcttggaacaggcactctattgtatatattcctcacggtcaatggctaccaagcaacaccaaagttagttcattataccctgcctcacttatggctgtgtcttctttagggggttatttacataatataagcagaatctggtaagtaaagtaagaaattgtggatctgtttacaatttggttcccatgctcaattgtacattagtttggtctccttttaataaacttctgtgtatgtactccaaa

SEQ ID NO: 244580 - DNA, 936 bp, Homo sapiens
gaaggaggatagatgcttttgaggtttttaatctgtgtgaccaggatgtgttggtggcgttgctgacaaacacagggaaacggtggtgggaagagaaaggaatgcccagagatttttatgagagtaaagcaagtcctgaataactgctcaaatcctgtaacatctaaaaggaagcaactcactcatctttgctactaaagccttatttcttatatagttctttatagaagtaaaacattgtcataaattagaattgatgttgaaatattgatggcattggctataactttgcatttcatttaaatttttggagatgatttgaagggtattgtagcagactgtgtataaacaactccacacatcatcccagagtgtctctaactgtaactgggactagggcaagagcacagtcccaagataaaaattgaaactctgtagttcagttgggactcaggctagtcttattttctttgcttttaggatagtgcagtaaatttctatccaaataggttcctttccttgggtaaagacaagttactttgtatttctttgtttgatatatacttttgaatgatttgggctacattcttactttagttcattttggaggaatatttcttagtttaatttgtctcattattaattcctccttctctgaaactttttggggatataggtatgtatggcatagtctacaaatttaatgcctttacttgtttttttcttttttgcagatgtagggcgtgtgagtatggggcgatggtgcagggaaccttgctttaacatgctattttgaaagatatccccttttattttgtagaaatgggttaccacgttgagcaccaggagtttcttgtacatttggatcctagcagaggaaatgggactttagaaagattactctgaactctgaagggctaatttaaaaaaaaaaaa

SEQ ID NO: 244581 - DNA, 344 bp, Homo sapiens
acatcttcatactcaggagtagggacaggaagacacaggctgggatggagatgggctcactcctgggccagtcaggttggctttcagaaaggtgatttctggtcacaaggcccttgagcagctggaggacttaggcagagtgcggagagcagccattcacatgagaagactccaccctggaggcagcgctaagcagccatccttccttaactgggcctctggggcaggtggtgcctagtggcctgtgaggtatacagccctttcagcacttagagaatgacgcctcaaggggaaaccattaaccctttcctagaataatagcatcaaagtcctgaccatgttga

SEQ ID NO: 244582 - DNA, 550 bp, Homo sapiens
tctccttttctatctctgcagccaagattaagggggatgctcaggaaacctaacgagttatctgcgtgtggactaatggattaacaccacctaccatcagcctcctgggtgatctgtctctttaatcttgctcaatagataacatttgggaaaagctcccttgactcctagagacactattttctgttataagctatgaggacgtcccctctggtcatcaaatttaatgggatgattattaaagggaatttgctaatattaatgcccactttcaacttgagggcctgagctacaaatttctccctgctttggctggtggggaacaggccaaggacaaaatctgaataaagttaaagaggtatctgctgctgttcaattatttaatatatcatgtaaggcaaaggtagtgatgcactatccacccaaagatatgattacactcaaagccatacgaacttttactatgcaaaggccacttcataatgggggtggggagacacagtatatacaaagttctaaagtactagtaatcaatagccttaaaaataat

SEQ ID NO: 244583 - DNA, 402 bp, Homo sapiens
cgccacaggtccatgagtgactcctaattaccaaatccaagggctccttcaccctgtcccctctggtcatcaaatttaatgggatgattattaaagggaatttgctaatattaatgcccactttcaacttgagggcctgagctacaaatttctccctgctttggctggtggggaacaggccaaggacaaaatctgaataaagttaaagaggtatctgctgctgttcaattatttaatatatcatgtaaggcaaaggtagtgatgcactatccacccaaagatatgattacactcaaagccatacgaacttttactatgcaaaggccacttcataatgggggtggggagacacagtatatacaaagttctaaagtactagtaatcaatagccttaaaaataat

SEQ ID NO: 244584 - DNA, 842 bp, Homo sapiens
aagtgtatgcgtagggtaaattttgagcagtagggttgctaggtcatagggcacctgcatttttatgtactaatattgtctaattgttctcagacacaattatacccgtttatactcttctaccaaagcatatgagaatgtctgtttctccacattcttattagaatttcatgaaacttaatttacctgcttatctcagagaagaaatattttgacattcatttcttctgtaaggttaagtatctttattgatcccttctattttttacattacattccacattgattgcctttccttatttttatattggttatttgacattttaatcatgtgagatgttggaaattaaggaaactagtcatttgtcagtcatatatgttgcaaaaacccactgtgctttttgttttgggggctgacgggagggatatgaggacatttttaatgcttgtataaacaaacataccaatcttcttgatgactttggtgtctacctgcaagggctttactctagttcctagtcacattccatttgtgactgaagctttcttaaccaccatccaaataaccaactcagaagactgatactctgctttctacttttgatctccctggccttgttgactgctctcaattacgctagagctcttccagttccacaagttaagctgtaagcttgctaaaatcagttgtgcttatgtgctttcatatgcatacagatttatctttattatgtcatttaattctatatttcataagccaatgaaatgagagtgtgaaaagaaggttgggcttttgtgaaagcctttaaaagtgagtgattaaaattttaaggatttttatt

SEQ ID NO: 244585 - DNA, 546 bp, Homo sapiens
gcactattcacaatagcaaagacatggaatcaacctaaatgcccattaatggcagacctttgcaggaacatggatggagctggaggtcattatccttggcaaactaacacaggaatggaaaacctctgcacattctcacttataagtgggagctaaatgatgagaacacgtggacataaagaggggaacaacagacaccaggacctacttgagggtggagattgggaggagggagacgaccagaaaaaataactattgggtactaggattagtacctgggtgatgaaataaatctatgtaacaaacccctgtgacatgtacacagtttacctatataacaaactgcacatatacccctaaagctaaaataaaagtttattttttaaaaaacgaaagtaagtatgtagtcagagaaaagggtttctattaaatagaaaaaaagcttaattagaaatttaaaaacaatcatctctgtggagtgatggggtgaaatccttaaggcaacgagttgagaagtcagttgagattgaaggaaccagacagcaa

SEQ ID NO: 244586 - DNA, 492 bp, Homo sapiens
gccaattttgggttgagttaccatgttgtatctctcttgcgcctaagagattcttgaaaccccagatctaagcaggtagaaccatttgatacgttagtctgaaagtgatccctgtggcaacctacttttttcctgtttttctcttaggaaaacacgtcatctctgatagaagattttcttccttctcttttcttttctctttttcttccttctctcttctcttcttttctctcctctcccttcccccgctttccgcctcctttccctctccttcccttcccacctctccccatccctcctctgcctcttctcacctcacagggttgttttttctcacagggtttctttctttctgactttgtcttttcacaaagtcttgctctgttgctcaggctggagtgctttggtgtgatcacagcacaccacaacctcaacctctgggctggagagatcctcccacctcagcctccattgtagctgggactacagtca

SEQ ID NO: 244587 - DNA, 305 bp, Homo sapiens
aaatatctttcaaaacgactcagagacatttaagaatcactggcttttttccaacttttcctccaaggaagttacaatacaatgttgaattatgtattctactttaatcaagaatttgacattaaagtaatatgtgaatcattgctatagtacactagcaaaatgggtaataaactagaatctgttcactttgtgggtttgttccagttccagattataaaatgaatgctcttaaagtgttgtggtcatgaaacaattattgagcatctttatttaagaacacgattcaattaagttttcattta

SEQ ID NO: 244588 - DNA, 726 bp, Homo sapiens
ctgtattatgcaggttacttcataaaatgaaacgatcaggcactaagggcattgtcctgtattgttatattgatacatccaactctggcatagaaattaagaccatttttagttctagaagaatgcaaggaggaaaaactttaaaatgagaaaatgttgtctgttggcctaattttttttttaaagtgggaaaaaatattgcagaaccttttagtagagctagtaaatatagagcaccagagtttgttccaacgggaaagaaagggggaaattactgaactgtgcctgtctcttgtatgtcgtttttctttttaatgaaaatttaagtcatacctcccacagtcagtttctggtcactactatctccctgtcactcaccaccagccattacctacttccttccaaaatattttttatcctgtttgttttaaagtagttttttcacagttaagaaataagtcatatgaaaacatctccatgggaatctaatgctaaaagttcacttctgtcttttctcataaaaagtgtcagatattttacctataagtaatagaaataagtctaaaataaatcagttatcactttacacgttgattttccactttttaaaaggttttttctttaatcatagtttatgctttaatcataacaatgcaagtttattatcccttatcccaaatgcttgagaccagaagtcttttggatttcagattttttaaaaaaaat

SEQ ID NO: 244589 - DNA, 424 bp, Homo sapiens
gagacagggtttgttctgtcacccaggccggagtgcagtggtgcaaatgcagctcactacagcctcgacctcccaggctcaagaatcctcccacctcagtctcccaagtagctgggaccacaggtgggctccaacatgccaggctaattcttaaattttgtatacagacaaggtcttgttatgttgcccaggctggtctcgaactcctgggctcaagcagtcctcctgccttagcctcccaaagtgctgggattataggcatgagccactccacccagctgaactgtgtatgcatttcataaatatataaatattccctatattaactattaatattaactatatttataatatttacataattgtcctttatcaatatatgtctcagatttatcaactcaagtgcagccaaattctgtctcta

SEQ ID NO: 244590 - DNA, 254 bp, Homo sapiens
tatgccctatccccagaagctcctcaaagaaaacagtacaactgaatcacatattgtatcctttctggatgaagtctgttaactaaaacttgctcatcttcttgtatttccagtaatgtgggtgagtcttacggataagtgatcagggcagatcccaggctggacttctccttatcctggcttaaggccaccagcaacattcttgtgttggatctagacaccagctctaccgcacattgaggcagagttcataa

SEQ ID NO: 244591 - DNA, 383 bp, Homo sapiens
cagtccactgtcatccagcatagaatcagtgtggagcctcttgctcagacatcccagggccaggcctccatcaggactgacactttccatttggtttctgagctctgcctggtagacccttgtgaaaggagattacccatataactgtgtttacccaaggggttggggaatggcacacacaaagctggtgaaaatccagaggtcagaggttggaaggtgctgcttttattactgagtattgaaagtgatccattacaggctgggctcggtggctcatgactgtaatcccagaactttgggaggccgaggcgggtggatcgcaaggtcaggagattgagactatcctggctaacatggtgaaaccccatctctactaaaaaata

SEQ ID NO: 244592 - DNA, 386 bp, Homo sapiens
tcattttgaagtacaggagccaaagtgtaaaatggtaagtggtgatggaatgagtgagtatcagcataatcttcacaagtgttgctttctgccctgtgatttcagattatgcaatctttaatggctttacagttaatagactcaaagtaggagtaagcttgtaatcttatttactcttacaaaaaagtcctactgactcagaatttatcttagaaatctagcttttattagggataaaaaaatatctaagatatttgtgatgctaattttatgtgtcaaattggagatgttttggatgagatcaacatttaaattgatgaactttgagtaaagtggattgcccttcataatgtggcctcctccaatcaactgaaggcctgaataga

SEQ ID NO: 244593 - DNA, 367 bp, Homo sapiens
caggccatacagttgcaaagttcgaccaattttaaataattctaacctatagaaaagttgaaagaaaatcacaaaaaaaaccttcatcttgattcaccatttgtccatatttgtttctctttaaacatacatacctgttattatgctgaatcatttaacagtaaattataaaccagcactgtccaaaagaactttctacaatggtggaaatgttcatatctgtactgtccaatatgataggtagtagccacatgtggttatttaaatttaagtgaattaaacttaacttaccacatttcaaatgctcactagtctgtggctagtggccactatattgaatagcagttatagatattatactccctaa

SEQ ID NO: 244594 - DNA, 646 bp, Homo sapiens
ctgacatattagtagaattcaagacactacaggaaaatcaatccagatttggaggcctaaaggatacataggaattaaccaagaatagagtacaaatgaagaggggcaagggattggtgtcccaagggtatgaaaacaatgttagcagtgaaggaaagcatcacatattcaggggaccttgaaaagtttggtgtgcctgagcatagtgtagctggaaggtagtggtgggagatgagcctggagaggaaatcaggggctagaagataaacaggaatatatcacagagttacttaccttaaaagtaatgttgagccactgaaaggttttcagcagctctcatcaggtttgcattatagaaagatggtcttcaggtgtagttgaatggttggaggggaagttggaacaagaccaaactaccatggaagagactttcatctgttttgtctcagcagatagagctgtatatgtcttctccctgtcctactgttttgggggactgagattttggtactcatcagcactcttgctctcatattatggacttaatagatagttagtttccaggtagaaatatattccatgctccagatattttccttcaatagagtacaagtgccatagcataaatggatctgggaacatggct

SEQ ID NO: 244595 - DNA, 383 bp, Homo sapiens
cttgaccaactttgctttctgccaacagtagtcctctcatttagtcttgcaagaagaggtaagctacaaaaactttccatatgctatacattagaccatgtagtatagttatgaaatgagatatagatatcaaatataaatgatcagtctcaaaaattatacagtaaaatacatttaactttgaagtactagtcatttaatacttgactcaaaaagagataaagagatataagttggaatcattgaaatcttaaatgaacttttatgattgaactagttatgcttggaagtactggttaataatattctgattgtaaagaacattttctttattttagcatcattttttcctctgagtacaccagtagtgtagtgtaagaatc

SEQ ID NO: 244596 - DNA, 357 bp, Homo sapiens
atgtctgattctatgtaacaagtagtaaatggaatttttcactaattgaatttttctgtttaacctagtgtccatgtgtacgtattgtacatatgactagttttgtaagcattagaatataataaacttaatcttaaacatacacccaaaacaattacttccaaaaattcttcaggaggtctattggaatctttagtgtgaatgattatcattgtgagcatctattgctattttagagtcttgcttatggggaaaaatactgattctgtgaaaataccccctttctccattagtggcatgctcattcagctcttatctttatattccagtaagttattttgctctcactgttttaac

SEQ ID NO: 244597 - DNA, 550 bp, Homo sapiens
tagatgttgttattatagcccaggtcaaggggatctagtgggaaagtggctgaggaaaaaaggatttcttcgaggtatttaatttgaaattgttttagcccttataggtgagaatgcacagaggagaagtgtgagtctttgttcccatagaattatttcaccagctcagtctggcagcctccaccttttcagttaatgctgacaatgtcaggcactctatcaggaagggaaagcataagtgtggaggctagaaagttccagagcttatggagagatctgttcatggctccaggaagaatgttctaataggtattctctctttgcttgctcctttaccttcttgctttgtcccatatttgtattctctctcactctctctctctctctctctattcactttgattagagtttggaagacttagaatatcttccttttgaatagggcctggtctggtcaatgatgtttacatgtcaacattcaggaatcactttcatttactctcaagctccatcacgtaagaaactccaaagccagccaggttaaaaaaaa

SEQ ID NO: 244598 - DNA, 456 bp, Homo sapiens
cagacactatatttttcagtgtcatcctgtgattttttaaaatttcataggtatctccccattcagcctcttatcttgaaaaatccatccagagaagctatgtttatgtctctttcttcatttgttctctctctttattttctcattttgtaaatctggccaccgtaggaaagacagcagccattcactttacagaaacgtctattttaagaactagctgcttgggggaaggctggatactttaatccttcatcttttctttaacaatactagctggtaggtagtcagcaggaaagtagaagtggagctttcagaaagaaaacattcacagtagaaagtagtgcccattatgatgttgaacaaaagtaattctcctggactcattttttaggaaagcatgttatgccactttgactttattaaaaaaaaagaagaagaagaagaaaaggaagaaag

SEQ ID NO: 244599 - DNA, 368 bp, Homo sapiens
aaccaatttttagtttctttgatttttctctattttttgttttcaagttcattgatttctgcttttgtctttataatttccttcattcttattgatttgagtttaatttgttctttctcaagtgtatcatggtagaagcttaagttctttaaggccatttttctctttaaaatatgcatatttagtgctataaatgtccctctaaacatttaacttcatcctacaatttgtattttgattttcatttacttccaactattttctaattcctttgagactttctcttttgcccattattttaaaatttgatgattaattgccaagtatttagagatattatctttctgccactacttctggtttaattt

SEQ ID NO: 244600 - DNA, 380 bp, Homo sapiens
gagatggaatcttgctttgttgccaggctggagtgcagtggcacaattccagctcactgcaacctctgcctcccgggtttaagcgattctcctgcctcggcctcctgagtagctgagattacaggcacgagctgccacacctggctaatttttgtatttttttagtagagacagggtttcaccatgttgggcaggatggtctcgttctcttgaccttgtgatccgccctccttggcctcccaaagtgctgatattacaggtgtgagccaccacgcctggcctccaattttttttaatatttaataaagtcctttttttttgtcatgttaggctttgttagaggttttttgtttgtttgtttttaccatgtatgttgcatt

SEQ ID NO: 244601 - DNA, 589 bp, Homo sapiens
tattcagttgtttctttattacccctgtgcaccctccctctgtaacagttgagaataacaattgggctttacttgtcttcgggaagccagcccattcattgaaggaaaaatggccccagccccaggttgccatagacactggagaaggctgtcaccgagctgcagcacacctatttcctggtgacatgcagaattagaggtattggggaatcaaagggaaaactaacttgatgaaacaaagggtcccttcagcatctcctgacatacttctttgcaaaagcagtctctctgtaccccttctcccttccccttctccttgaagccaggtgaatgaatttgaatccgaagccctgagaagaatgaaagcagtaacttccatgcatggctcaaagttatgcacagggcaaagacctcctttaaatcacatcggcgacttgccaggattccaaacttcttgacatgtccacagtcctcaaggatctgtcacatgcctatgtctctacattcctcagttactctgttatcattatgctgtcctcctttgagagcataaatgtgcaaagcattttcccaactaggggatctttgt

SEQ ID NO: 244602 - DNA, 471 bp, Homo sapiens
cagcttcccacaagaggagcccaggttggagagaggtgcagagccatggagttggggactagaaacctctagtgctgggtctcatgacctccgtccaggtttggggctgagaggggagggtcctaccatgtcccacctggttccctcaactccctgccctggctggggtaagtcagaaatctccttgcagtcagagacaagggaaggatccacgtgtatgctcagaagtgagtggggtttggccaggcacagtggctcatgcctgtaatcccagcactttctgaggccaaggccagaggtttgcttgagtccaggagtttgataccagcctgggcaacatagcgacaccccatctcaaaaaagagagacagagggagagagaaaggaaagaaggaaggaaagaaggaagaagagagagaaggaaggaaaagaaggaaggaaggaaagaaagaaagaaagagagagagagag

SEQ ID NO: 244603 - DNA, 408 bp, Homo sapiens
accacacatagctactttaaaaaaaattttgtagaaatggggtctccctatgttgcccaggcctgtctcaaactcctgggatcaagcaatcctcccgcctcggcttcccaaaatgccaagattacaggcgtgaaccaccacgtccagcccctatcttccattgttttactttcaacattttaacatccttaaattttaaatgtcttttataaatggcatataattattttaaaactctagctgcccaaagtggtgatttaattgaagcatttagtccacttacctttaagataattgttgatatactagggtaaataataaacatttctaccatgtatctcccgtaaagagagaaaaattttccttgggaagaaatgaaggatattatattgatgccatctactgaaa

SEQ ID NO: 244604 - DNA, 392 bp, Homo sapiens
agggttttgtttgcttacatgtttgtttttggtacagaaaggtgaaaaagttctggagatggatagtggtgatgattgcacaacaatgtgaatgttctgagtgccactgaacttaaacatggttaaaatggtaaatttcatgttatgtatgctttacgacaattaaaaatatgtatatgcagtatcttttaaagtctttatatttactttttatttttctttaattgaaggagatggaagacatttctactaaaattatagatacatttattatttgaccaagatgtatcctagagatatgcctgctcacattggaatgtcattatgttcaaagtgattcattgcaagattgtaatactaaaagactggaaataaagtatgtaactagaaga

SEQ ID NO: 244605 - DNA, 318 bp, Homo sapiens
cggagtgtcagcttatctgtaaagttacattaagctggttggtgaatacatgggttttatataattatttatacttagtatgcctgaaaacaaaagtgaatttttttgggccagattattgaggtgaagtatgaatcagagttcagagactacttggggccttataaaactgaaatcatccttttatgttcttagaaacagatccttatggctgtgtgtggtggcacacacctacctataatcccagcattttgggaggctgaagtgggaggattgtttgagaccagcctcagcaacaaagtgagaccctgtctctac

SEQ ID NO: 244606 - DNA, 283 bp, Homo sapiens
ttatagatgaggaaattgaggctcatggtggtaagtgaataacttgcaccaagatcctatggctggtatgcagtagagcctcaattcaagtacgggtcttccaggtccaaacccatgcaggctttgagaggtaaggaggtagagaacgttgacaccccgttcttggtgtgtttttcagcaaatacttgtatgcatattaaagactgtctacccttttgtcatcttgtgtcacttgctgcttcctttggtactacccaaatttctttcagcatttcagctttga

SEQ ID NO: 244607 - DNA, 921 bp, Homo sapiens
aaagcagaatagttttcaagcagaatgtattcaagcagaatggctttcttggattttgttgtgcccaataaaataaaacttttccaagtctggagtagaaaggagaggcttcttggaagtagcaatgcttaatttgggccctgacgggggaggagaaagtagttgacatgggaggaagggcaggaaggagggagatgtccatgtactatgaaatacaaaaacatatgattctattttatgtttcttttgaaatctaggagcccaaggtataccagcatgaagaggatcacctgagttacctggagatattgagatatgcccacccctaccaccatgtgcctgctgtgtaaagctcaatgggccattaccaggaccatcccagtccactgtcttccaggaagctctgtacaaccatcagaatcattctgacctggccactggagtgtgttcttcattctcctgcaccaccctcgtgtataccactttggttctgacattgcactgtttcagaatgctgtcaaggtgggtctcatgaggaatggtatccaggtcagggacaaacaaggagaccaaggacagccatgagcaagtttcaggaagttccatcacacagctgagaaatgggatatgatgtggccacagtctaagctggacaaagcggagtctgaaaaaggaacttatctaactgtattctatgggtatttgctcagtggaaattcagaaggctggaactaacagcatgggccttttcctcaagtacctctgcacttaagaaaggatgctttctactgctctcagcccaagtattccctctagtatcattcaatggtgaatagctcaccaaattggcaatggctaagtttgaacaaaatgaatatattagcaatgactgaaaccaataaagaccaacaactcatcaat

SEQ ID NO: 244608 - DNA, 527 bp, Homo sapiens
tttttttttctaattattcagttccactggggcactctgttgttgtaaataacccatttatcgtcatcgactcttttggatttttcccagaactaatttcatttttgaaatagtttctcttcttattgttttgagcaaatactgagcaccattatagatttatttttgtttgtctgatagatgctactattaaaattcttttatatgattggagatagatttccatgacttcaaaagcaagggtgatagtcactctaaagattacctcccaagtttagaagttcatttaaaaatagctctacaatgtattgaaaacccatttattcagccatcatttattgagttacccaactaagagctctgtggatggcaagggttataaatgccgaaaaaatgtggtacttgcccaggatttgcactccactgagaatccaactataattgccaacattttccacttctgttgttttaattatttcaaaattcaggtcgacgcggccgcgaatttagtagtagtagtagtaggc

SEQ ID NO: 244609 - DNA, 348 bp, Homo sapiens
tcggagaggcagggcaagcaggtgctgcccaactgaccacactccaggctcaaggaacacccacctctgcctctgtgtctcctcttccacaaaatgctcaaagagggccacttcaaggggtcgctgaggcaggagagcgagttcccatctggccttctctccaagccttggaatccagcaggggagcagttggcagcccagggacaagacagaggccaagcagtgatgtatgctctgttggccagcctgggtggaagggagagcaggtgagatcccaagcacatgggtcctcttaggcccacgggatcctctcaagccccagtcaggagggaacgaacccttcggggc

SEQ ID NO: 244610 - DNA, 812 bp, Homo sapiens
ggaacttcacacagtgcgaggcacacagggggccctcagtagctgtctgcgaactgaattcagccctgcacccagcccatcacaagcatctttgttctaaggcggtccaggaggagagaaggagctgccacgtgctgatggtctcccgtgggctaggctcttgagattccatgtgtgtgttctcattcagtgctcacagcaactccaccaggattccagtttcacagccaagaaaacagaggctctgtgaggggaggcagcttggcgaggcaatcacctcatgtggggcagtgcagggttgtacacatctgtgtcccacttggatgacttgaggaatgacttgaggattacggaatgacttgagggtcccacagaacccttcttgcgaaagacccttcatctggaggctgcactggagaagggatgctggacatgttggagcctcaaagtgcagcatcttcagtttcttgaaacttctgtgcttcttgcttgggtaactgtgcttcctctgatctttgggccaacctggcccatgagagattccaaggatttgagctgtctctagggtcatggggcagcctacatcttgtgcttgatttttctccagggatatcctaggtcaggtagttagggtgatggacattggctccagagtcagcctgatgagttgtgtttttctaaattaacttttatctggcaagagtgttgcagaatcaagttttaaaaaatatttgcatatctcatttctttgtctaattagtgttgtgagaatgatgtcacagttttcatgcttgaataaatagctgatggtg

SEQ ID NO: 244611 - DNA, 546 bp, Homo sapiens
ttagtagagacggggtttcaccgtgttagccaggatggtctcgatctcctgacctcgtgatccgcccgcctcggcctcccaaagtgctgggattacaggcgtggtggtaagggcctctaatcccagctactggggaggctgaggagaattgcttgaacccaggaggcggaacttgcagtgagccaagatcgcaccactgctctccatcctgggtgacagagtaagactccgtctcaaaataaataaatacataaaataaaatatagatcacttttcttttccattgttgcacaattttacatgtatgaatattctgtagtataaacaatcctccttttgatggacatgcatttatttttccagtgtttcatttaacaaacaaaatctgaatgattattcccgattgtactgctttgcacacatggtctaatatatttcaaggattaataagtaaacactattttattcacagtaaatggttcactcatgtttacactgtctcctatttatggcaaatgataatggtccatccgctatgggggtaat

SEQ ID NO: 244612 - DNA, 301 bp, Homo sapiens
agagtgctgctgtcttatctttcaaagccctacagaaatatggagttgactacaaaattataaattctgaaaataaaacacgtgtcttcagggaaattttaagcttgacactactttggagtaaatccctaggtccccaggagtgatctatttattgcctgccaccattagtgtatgtgggtaaaagtttgagaaggcctggagtagagtagcccaagccctcaatttgtctttcaaggcccagtgccttccttcccccaaaccctgtccgatctgtcacctacatgtaccttattctcta

SEQ ID NO: 244613 - DNA, 448 bp, Homo sapiens
ccatgtgagatgacatggcatgaaaaaaacagtgggataactgcagccagtaacacagaaaaagaagaagggctatgatgtatacgtgggtggaatacacataaaaagacaaagcttaagataattagaaaataaatgaagcagaatttctttttaaattcagtaaaattcagctttgcagcctgaaaaaaaataaaatgtcctctccacatgaagaatcaatgttatttgtttacctttgatattttccacctgacttgcagtttgcaactttcacagaagtatttatgccttattatggagcatctgttatacagcaagcactgtcatgtttgtttgctacatttatgtataaaaacattctcatgacttatgaagtttccctagtacttacctgaacaaattgcctaacgaataaatttacttatatccatcacaaaaagtgaaa

SEQ ID NO: 244614 - DNA, 560 bp, Homo sapiens
acagggagaacgccttgagcatgaaggcagagattgcgatgatgtgtctgtctacaagccaaggaatgccaaagatcaccagcagagagaggcatggaacagacacttcccccacagcccgcagaaggaaccagcctgccaacatcttgatcttggacttctggcccccagaactatgagaaaataaatttcttgtagttgtttaaagccccctagttggcggcagctccatggaactgatacagaaacctggctttgaggccgtctctctggaagactttgggcaaatgactttcctctttgagcctggggttgggaacctgagactggggaggcctggctgtatagaaatcacaggccatgccgggcgcggtggctcacgcctgtaatcccagcactctgggaggccgaggcaggcggatcacgaggtcaggagattgagaccgttctggctaacacggcgaaaccccatctctactaaaaaatacaaaaaaaaagaggcagaagaatggcgtgaacctgggaggccggagcttgcagtgagccaagatcgcgccact

SEQ ID NO: 244615 - DNA, 429 bp, Homo sapiens
atctgaaaagacgttgatgctagttatgacaaatatcagtcaatgtagtcagttgattaaatattacaaggtcgattagtaaattacattttaaaataaaatgaatactttctattgcatatcaaacaagtaggcattgtgtgttcaagattcagactcatagaatggtagtgaatgtaaaaactcttggaaagcttcttgcaaacacacattaaattttatgaaacctgaagagaaagagtatttacctcaacctggcttatgttacttatttttagcgtctttaaggtatcgtttataattaattccccagccttcttcttcttgtaaatgtaagcttagtgtcttatgttctcaaagcacttcatcaccttagaatgtcttattcttctgaacttaaaagttttatgtttgggcgatacatgcgta

SEQ ID NO: 244616 - DNA, 419 bp, Homo sapiens
tctattagttttctattgctgtgtcacaaattatcactaacttagtggctttagacaacagaaatttatgatctgacagtttttatgagtaaagagttcaggcacagttactgggtgttatgctcgagtctcaacagactgcaatcaaggtgttagctcaggctgtgatctcatctgagactttgggggcctcttctaagttcattagttgttggcagaattcagttccttggggttgtaggactaaggtgctcagcttttgaaggttaccccttttcataggcatttcacaatgtgggtatttacttcttccagacaagcatgagggcatctctctcactaggaatttctccatccagctggctaaaatggaaccttatcaaatataacctaatcaaggagtgactaccccaatatat

SEQ ID NO: 244617 - DNA, 562 bp, Homo sapiens
cagcaatgattgactctaccataaatccgttctccgtttccatggagaaagctatcttcagccaccccatggtgctgtctgttgggcaacacattaccctcagaggggactgggatgaagtgtgggcttgttttctataattaatccccaagaactctgcccctatcttccataaaaaccccagagtccccatgggagtagatttccctctttattctagttgaagtctcctggagggatccatatggtggtaaattgtttttgcaattgaaacgccttaggcagcaagaggaatcgtttttcacagccttggagaaaatgcctgcccttaataatgatggaaaagactcttctgtttccaatttatttgtcagaagtaagtggaattgagctcattaaatactgttactataaccatatattcaaaatgtctacctatctacatattcaggagaaaaatgtcaataccatgagcttttaggatgagaaaatctagacaagaaaatctgactcaagagaaaatctgactcaagaaactgtccaatcaaacctacatttggaa

SEQ ID NO: 244618 - DNA, 243 bp, Homo sapiens
gaaatttgataaagcatcattttatatttgtactaaaagcacaagatttaaattagctatcatgagtccatattaaaaacaaaaacaaaactgtagaatgtgaattatagctctgtgtgctacccagaaaaaaattcaagtcttaatgtacttcaaagcaaatattatacgattaaaatgaaatacattgatccatgattattttatatatattcattctttggtttggtaggtgaaggtata

SEQ ID NO: 244619 - DNA, 563 bp, Homo sapiens
cctatatgtcagatttaagtcccagaagcagtaggaatgcagaccctagaaaaaaaattaaagaatgtagtttattttttcctctggggtgttaactgcagctactacagaatgcagactttggaatttcaggcataacatctgaaaccatgcaagaatttagatttctgtattaaagctaaatcttcatgtaaatatggtgtaaaacaatgcattatcattataaacactgtgccttacgagctggttcaagcagaacccagataattggaaattatatgaatttatagattttccatttgaaccttattagtgttgtttaaacttgtaataatggatattttctagttatctgttttctttttttcatacactgtgatggtattttatgaaatcatttggttttgggaagttggaatttcctaaagccacagcattaaagtcagataattttatttacccaaaagtttctggaacgctgtggttctgtactgtgtatacaactaaaataagaatataaatttatataaaaataaaaatacaactatataagtaaaatttga

SEQ ID NO: 244620 - DNA, 465 bp, Homo sapiens
ctgaggaaacctggggtgggtgcaggtcctacgcagtactgaaggcctaattgaagctggagacaaaacagtggtttaccacgttccaacctcctagttccattggcctagaatttcacaatgctggaagctattaactaaggactgcctttcatggaaatttataacaattttcagtgtaagcagtcttgttactgatatattcagggactgcttatactttttacagacgaaaaaattctcctaaatccttttttaaatgaaaatgttattttataccaatctaaaacttgtattcagtttaacatcttggttttgcaaaagaggtggtctgtattcatggaaacccaatgctgcttctgaggtaaatttaaaagacaactagctgcgagagacaagatacttctaaatactttatggtaggacagtaagtattgactcatggtgccccttgttaacaggagg

SEQ ID NO: 244621 - DNA, 466 bp, Homo sapiens
aagatgctaatgtctccaatatgtaagacacatgtgggatcagaattaaaggttagctgagccatatggggctcagccttctaagcaaataaagttagggtagacacgtcatcagagctcaatcctctgtgtgagtggccaagattagatctcataagatggtgctgggcatgattgtggcatgcctgtttccagctacttgaggcaggaggatcactggatcccaggagttcaagactgcagtgagctatgtttgcaccactgcactccagcctgggcaacataatgagaccttgtctctaaaacaggaaaaaaaaaaggctgggcgcggtagctcacgcatgtaatcccagcactttgggaggccaatgcgggcggatcacctgaggttgggactttgagaccagcctgaccaacatggagaaatcccatctctacaagaaaagaaagaaagaaagaaagaaag

SEQ ID NO: 244622 - DNA, 500 bp, Homo sapiens
tctacctctgttttctcttactatacttgcctacatctcatcttctgtcaacaccaggtactcaccccatgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaataacagactcatccacactatgaggctgtgcataaggtcatgtatgtaaaactacttgctttgttgatcattctgtcccagataagtatgaattattatgcatcatttcattaaacaagaaagcttcactgtgttaatatgc

SEQ ID NO: 244623 - DNA, 368 bp, Homo sapiens
gtgagacagcaaagatggcagccagcttcttcctctggaagctttgtcccaggtgggtagtgacccattgccagcctgccctacctgtaggaagtgggttggagacccacattgggtggtctcacacaatcaggaggaatgggatcagggacccaactaaagaagcagtctggctgtgttttggtagagcagttgtgttacattagcggtgggagggtcccttcctcatctgggccacctttattctccaaacctggcaggctggagtggctgagtcaactgaaccacagagatggcagccacccctctccccaggagctccatctcagggagagattgctttgtccgtggaacccttgctggagtag

SEQ ID NO: 244624 - DNA, 485 bp, Homo sapiens
ggactgggtgtggtggctcacacccataatcccagcattttaggaggctgacttgggagaatcacttgaggctaggagtatgagaccagcctggggaacatagcaagacccatatttctaaaaaaaaaaaattatttaaaaaattagctggcatggtggtgttcacctgcagtcctagctactcaggatgctgtggcaggaagattccttgagcctaggagtttactgcagcctggatgtcagaaagatatcctgtctaaacaaaacaaaacaaaaatgactaaatgggatgttttttaagtttttcaacacctctcacttcaataggtaatctatgcagcctcctgttacagagtaaattaaaccctgaggtattaaaacctaagagaatcagtttctaggtatataaatcttggggatatataaggaaagctaggaatgtagaagcagataattatcactgttgttcagttaggctgttatat

SEQ ID NO: 244625 - DNA, 158 bp, Homo sapiens
ggtgctcattgtatagtggctaccaccaggattatagtacatacaaaggatatttaagcccttaagggctgttgaatatgtactataaccatatgtttgaaacatgtgaatatcagataacaccgatattttaaaatgcatgatgttttcttcactgg

SEQ ID NO: 244626 - DNA, 366 bp, Homo sapiens
ttatgataagaacctctacttgctttactctaagtaaaggcactctttgtccggggaatttaaaattagttccattaaatccactggaaccaatgctgctgatatcacatatgaattccaggtttatggaccctaagagttaatggataatgagaattcaaggttccctattttcttctgtcataattattataggaatataagtaattcatttaactggtctgtgcccttgagactgcacaggttgctaccattgtcacacaacactgcagcattattaaatatacttcatattaagtcaggtataggaagataaaatagaaagaggagacctaatctctgaacttaatgagcttagacttcaac

SEQ ID NO: 244627 - DNA, 577 bp, Homo sapiens
ctattcagtaaacttttttaatgtataatttgtttttcctatttacctaattccgttattcctaaaattgcaacatgtaattccatgcaggtattatttagccagaaacactcatgccctgatgtattcagcaaaccactgaatagttactcttcagggtaaaaacaggaattcggcttctcttggttgagtttacctccccatagtggctatataatattggcctctgatgggagctgtttgtgtttgcacagaaagttttcacatatcacctaaaatagggagtgtgcccccatctctgtgctggttagtggggtcctacgtaaattagtaagttatctgttgactcaaggttctttccatcttcaaggtgctctgcatcgggaaatgaagcaaacaagaaacaccagcttcagttcttaatccagaatggcactcaccccaaaacacaattcacaaaacttcttaaacacaggaggattgtttgagcctaggagttcgaggctacagtgagctatgatcacaccactgcattacagtttgggtgacagaaaagcccaaaagctatctctctctt

SEQ ID NO: 244628 - DNA, 564 bp, Homo sapiens
attcacataagtgacagaagcaaatgtattagtcaaaggatatcttcatctatattgaagtacaagctagaaagtaaacttcttgaaggcagagattttttttttaagttgtgtggctctaccacctaacataggttatgtacagaatagacatcaatagtgaatgaacagatgaattagttaatgagttaatgatggatttttagcacattttctctcttttttaggaacttaagaccccaactgagttgtttagaggaaggggccttaggctggggccaaattctatgtcttctatgcagacgtgagataatgtgaaatgttttccttttacagggtgtttcccctggcttttcagcattcttctcaattctttaattgccatttaaagatttgtatgctgtggatgagctgatggaggggaatgtttccctgaggacatggcttctcatggcagccaaggttttgtgcctgattaactcgctgattgaatcactggcctctggaggcaccaagggagggagcatgagtatatttaagcagccagaactctctgtgcctgtg

SEQ ID NO: 244629 - DNA, 223 bp, Homo sapiens
gtaaagaggggataccttcttaaactgatagacttcctgacttctttcagcagggtattgttttaaatcagccttgcagataaaaattaattccatctttttcagacaagtgaacaatttagttccttggcagatccaaaatgatagatggttatgttacgctttctgctgtcccttgccaaaaataagtaaatatatcagttaagattatgcctttacaaaa

SEQ ID NO: 244630 - DNA, 314 bp, Homo sapiens
tgctgctgtgtcgacggttgacataattatgtcaacctgcttctaaaagaaatcacatcacagctgtgcatttcaccagcaagctaccacaagataagaaaaaagaattcccagtaatggataccccactcaatcctcagtctgggttgacaatcctctgacaaattctggtgtccatgacatgcactgccttattatctgtatgaatttcatctgtctaccaacctaatatgaattagggtatttacaagataacctctaggatgtcattgtataacaatttgagtatgttaaagtgtctccttttaatgtta

SEQ ID NO: 244631 - DNA, 477 bp, Homo sapiens
agtatgaaattagtcttcaggagctgcattacctgctttcattctgtaataattcctaatgttagatgaagttttacttaggaatattctcaactctgaagtctctcacaaacttctatgaaatgcatgtgttcagagttaaattttcacaagaactttgctcaagaaattacttttcacctcagttcaatgtgaattttctctccttgtaagcaaacagaatgtagcagtactatttctatcctaagaacatatgcacgttgttccattagtagtaatattttcatcagaacattgtttaacagtagcaagtgataacatttgtaggcagtaatcagagacttgacagctttcctcaccactaacattcttccatctaggagacaagagatgtaaatgaaatagaatacttcagaaaatgattattagccgatgctaactcaagtgccaagtcgaagttgagttacgtgtttaaaa

SEQ ID NO: 244632 - DNA, 419 bp, Homo sapiens
ctcaagcaatcctcccacttcagctgcctaagggctgggattacaggcatgaaccatgatgcccggccatcttatttcttataaaaatacagtttaaaagaaagtgatgccacagccataaaaaaagaataaaatcggccgggcgtggtggctcatgcctacaaatcccagcactttcggaggccgaggcgggcggatcacgtgaggtcgggagttcgagaccagcctgaccaatatggagaaattccatctctactaaaaatacaaaattagccaggcgtggtggcacatgcctgtaatcccagctactcaggaggctgaggcaggagaatcgcttgaacctgggaggcagaggttgcagtgagctgagattgcagcattgcactccagcctggggaacaagagcgaaactctgtctc

SEQ ID NO: 244633 - DNA, 491 bp, Homo sapiens
caaggtagtatatatgaacccgttgatatattctgaaactccaaatgatttttgtgtgggaagtattgtccatattttcaacacatttctacacagtataacttttataatgagaaaaatattttaagttagctatgaggaagtacttcacgagattaaatcccgtcaatgcttatctttacctacttcaggtgcatgtctctgtaagctgccttttaactgtttttagaacatggtagggtgtgagtaataatcccaaataaactactcctcctcagcttgcttgagtggttacagcaggtcagagagtcaatctttcaggctccttggccataagatctggctgcaactactcaactgtgctgctgtagcacaaaacaggcgtcgctgtgttccaaaaaaataccctttaagtacaaaacatgatgggccagtttgctgacccctggatcagagaacaaactcaaacgctggtatgtcaatctcaagta

SEQ ID NO: 244634 - DNA, 462 bp, Homo sapiens
atatattcacactttaaaatgttgtgcaagtactatctctttgattcaaatatgtcctttgggtgggcggagtacatatttcatggtgataaattcaccttataagtagaaaaactatgcacaaatatactgcgatgtcaactttattgatttgtgtaccattgttaagacgttcatcgtcctccaatatttcttaaatctatcagcatctcagaaagtgaccatgaaggcctcatttatctatagaggaaaagatcccttcctttaggttcactcataacattgtgatttaaacagctcaggaccacctctgctctgaagggtaacagtcccagagaaagccattccctcatagtcatgcacagggacttctctttttgtagaactagggtgtgtcaagtcttaagaacagtaaaatgcccatggctaaatgcccttttaaacgtccttcagataactatg

SEQ ID NO: 244635 - DNA, 552 bp, Homo sapiens
caggagtcagtccacctggaacttctgcctccagtgcactgagtctgcacggaccaccagggctgacactgccttacttaatatgggggtgggggaagtccctgcgatatataatggtctcaatttaaattctgtgctgtttttattttagctgtgtaatttggaaacttcaaataaaaagcctgaaaggaaagttggactatttaagcttacacagactctattaatgctatatggttattctacccctgactttggaagaaggagaaactggcatgggaatacacttttctaaaaaaaatactatttaaaaatatgaaagtttatttaacatctaaggaaaggtacttaattagagggacactcaacaagaagaattgaggatctaagtaaatagtccccatctgctcctggtcctaccacctggcgattacttcctcttcttctctgatagattttagccaaccaattttgttttatttgtgcaagttgagaggccacctgttatggaatatacttccacattaaacaaagtgaacatttcctaaatct

SEQ ID NO: 244636 - DNA, 439 bp, Homo sapiens
caaaactgtaatttaaactgatttatgtcagactctgctattacttacattttatgtgtgtattgagggtgcagagagaaagtagattagagtaagagagttgagagagaaaaagtgtaattaatgagcaaaaattaatgagctagcgagctacaaactgcttgaaatatcagctgtattattttgtaatcaaactgcatacaactattaatttctgtaaaacatgtgttttgttcactttggaaaaatataaattaaaatgatgctatccatttacttactcaattgatgttaatatgtgtataattacagaattgtataagaagactcaggtggcagaaatgagtggaggccttaatgataagagagaaaaccaatctggctcagggtaatcttttgcttatttatatgatcaaaataagatgtttcaaaatggaaa

SEQ ID NO: 244637 - DNA, 452 bp, Homo sapiens
ccacctcagcttcccaagtaactgggactacaggcgcttgccaccatgcctggctaattttttgtattttccatagagacagggcatgttgcccaggctgttctcgaactcctgaactcaagcattctgcccatctcggcttctcaaagtgttggaattacaggcgtgagccaccacacccggctatatatacctacgagtagaattgctcggtcagttctactgtgtcgagtcaattctgccggatctacccggtagaaatgctgggtaactttaattgaatctttttgaggaattgccagactgttttccaaaggaattgcacaattttatactcccaccaacagtatataagggttctgattctccacatcttttccaacacttattattacctgtctatttgataatagcagtcatagtggttctgatgtggtatcattatagttttg

SEQ ID NO: 244638 - DNA, 375 bp, Homo sapiens
atcgctccaggtctaagaagcactggtctgagggttaaataagccttatcccctgtatttggtggagagatttgaagggtaactgtgagtaggagacttcagctgctctgatgggaagggcaagcaagggccccctgaccttgccaggaataacaggaatcttccacagtaataaaaactcttcagtttatgtcccttttcttatttgattacctcacctctctgggcctcagtttccttgcttgtagagtaagtggtttaaatttaatggttttctagaatctctttggctccgatagtcctgaatctttctagtgttggaagaagctctaatctagaacagtgttctagagcaatgttgtctaatcttggtct

SEQ ID NO: 244639 - DNA, 431 bp, Homo sapiens
acttcgctctgcaactttccccattctgtcttctacttactgagattctttttgtatgttgcattcaaactttcttagaaccacaatctgtttggtttatttagtcattatcaggtgaagagtagtccgctcagttaagatgctttcataggcagcataataggcctcccattgctagtagccttttgctcagcaccaacctttgttctaattagttgtggctagggtgatggtggaggtgacatgattataatgaaacacccatgggcacttttctcaaaaggcattgcaaaaggtgtacagaacttcatggcgtgttagttatttgttgctatatgaagatctttgcagtttttaagactgaaattggcaagccagtcacttggacatgttcctaggatttgagatataggagtagtatatttatgtgg

SEQ ID NO: 244640 - DNA, 1890 bp, Homo sapiens
  misc_feature (49)..(49): n is a, c, g, or t
  misc_feature (341)..(341): n is a, c, g, or t
  misc_feature (1256)..(1256): n is a, c, g, or t
  misc_feature (1495)..(1495): n is a, c, g, or t
ttttttatagagacatgtcttgctgtggttgcgcaggctggtcttgaantcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagangtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagattgccttcattcactttcagcaaagccaagggcgttgtctttcccttttcatatctgggacctcattttatttcaattttatttgtctcaaatcaagatagtaggaataatgaattactgttcattctgattttttggtacttgcaaaagtatgtgtatgtttttaaacactcccccaacttccagacttttataagattgggaaaatagcacagataatgtaatactgattggccttagagccagtgaccctggacaactcacctaacctttctgagtttcccatatttccctttttatcttccccttcacttacatgggtgaattacaaaaaaagttttactaccctaacatcaggaaggtcattataatgtagtagcaaagagcatagactctaaagccaaactgtctctttgtgaatcttggctctgccacttacctgtgtgtcctggggaaagttaactttatgggcccctgtttcctcaactgtgatattaggatactttcagtgttcacctctaagagttgtagggagtcaacgagtaaacacatgtaaggcaccttttagaaagctgcctcctacatagtaacctttctaaatctttgctgctgttancattatgacattatcatgataccagtatcatcctcagtcaacaaacgatagataactcagagaatgaaaaggttgttcctttatatagtttccctagaatcaccttgtaccactgctgctgagttgcaatcattcgttagtcgtatgtgacctagattccattttctaagattattcaacaatgtagaggatcagcgtagtggaaatacgtctataaacatttctaagaattgaattcnttgtaattaatagcatcagagaagctgaaaatccaaagagctaatctcttaacttcatgatggaggacaaagattttatcttttggaattttaataatgtttccagcatgagattagccttcaatattgatttctggaattctgttttcccttgtttttcattgattaacctaaaacttttgagatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaag

SEQ ID NO: 244641 - DNA, 480 bp, Homo sapiens
gagtcttgccctgtcacccaggctagagtgcagtggcacaatctcagctcactgcaacctccacctcccaggttcaagcgattctcctgcctcagcctcctgggtagctgggattacaggtgtgcgccaccacgcccagctaatttttgtattcttagtagagacaggtttcaccatgttggtcaggctggtctcaaactcctgacctcatgatccacccgtctcagcctcccaaagtgctgggattacaggtgtgagccaccgcgcccagccttgcttttattttttaatgagatgagtacataaatagcctcttcatgcttttttcagctgcagagtgcaggtattaagacgtaaatgggatctagaattctgatttgattctgtttctctagcaccgacattaagatagactcttggggatccagtgttcacaggcactgttactccacctggattttgtctacagagtgaattatc

SEQ ID NO: 244642 - DNA, 658 bp, Homo sapiens
actccacagtcttcagagtggggaaaataaaagggtcaaacaaggggcaggaggacgcaaggggagaggccgagaggtctcattcccattctcccctgtagggctgactctctgacttcaagataggaataaaaggaggaggagtctgctacacccaccattaagtgcgctcacagtatttactcaaccagtgacaaggagggccaaacaagaggaaaaatcctagaactgcagcaagacagatgggaatcacactagaggagggacttcccagggcatctgaggtaaggtgtaaaatctctgccttctcctccctaaatgtccccacaactgagtccagtgcaatacagcctgaagatgatagatgggtgagatggcatatgcccattctggaagggatgtcctgaatgtgctaggagttgtgagagatgactggaattccagtaacttttggcaggatttactactgtatctggatctttgggattgagagaggagcaagaagctgacactgcctactgcaagtggctataaagccattctcacggtcctgatgcaatgctcaagataaaaagcaagtgagtaattaataactaggttgtgaactaacctcttgctccaaggcatagtaccattttgcacaatccatccaggcctg

SEQ ID NO: 244643 - DNA, 908 bp, Homo sapiens
gcatcagtggcaccctccttccagtttgtttttgtttttttgagacagagtctcactgtctcccaggttagaggacagtggcatggtatctactcactgcaacctctgcctcccacgttcaagcaattctcctgcctcagcctcctgggtagttgggattaaaggcacctgccaccacgcccagctaattttttattttttttagtagagacagggtatcatcacgttggccagcctggtcttgaactcccgacctcagatgatccacctgccttggccttctaaaatgctgggattacaggcatgagccaccgcgcctggccaaatttttttgtttatttttgtaaaacatacctaacataaaatttaccattttaactatattgaagtgtacagttcaacggcattaagtacatttacattgttgtgcaaccatcaccccatctatctccaactcttccagttttgtcaaccaaaaatgtctctggaaattgccaaatgtcctctggaggcaaaattgctccagttgtttacaccttctccaaggtgaataagaagtcaaaaatgtcgatgtcataaaaaaatagaaagaaagtctaagaagctgcaataaagaagaaatgacaattcaacgcaacacataatcctgaactggttcctgtatagaaaaaaaaaattgctataaagaacactattggcaggctgggtgcagtggttcacacctgtaatcccaacactcgggtgatcagcccgcctcagcctcccaaagagcatctatattatatttatttacttcaaatatctgtagacaaatagaatgccaagacaggaaaagtaaatcaactctattagcacagaaggctaacttcaggtcagggagcaagagttatacataacaggttaagtgg

SEQ ID NO: 244644 - DNA, 434 bp, Homo sapiens
atatatttgggtgtgtgtgtgtttatattaacatatataagatatgttaataatcttaagcaaactccagaaaataattacattcagaaaaaagagaatgggatgcagttggcagtggtatctaggacaacttcaatagagcttataatgttttattttattaggtgtatattggatagatgaatgttatttatcgtttttgtggatgagaaacaatttatactgaatgttaagtaatagggagaacaatcagaccaacatgtgtgaatgtctgtttatgtggagaagctgaagaaacaattgtttgggttgataatgattactaactggaagctatggaaattgcatattaatcttcaaagtatttgaatataataaaaattacctaaacatcattcttgaacataattttaaaaataaaataataatatatt

SEQ ID NO: 244645 - DNA, 458 bp, Homo sapiens
ggaagaattttcttagaaccaaaaggcatggaattgatgacatgaaactgcctgagcttctcagctgacctgtgatggagtgttgtgcccaagtggaaagttcttctttctttcagagacatatcattcaccataaaatacaaccagagacttcaaaattactccaggctagaaggacactccaattaggggaaaagtaacctatgggcaaaccatcttccgtaagagttcaaggacaaaaaactactgatgttgtaataacattgaaacttaatgttttgggcaatccttaagtgatttatttggagtgtcccagtcattttagacctcttcaccttacaatgtattgtgtgagattatatttccatgcacctaattttaaaataaatttatttaggtagatgtagagacatattactgtgataaagcagttcataccaaataaaatttagctaata

SEQ ID NO: 244646 - DNA, 183 bp, Homo sapiens
aaaattgcatgctacaagcaagggaagaatgatttgaagcatcactgacttctcatcagaaactatgaaggccagaagtccctggaataatatctttaaagtgcttgataaaagccagtcaatccagaatgctatgttcagtgaatatatccttcaatgatgaagacaaactaaaggcatttt

SEQ ID NO: 244647 - DNA, 1149 bp, Homo sapiens
tcttttaatcaggttgctgaaatgtctcaaacttcctccctgcaatgagcagtaacatggtggaagggcgatcagcttttgggggttgatatttgctaatgaaaagacccaagcaccaggcaacatagtctcacgcacatttatttcaggggcaaacttttggagggaaaaggctctcatttttatgtgttgaatctgaaaattctcacctgaagacaaagtaaaaaaaaaaagtctctcagatttacccatctcactccttaaaaagaagagcttgattccttggcaacaaggaacaaatgttcctcagaatcccaagttatctcccacttcccagttctgaagttacatgccaggtagatctagttagatgccagtactattgtttctcaccatagcatcatagttcagaatgagactggctgggttcaaatcccgactccctcactttctagctgtgggccctgttattagctcactaaactcttggagaagaagtgctaaagatagaagcctgggtctctgaatgactgtgtggagccaagaccccaccttcccacccaatatatgaaaatgtaactggagtgccttaagtccttcagatgtggggtagtttgcactgtatgtagctagcatactcctgcctcggtttccctaacatagaactgttttgagcatcaaatgacttaagagtgatgggaaagcttagttgctccccactccaactccagatattgactctaataagggtagtccccaaatatctgtaacttttatcatgagccggatatagctatgactcccaggaattccccgtaaactcttcttgaatatttttcagcctgaagccctcttgtgggaagcaagtttgtctgctcctttctgtgagacgttcccagtcactggctcaccctgggagagacagtacgcgtgttctaagctaccaacagacttcctcagatgcagtgagtcagtacaaacacacaggcaaggttgaagaactctatggccttcgtctctcttggctcagccaggcacagttcctcttagcccaagacaaaacagcctatgctgttaaatcagtggttctaccagcttccaatcataaaaccaaggggcaataatacataaaattggaacttatacatt

SEQ ID NO: 244648 - DNA, 456 bp, Homo sapiens
ccttatctcataggtcatagaagtttggcttctctcattgacctggaaggatgccgtcatccactctgacctgcaaaccttttgatctcaaacagcgatcttccaggcgtggccccaaatcaacagcatcagcgtcacccaggagctgcctgaagccctcttgtgggaagcaagtttgtctgctcctttctgtgagacgttcccagtcactggctcaccctgggagagacagtacgcgtgttctaagctaccaacagacttcctcagatgcagtgagtcagtacaaacacacaggcaaggttgaagaactctatggccttcgtctctcttggctcagccaggcacagttcctcttagcccaagacaaaacagcctatgctgttaaatcagtggttctaccagcttccaatcataaaaccaaggggcaataatacataaaattggaacttatacatt

SEQ ID NO: 244649 - DNA, 821 bp, Homo sapiens
ccttatctcataggtcatagaagtttggcttctctcattgacctggaaggatgccgtcatccactctgacctgcaaaccttttgatctcaaacagcgatcttccaggcgtggccccaaatcaacagcatcagcgtcacccaggagctggattctttcccaaaacccaaaggcccagtccagtcacgagaagacatcaggcaaaccgaaattcagggaagttctacaaaacactaaccagtactcttcaaagttctcaaggtcatgaaatttaagaaaagactgagaaagtgtcacagttcagaagatactaaggagacaagatgaccaaatgcaatgtggcatcttgaattggatcctggtgaataaaaatgcagtgggaaatccagcgaaatcaaaataaagtctgtagtttagttagttgtgatgtcaatttcttagctttgataagtataatacgattatgtaagatgccaacattaggccgggcatggtggctcacgcctgtaatcccagcactttgggaggccgaggtgggcggatcacctgaggtcaggagttcaagaccagcctggccaacatggtgaaaccctgtctctactaaaaatacaaaaattagccaggcatggtggtgcatgcctgtaaatcccagctactcgggaggctgaggcaggagaatcacttgaccccaggaggtggaggttgctgtgagccgagaccacgccactgtactccagcctgggtaacagagtgagactcatctcaaaaaaaacaaagtcatttttctcaaaaaattaatcgaataaccgacagggaccagtgc

SEQ ID NO: 244650 - DNA, 459 bp, Homo sapiens
gcactcctgccttaagtcactgttggtagttggtgggctccggtgtacacagcctcaaagtgaaattagaaaagattgaaaactagaaacaactgaggactagaaattcaactagaactcttacagctcttataccagaagaaattctagaacttttttgaattctaactaatgccccagattatcatttggattattttgaactgaattaattttcttccattacctgcattgaaacaaatgaggtgggtcagagtgtgtgagactgtcgtggtcaagagtccgtgttatgggatggactcacagctggggaatgtcttttgggctaactgccactctgttgttgtcctctatcgaagttaaccagttttgcggttcagctttcattccagatggaatcatctttgacccacctatctgagtttgaatcttttccccctcttaatggtttacctgtat

SEQ ID NO: 244651 - DNA, 277 bp, Homo sapiens
ttatgatttgcattatctctagacagatttttatttccaagtgcctttttaaaaataagtttctcattcagcagacatccttttctcaaagtagagttttcttttttttccccaaaagacattttaaaatatcactctagcaacatcacaagaactctaacttaaaaaggaagaaaattcatctacaattctgctacgtcaacaaatccaactggttgtcattgtccatatttccttctagccctttttgcaataaagttttgctacaaaacttttg

SEQ ID NO: 244652 - DNA, 416 bp, Homo sapiens
atctgtagctaaggccctggcttttctccttctatttggaattcacttctgaaaaccatttagctcacgttctttcacataagctacatcagattcaacacagactaacagttgatgaaggtctgtgattaacatacacattcgttagagcggtcgttacctttctaagttataaaggagtagagtttacagcgagtgagttcacggcgcctcagcttttaggttgtgagcagttgcagtaggttacatcaccaggcagatgtttcctgctctgtcccgcatgttcaaaggaggatatttttgatgggaaagtgctgagacacatggtaaattgcgcctttctgagtctccaccgagcgaatacagagcctccaggaactatgtgaccaaataaaatggccaaaatttccattaga

SEQ ID NO: 244653 - DNA, 514 bp, Homo sapiens
cagatccattcgttctgtaccaatcctgcgctgagcacctgaaagtgctgaggcccaataatgagggcagaacacttggcttcagagagtacacagcatctggcagagaaagaaatataccacaaatggggcgtttcggaggttaaggaaaattccctctccccgcacactgggggcactgaagaaatgaagaacacgatgcatccactctgaagcagagattcagaaaaaagctaaaggagttgacttgcttgagtgtatgcccctgggaggaaggtgtgtaaggttatgtaagatggaaccaattttatcccgtgtgatgctaggaaaagaatggaaagccacaccacagaggggtctaaattgagcgcattgcggtcagtgttcagcctgagctgagaaaagaaaccaggctccccatggggaggcaggaactttctcagtgatttttgaagtccatgtaaataaataaatagctaacatttattgagcacttgttatgtgagcactcttc

SEQ ID NO: 244654 - DNA, 801 bp, Homo sapiens
gggattacaggcgtgcgccaccacacctggctaatttttgtatttttagtagagatggggtttcaccatgttggccaggctggtctcgaactcctgacctcaagtgatcagccctcctctgcttcccaaagtgccgggattacaggcttgagccaccgcgcctggccagaagataactttttattggtaagtgactgtaggataagaagatatattcatttagtttgagaggtctaggcccgcttttggaatcagcatgatttttttgtatgtgtgtgacctgtggcaggggccgcgggtcccctgtccgtggcgcttcgtcctgacctgctatggggctgtgggtggggcgccgccgcggccctggcattcacatttgggtctggagagagccgggagtctattaagttggttgtgaggtgccttcgaatgttatttttggtttacaactttcttgatgatattgtttgcagcacaatggtttttaattttcatgaagtctaatgagttttttcttctcttgttatagttttgtgtcacatctaaaaaaacattgtgaagtttaagatgacaaagatttacacttatgtgtttgtctaggagttttgttttagtgcttatgtttaggtttctgatgcatttttagttcatttttctttatgatcatttttttttcttttgtgaaacatctacatatgtgttttttatacatttcctgttaggtcttaatatttttctttttaatatgcttgatatctcttattaaaatgtcaacattaaataccaatattcctttaaaaa

SEQ ID NO: 244655 - DNA, 476 bp, Homo sapiens
ttggtcaggctggtcttaaactcccggcctcagatgatctgcccacctcaacctcccaaagtgctgggatgacaggcatgagccactgctcctggccacaaactacctattctgtgatcatctccacataaaattaaatcttgcagcaaggctaacatccccaaagcactttcctggagtcctgcggtccatcccaccctggcctctgccttcctgagaaaggaaagaccctgccaatatggctgcaaagaatttcctccccaatttcttgctgctctgaaaacaacttccacctcccacctcccgagtgctagcttctggaagttacgttgcctggacttgtctcggagtcagagatattgaggttctggcaagatttcgtcttcatttttcattctaagttaggacttggaaacccaaaagtcccagggagctgaatagaatagtaggtaaagtgtgagatgggcaagtgtaaa

SEQ ID NO: 244656 - DNA, 275 bp, Homo sapiens
caacaacatgggccccgtcacaccccacactgctggccaacgtggaggaggaggcagcccccaggacgcacctgtgggtggcgcttgcatgggtagcacagggtcagaccgcggaggcctggggagcgcacgctcagacagcggaggcctggggagcgcacgctcagactgcagaggctttgcagttttatggtttttatgttctgagttggggctttgataccaacacaatgaatttcccgatgtttcactagtactaaactggagtataaaca

SEQ ID NO: 244657 - DNA, 511 bp, Homo sapiens
cattgaaatgctgtatgtagacatgtaaaaggcataattcatctaaaaagcagtgcgcctggtcattttaaattgccttcagggaaaacaagagtattcttttttctttttcagtttagagtgctttttctcaatctcccttccacacatacacttcataggacagaggtcaatggagcagtgttgttttcatctaaggggtgaaaactttcaccttttccctaggcataaattcaccaattgctctacaaatcaaaaaactcacaccatttgagtggtttatagtgaccctctcactatttttttaaaccttcagatcactagtaataagacattttgtaccaccttttttgcctaattgaagctcacatttgagtagtatttttgttttataggttaacaatgacctctttgtgttttattgaacataaccttttttctgtgattattgagtttatcgaacctgttaaaatatgttttccttgaaaataaatgacttaaaactgagtga

SEQ ID NO: 244658 - DNA, 676 bp, Homo sapiens
gtggcattgcgcggtacacattacagcttctctcataaaagcaggtactgtattttgcatgagtttgataaccagatctggaaggatggcaaatgcagttcttttaaaaatatggcctctttgagatgaatgaccacgttttttggaatgaataacacattaagtcgtgtcttcaaatctaagaaggtctgtgttttgaagcctctggtgcttatctttcttttttaatggcagaaattattctctaacagtgtaataagtgatttttaagttgattttgaaatgttgccttttttgtgatagccttgttatggtcaaaggctattcatggattattacatttgcactgttattttttaatgggcatataagcacagaagagataggtttatatcattggcctgagtatttgtttttattgaccatttatttttggaattggacctcagagcacactgtggattttagaaaagcgtgtgtgtgtgtgatgttataattataggagacctgcagattctatctaggacgtaatgcctgcatagatgaagataaggtcattagtctcagaccataattatgttcctggaaaattctaagtgacactgtcttcctggctggtattacagtttgcatttttttcattttttggattccagagagtaaacaccatgtttta

SEQ ID NO: 244659 - DNA, 373 bp, Homo sapiens
attttttcattgaaatattttatttacttttaaaccagtagtaaacattttttttcctgtgaccatcactgcactggtcacctcatttattaaggaataaaccaaactacatattatcaacatattatcaatgaagaaatttgttttagggttccggtagaagaaactgacagtttattttagtagccgttttagtgaaatttgactaacacacacaaaaatctatcctgttaaaatagttttgttctagaagcatgatactcataaatagttgttaaatacttatttgtgtttctcagccagatgtcactgtcataaggatgtattggattgcaatacctaataaagttgatttatacataccctgataaaa

SEQ ID NO: 244660 - DNA, 784 bp, Homo sapiens
ggttttttggatgtttggtttttgtgtggtaaaattcaccaattttaaatatacaagggatactctgtttataccaaaagtaccaagtcccaaaagatccagaaatagatgtattccaaccccttcaacccatttcttccacccattctctccctctacgtggtcagacaatgggactcattgtttttggctcaagaatccctgacctttttgtggtaagaatctactttttcatctccctgagatctcgagatcgctggggagccaggacctggcagtgaaacagatatggagaaggggagggacaggaattggtgctgccattagaagagagtcctcaagaaaagccgggactgggacacgtagtgggagccactgggttgtgtgtgggggatgcctcctgcctggggtctgtcctcccaacccacaggagtggctctggctgtcctgttctagctatttgatcttgcctgtttggatctttcctggactcactgagatggatgctcagcatctttcaaataaatgccccgtttgcttaagactagccagagtcacttgggtttttcacaatcactaaagcttcactaaaatgaccctccaggatcccagcctctccaggaatccatgactcaagaagcggggtcagggaggatggtatggagacttccagagaaggtattctaagcgtatgccaaactactgggtgggaattcctgttgtgtgggaaacctattttccaagaaagaattgacgttttttttttttcttttcttaccttctc

SEQ ID NO: 244661 - DNA, 213 bp, Homo sapiens
tcctttttgcatggctgtgtttctgcagtgattctttcattaactagctccctaaagagctgttaaaactgcatgctgcagtggttttcacagttatgagccttcttctgatctctgttaatcagtcaagtcgtcaaacgactactgaatcaattcttccttctgatatatttgacactatcactcctcctaactatgaaaaatgtgccagga

SEQ ID NO: 244662 - DNA, 397 bp, Homo sapiens
tggggggtgaaaagttataaattacatcttttcaaatggttcacttctgagcataaaaacctcaaataacctcacgtaaaatgattattaaaaattggttcacagaatcttcatctcctcaacaaaactgttttaatttgatcaacaacattcctacattcacttaacaaatatttattactgcttacaatgtgccaggccctgtgctttatcatacacagtaggataatcagcagtgaatgaaacaaagtttctacccttggatattaatgggaaagtgattttaaacaagcacgagcatataacataatgccaggtagggggaaaacaacaaacataataaagatagagccacattttagaagaaaacattccccaaaaccaggtaatcctctgc

SEQ ID NO: 244663 - DNA, 377 bp, Homo sapiens
ggcttagaatcttaacctcatttaccacaactactgaattctttcttgtagtctagaaatttaaaaacttaaattaggtactttaagaatcccatgccgagcgcagtggctcacacctgtaatcccagcactttgtgaggccgaggcgggtggatcacgaggtcaggagatcgagaccatcctgtctaacatggtgaaacctcatctccactaaaaatacaaaaattttagccgagcgtggtggtgggcgcctgtagtcccagctactcgggaggctgaggcaggagaatggcgtgaacccgggaggcggagcttgcagtgagccaagatcgcaccactgcactccagcctgggtaacagagtgagactccgtctca

SEQ ID NO: 244664 - DNA, 421 bp, Homo sapiens
ttgtaactgtcttatttaggaatagaatgagaggcaggtgtgcctgatgcagttcccagcttgatttttccctttggcttagtgatttgggggtcctgagatttatttgcctttcacattggcatgaggagaaaaaaatctattgaattgtcttgagtaggcatccctcttctggactttaatttgtgcaggaggggacactggtattggttatcccacccagccaagcttggggtataattgatttttggtctttgggtttctaaatcagtcttatgacctcattaaaaaatgaatgagggccaggtgcagtggctcatgcctgtaatcctagcactttgggaggccaagatggatggatcgtttgaggtcaggagttcaagaccagcctggccaacatggcgaaaccctgtctctactg

SEQ ID NO: 244665 - DNA, 638 bp, Homo sapiens
ttgtttccaggctggaatgcagtggcgcaatctcggatcatggcaacctccgcctcctgggttcaagcgattttcctgccccagtctcccaagtagctgggattacaggaaccggccagcactcctggctaatttttgtatttttagtagagagggggtttcaccatgttggccagtctggtctggaattcctgacctcaggtgatctgcccgcctcagtctcccaaagtgctggattacaggcgtgaaccaccgcacctggctggagccatgtttcttcattcacttagctgtcttccttaagttaatctgggagtctttaaggcaagaatcatgtactttacagtcatctttagcacagtagccaacactttgtaatactttgtaaatatttggaaaataaattagtgaagatttatgaagatcaagagtactttatctttacaattatagataaaaaacctcattccatgaagggtgtcttactttcctgaatttcatgttatgttcttcttcatgcatttttttattgcatgaatattgtttttctattacattccattccaagatttatcatgttcccatgttggaaattttttttatatgtctatctcctcaattcaactgagagattctct

SEQ ID NO: 244666 - DNA, 385 bp, Homo sapiens
gaatctgcagaagaaaagttggaaagtagctgaggttgactggcttatgtttaaggaaagaagccaactccataatgtaaaggtacaaggtgaggtagcaggtgctgttgtagaagctgcagcaagttatccagaagatctcctaagatcatcaaggaacgtggccacatgaaacaaccagtttttaatgtaggtgaaaaacagccttctattggaagaagatatcatctagaattttcatttctggagagaagtgaattcttagcttcagttcttcaaaggaaaggctgactgttggggctaatgtgtctggtgactgagttgaagccagtgctcatttattattccagtaatcctagggccttaaaaattatgctagatctat

SEQ ID NO: 244667 - DNA, 423 bp, Homo sapiens
ctcattatttatctcagtgaaaaaagtttgtttagattttttcatccttcgtgttttctctagtaaatagttatccagctaaattattcatcacatcatcagagtgcttcctggagaaaattcaaaaacatgttataacaccctcaagaaatgcatgtcaaagtctgaatgattactaaagcacaaaaatgaggcatatcaagcattttgcagtatgtgaaagcaaaataggccagtctgggaatgatctaatatcactgtcttcagataagggagatggtcactgccccaagtcttttctttttaaaataaaccagctaacacagaaactgccttttacatataagtgtagactccacagagtaagtagttacatgcgaaaactgcaaggacacagagagactaacctcaaaaatttattat

SEQ ID NO: 244668 - DNA, 101 bp, Homo sapiens
cagatgcccgaatggcggtcctgaaggtggggatgctgcaggtaaaaacctcgagacctccaatgcccttgcagggtccccagagcatcttgctggtgaac

SEQ ID NO: 244669 - DNA, 397 bp, Homo sapiens
ttatcaattttaattaaatcagttgattataattgataaatgtataacatttgatacatttaataattagctcaaatagataaatttaattataactgtcctttatgttgacttacactaacaaaagttgaatttctagaacagccttgatacaatgtaaatataatacttaaattagagtagattgaccctgtgttaagtcaaagataaaactatttgcccttagtgggcccagaggattctcccaaaagaaaatggagaacataagatgttcatggatcaaatatctcaatactgttttgtagtttttgtgtcaattctgcccaatcaatctacacatttattttggactaatgtaaatgttgattgaaaaatttacatcaaatgcaaaagggtc

SEQ ID NO: 244670 - DNA, 445 bp, Homo sapiens
gagagaagaccaaggaacacagagtgggcagacgtgactaaattacatcatgaccttagcatctgcagacatcctggagagaacactggatttccccctgaatgaggacggagtttgtgtcaattctatggaatttaagaggaaagagttgacatttagattaaattaatacaagatatacaattcttaaagaatcaagtacatattggtgtctgtcattttattggtaatttgaaagccatttttactctaacgaaggataaatattatgaaagagaaaaactctattttgatgtaagtacatgatgtagtttggctgtgtccctatccaaatctcatcttaaattgtaactccccaaattcccacacattgtgggagggaccagtgggaagtaattgaatcaaggggcgggtctttcccgtcctgttctcatgatagtgaata

SEQ ID NO: 244671 - DNA, 300 bp, Homo sapiens
agatcgacattaaaaccaacatcataacatgattttatacttagaaaaccacaaagaatctacacagtatgaaaatttatatgtgaagcaattaaggtgctagttaatacaacgtcaatgtacaaaatcaattgtatttctatatgctagcaacaaaaaagacaaaccaatttttaaaatgggtcaaaactcgaataaacattgctccaaagaaggtatacaaatggccaaaaagcacatgaaaagatgtttaacatcatgattcaataggaaaataaaaatcaaaaccacaatgaaata

SEQ ID NO: 244672 - DNA, 594 bp, Homo sapiens
aagaacatcactggaatgcatcacagaaatactaaacttgacacaaataatttccaaaattgaactctcaaattttcaccctgtattcatcaggttctagttaggaaaaaagaaaccactctaagcattaaaacagatacaaattaacagagaaatgtggttacatggcaatagaagatccaagactccaaacagggaatgggaaggaacaccaaaatgaacaacagcagtgatggggctcagagcacactaccccaaaatataccacctcgacatagtgagtattttaaatggaagagatctgaaaaatagcagaagcaggaaggtctctctgaccttgtccctcttgtctcccctgaaacaagtcataaaacctagaagaaaatttctgaccttcccctgaagcaggttgtaagaccctcatctgagacatgccctccctatacccagaggaaaggaacatccttatctctgaagacgaggggacacagaagaatctggcaaaatcaggtcctactatgtttcccccagtttactaccattagatcacactcttttaccctaccatatttctccatggctctccactcttct

SEQ ID NO: 244673 - DNA, 339 bp, Homo sapiens
  misc_feature (1)..(1): n is a, c, g, or t
  misc_feature (8)..(8): n is a, c, g, or t
  misc_feature (26)..(26): n is a, c, g, or t
ncatggtncccctgggatcaggaatnggacgagatttatgatactctttctgatgaacatcatctagttgctgttcaatgcacggattttcatgttggagttgacatattctctcttctacacagctccactttccagtggaattattctctttagcttctgcattttcatacatctctttcatttcctttatttgctgctgtgtttggcttaggttgttatgtacagtttctaaagccaataacttttttctgagagtatctcttgtcttacggaacttatcttttaaggtattgaatttaatttgtggtttagaaagttgttcagtaagaaactcat

SEQ ID NO: 244674 - DNA, 356 bp, Homo sapiens
ggagcctgaagctcctgccctgttcctctctctccagctgcctctctctggggttggctcctctcatctcctgtccacatgcctgtcccattgctctttctacactcaagccttttccctcattcacactcgctgcacatcactgtggcccaccccacctagccttgttctgacctggctgcctggagctgggctccttcatgctaagttcccatccttgcttcacctggttgtacccccgggttagtgagggctgcatggcgcgtgtgtaacatatgtaactaacctgcacattgtgcacatgtactgtaaaacttaaaggataataataataataataaatacatacggcaaaa

SEQ ID NO: 244675 - DNA, 454 bp, Homo sapiens
cactgtttctctccatggattctgaggcccacctgggtattgtgaattctttctctggccacatctgccccctgcattgtgaaccagtgttcttagctctgacgttccagaagatcccctcaaacatcacctccctggcttggcttccctgggatttgtgaggctggagagaagaaaaaggcataagcctgagaggctccaagttggaccctaccccctgccaagcctcattttccacatcttcagaggagagcgtagatttgggcactggagcctcagtatggggtgactgtcagaagccaagagggtgccggacgcagtggctcatacttgtaatcccggcattttgggtggctgacatgggaggattgcttgaggccaggagttcaagaccagactgggcaacataaaaagaccccccatctctacaaaaaatacaaaacattagccaaat

SEQ ID NO: 244676 - DNA, 410 bp, Homo sapiens
cagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgagatcaggagttcaagaccagcctggccaacatggcgaaaccccatctctactaaaaacaaaaaata

SEQ ID NO: 244677 - DNA, 207 bp, Homo sapiens
agtgaatgagttctcacaagatctggttgtttgaaagtacgtagcacttccccctttgctctctttctctcctgctgccatgtgaagatgtgcttgctttcccttgcccttctaccactctccaccaatttcctgaggcctcccagccatgccttctgtacactctgtggaactgttagtcaattaaacctcttttctttataaatt

SEQ ID NO: 244678 - DNA, 168 bp, Homo sapiens
atgagcactggctgcaaacacttccgattgtcctaataagggggctgcccttggattcagtggggagggctcagggatactgctcagcaccactgcaggacaataacacagccctcaatgtcaacagtgaccacgctgaaaaagccagccctgcaggaacctcaagtc

SEQ ID NO: 244679 - DNA, 657 bp, Homo sapiens
caggaaggaagaatcatgatgccacagtaaagggagggaagggaaggaaggggaacagaaagcagaggccaacaaatagtgttccttgctcaaactaaacagttctatactttcatttagagttaactactaataattaaaaagaaaaaagcagagaacaaatgagtttgaatacacagccttcccctggtctttggcacagcagggttaagcattcctaaagatcatatagtctaaaatggaatatcacaaagacctctaccacaatacattgaaattgattaagtgaaaggaaagaaggctgctcaatggatgtttccttatgggctatgtagctttgatcaagaggggcagagattccatatctacccaacagcagaatgcaggtaagctcaatgtccaagtgttgtgatcaggcttgggccaggatttattcaaagtctctccaaaatactccacttggagactactcaaaacaaaggatccttctattaaacaaggaaggggtatgaggagtgaaagtgcgaggtggtgagggagatcagaaacttaagctgctgcacactgcggctcacacctgtattcccagcactttgggaggcagaggcgggaggaaccctttagcctaggagttgcaaacccaaacaaacaacacag

SEQ ID NO: 244680 - DNA, 431 bp, Homo sapiens
gaaaaattatttttcagttgcacataccaatttatgccaaaatatattaaagggaattaagtaacacatgacttaatgtttgtgtagacaactaaataaaataaaatcatagaagtgatgctgtaagaaatattgggacttaaagaagtttggaggttttgcaatgatgttgaaatgtatagaacccatagtattttactaagaagattatctggattttattttatttttttgagagacaacaaaaactgttctatgatgttggcttctatttaagtcataaaacttctattgaaagcctaggactctgttctacatgttgggaccaccaagatgagtgagatttgaagcctgtcctctgggaattctgtgttataaatttcattatgacagtttgtagttactcaataaatttttcttgcattttcacc

SEQ ID NO: 244681 - DNA, 296 bp, Homo sapiens
ctatcccctcatcttgatgtcactagaactggccatagctttggttccatctgccctcagttcacaggctatgtcagaagagctccaactcttctcttatccctggccattcctcaaatcaaggcagggtggcaaattcctcacccacacttactcactgagtgctgtcaaatatgaggggtaagaatccaatcaaaaatggtctaaagattttaatagacgtttctcaaaatatgatatataaatggctaataggcacataaaaatgtgctcaacatcatcaatcatagaaatgc

SEQ ID NO: 244682 - DNA, 487 bp, Homo sapiens
cagttaagttttaacagtacctacgtttttgagatcctttgactgtaatgtaagggttctgtgtggagcaaagagcagttaagcaacatgaggaagaatcacaactggacaacctaaaggtaagttgcctagaatcacagcagtgcttaaagtagtgaatggcttcgtcagctctgaggggcagcaagcctgtttctgtccttctctgagctaagaaaattgtgctagtggcctggaatggcttgaggctggtaattgtggagaaatacctgctcttaacaaaagtgctctctctttctggcacacctttctagtacctctctgcaaattagtattggtctgtctgtatgctcttttaattataaacagaaacagttgaactcttaaacaggctgatcagtagaaccactggctagaattaacagccaaagggagtaagcaagtgttggatatcccagctaggattttagctgcgaaaaggaaaaaa

SEQ ID NO: 244683 - DNA, 414 bp, Homo sapiens
cttagtaacaatttggacaagacagcaaatgctattgtccaagttttctaaagaagaatctgaaatgaaatgacatcaagagacctatcaagacctgtatccaggaaaaggtttatatgtggaagagacttgccctgtctcaggaattagagaaagaacaaatcagtgtgaaggagaattgtcagtaaaattacaagaaaagattgagatcataattgacctttgaggataataaaatttaaagaccaaaaggatggacttcacagaaacatgaccttaggttgtttttgcagttgtagtaactggttatatgaccaacaaaatatgaagaatgggtacaaattctgatagtaatgatcagtcactttgcaaatataaagttactatttactactgtattgtacaggttcaata

SEQ ID NO: 244684 - DNA, 479 bp, Homo sapiens
acatgctttcctctggaggacaggttaaatcagcagccactgttaggtgcctggccatgttcctaccggtgggaaggactggagctggggttcaaatccagagccctcctttttcctttgctccactttagagaaatcgtggaggaggatggcatgggggaatggcgagtgtggagaagagcaaggggagcagaaagaccagtgaggaggtggaggcgggagccaaggatacgagagcagggaactggctagagaaatgtttagaggtggagccccagggacaggacgtggattagatacagcagagggaggaggagctggctgagagggcagtgatgccatgcctgaagtgaggaacgcagaaggaacaggttggagtaagacaacgagcttgggttgggacctgttgcatcacagggacatcaaggtgacaattgactcaggacggagatgtaggttggagagaggaatttgggaac

SEQ ID NO: 244685 - DNA, 372 bp, Homo sapiens
tgggagaagaggaaaagttgaccagagaagggtaagaaagtttgcatagtggagatgggtagaggagcaccatcaagtatctccagcttcagccagtgatgccttggcctttagctgctctttaaagcatagggcaaaggttgcagatacttcctaccattaactagtgtgtgaccttggacaagtgttttaacatttctctgcttcattttcctcactaagattgtccccacttatggagttaatgatccctactgtacctccctcacaggattgtagtggggctagaatgaagaaatcgatgtgaaagtgttttgatagtaaaagctctttatgatgacaggtgattgctctttgcaaccatgagtgttt

SEQ ID NO: 244686 - DNA, 1011 bp, Homo sapiens
cgaactcctgacttcaggtgatccgcctgtctcagcctcccaaattgttgacattacaggcgtgagccactgcgcctggccctgttttatttatttactttgtgattcattttcccttttgtgtgtgctgaatttttagtaataaagctgccaaagtctccaggtctttgatagtatgtaaatgaaagactatggaattttataaaacatcttttaaaatcaccctcaacaaataaaagaatccctgtgaactaatgaactaagccccaaagctgatgaattgttattggacaataaactgaaaataataaattgcctctttatgagctctggtagcattagcattacaaggcacgtttgttgaaatagtttttgttgtggttgcccaagaaatgaaaataaaagcagttgttcttgatttctccgttaatcttggaagatgcttactctgggtgtattgaatcttctcaggtttgtgttactgagaagtatttagttctcaggtgtgtgttatggcattttcttttaagtctccttatgatggtttcaattaaatgtcactgaaatatcttgaagcacacatgagtgttttagtaaacccaaactcaaggggtgctctgtgaataaaaagttccttctactctcccccttgtgagagtttaattgaactcagcaaaggattgatgaattcacttgtgagttggacattacctgaaacatgagtctagaatagagtaacactaaatttgtaaagcagcaaggtaaaaactgttataaaatacaattgcaatggaagatgagaagaattgctaagaaatgtagcctcgtatgtctattttcccctgtaatatgtattgatatagggctctggtaatcaaaataaaataatatttctagtagacttgaattggagggaggaaattttatttcaggtattgcaaagaacatctcttgaaaattttaggataaaaggtgttacattgatatgctgtggatttctcctagagaaaa

SEQ ID NO: 244687 - DNA, 349 bp, Homo sapiens
aacctgcacatgaatgtttataccagctttattcataattcataactgccaaaagttggaagcaaccaagatgtccctcaataaatgaatggataaactgtggcacatccataccatagattattattcagcaataaaaagaaatgagctatcaaaccacgcaaaggcatggaagagccttaattgaatgttactatgtgaaagaaggcaatctggagaggctacatactgtatgattccaactatgtgacattctgattaaaactatagagacagtggttgccagggactcaggggaggaagtgtgaataggttcagcacaggggatttttaggggagtgaaattatt

SEQ ID NO: 244688 - DNA, 2111 bp, Homo sapiens
  misc_feature (29)..(29): n is a, c, g, or t
  misc_feature (805)..(805): n is a, c, g, or t
  misc_feature (1005)..(1005): n is a, c, g, or t
  misc_feature (1512)..(1512): n is a, c, g, or t
tgtaccaagaaaccttgccacccagtganacagacctacacggtgacaaaaattcagccaagagacaaataattcaaaagtaatatatattttaaggacaaagacacaaaagacatcagtcatctttctttaaaattgagaacagaaaactattgaatacaataagactgggaatgaacaactactcaaaatacagagcaaaaatgtaaatggtagaattctgtagtatagccttgttaaagaagagagaaagaagggtagaaaaacaatgacagaaaacaatgagaaagagatatatctagtgaacaatagaaatggacaagctgatgcacatccaaaaataggcacagaaagaaaatataaaaagagagaaacactcacacaaagatacagcaaggaaaagacactgaatgaatttcatgaaatctaatcccatcttttggcttctctgatgttatcattaaaaaataaaattagtgctttgtgttttgtgacttcaggcattatggggtacagtattggtggtgcattctttgctagaagaataaatggaatcaagaagggacccctgatcctggaaagacactcaggcccttatctgtagtcagggtatgctagaatgtcctcaggaattcttcatgctgtctggaactaggagagggtgagcccaaactgcccaagaacctcctccctcatcgccaaaatatactcaagccaataaatttagactgaaaaatttagcagcttgaaaaataagagtatttattgcaaaatgctgcaaaaaatccacagaacttgtctagantttgaacttgtcaagctctctttttattgagagcagatcagtgaaatcattaggcagatttagtcatgcaattgcctaagagattctgagatacagacaaacaagactcgaggcacaaatcttcactctaccaataagtagatgaacagagaaaagatcacagcctaagctgcagaggtaatggctgaaaagtaaaggantagcatcccgatgacggttcctattcagaagagccaaaacggaaattcaggctaatgcaaaatgcaaaacattattggaaaggagccctgaaaagtgtttcagagtacattttgatcctgttgaggtgagctcagagcaagaagctgactccccaaagcctagaggagctgtgtgagaaacagcagccaaagagaagcaaaatcaaacagaattgaggatgactcttcaaggagaaatgatctaaaagaaggggagcatcagggggatggcagactcatggggagagggacaggtacatccccataactgtctggggtgacataaggtggacaacctttcaatttgtacaagtacctacaaagagtctttaaattgttcatattcttaggtccaacaagtctgtatttaatgttttatcctaaggaaataaataatataggcaaaacatacctatacaataaggctagataaatcatggcacatccatatacaagagttcatgctgngcacagtggctcatgcctgtaattctagcactttggcaggctaaggtgggaggattgcttgaacttaggagtttgaggttacagtgagctatgattgtgccacagcactccagcctgggtgacacagcaagaccctgtctctaaagaagaaagagaaggaggaagaagaagaggaggaggaggagaagagttactatgcgatcattaagaatattgtaaaatatttcaaagagtgtatgagcaggtatatgggcactccttgttaaagatggcaagctgaatacatatatttacctctgcctgctaggaaaaccctacaaagttacattaacaggatcacaaagggaaaagctcctaaggcttaaagaacaagagtgcagacagcagcatattagatatgtcaacaaaattttagaagcttgaaagcaatcagatgagcattcaccaacttgacacaccaaaagatgactgctgaggcatggtggcacaagcctgtagtcccagctactcaagaggctgatgtgggaaaatcacttgagcctaggagttcaagtccagcccgagcaacacagtgagacccctgactctttccaaaaaaa

SEQ ID NO: 244689 - DNA, 473 bp, Homo sapiens
tagagaatatataaactttgaactcccttaaatgatgttaaagtactgaaatatgaataataaaactctagcttaaccccaagggcatttttatttatgtgttccaatttccttttcctgattttctgacaatgttggaagcattctaccttctcgtatatcacgatttttggtaaaatcgggagaaattcacagatgaacacctctggaagtacttgaagcatggaataaaatttgggttctaagaccctagaattccagatgaccagtgcagtggctttgctctgccaccctgctagcctcctcctttaattgtctgaagcctggccatggcagaacaaaacctataaccaagaccatgttgattctgtgattctggaaaagaggtctcagcactggtcaccagcagcgggggaagagaaagggtggctgtgttgtcttcaagagggacaaggaaagagcaaaaagacaaa

SEQ ID NO: 244690 - DNA, 394 bp, Homo sapiens
attaaatattttactgttttattacttatctagtcacattacatattactcttttggaagattttgggtaaaatatagtaaaaattttgtatatattcatcatagagatatggaaatagtgggactggatgtgtggataaagacagtgacactgttctgctgcaaatagagaggggatacctgcatgagtttttagtcaatggcagcaggtgcattccagagcactggagacaagtgaaatcactctggtcacattcctgttgaggactttgtaattgaagtataaactttgaacagtggcaaaactgagaagacttgcaattcctgttacatcccataacacaacatgtcaactgttccagaacagagggcataagatagaacagtagtccag

SEQ ID NO: 244691 - DNA, 464 bp, Homo sapiens
caaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccagggaaaaga

SEQ ID NO: 244692 - DNA, 405 bp, Homo sapiens
aaaaaaacccccccgggtggggaagagggcaccgagaaaacccccctttaattatgatttaaaacgggggggcgtaaaggggttttgccaccgtttggttatatttaagaagttgacttctctaatttccttgtcatgtttatttttaaatatctttctctttaaaagttgggatactataataaatattcagcaagtattttgtgtttaaatataaaatcttgttatttggattttaatactttatatatagtatttatatatataaacataaacaaaactaaagactctatgaaagaatcaaatggattttctataactgaaaatttcaatgactaaaattaagatattaccagataggtttaacagcaaattccataaagttggtaagaaaacaagaatact

SEQ ID NO: 244693 - DNA, 729 bp, Homo sapiens
ttatgtgggtatcacagagaagaggaggctctaaatgtggttctatttttttctgacgactattttccaatcataaacacatttacatcttcattatatttaactagcttagctagctttagaaatacattagctagtcttagaaatacattctaatgctaaactaagcaataccaggataacaaaactgcatccaaaaggggggggaagggcaaaattgtttttatgaaaaattctaagttattgaggtgcttaaaagcaaaaatatacaggaacatcaccaccgccaaaataattttccataactggagcaaatgccatcttccccagctgtgttattttgcagagaaaggccaataaaaatgaatggtcctcaaaaaggagaaacagatttcccttcatgctctttccacctgcacttctgacttttcagatgttaaaataagggtcaaatttctgtcaaaatgcaagactgcgtgattatagattaaaagggttggtgaatcattgacatgaagtttcagaagtaatgcagtcctgctttggagccctatccagtggtgtctgagacctatgcacaatggctttatggagtggggagcggggctgcaggtgagctgcagggcttagaaacacacacacagtccttcatggaagacgaggttagggggttactaaacctcctctgaaagcagcttgcctggaggctagagcatgatttattacaga

SEQ ID NO: 244694 - DNA, 324 bp, Homo sapiens
cccagaaggggaggccccgcccactgggccgggagggacgcgggaccacatccaattgactttgggaccacgcccacccagccacggaggagggtgggatcacgcccacctggccatccgagggctgaccctgcgctgtcaccggccactgcccagtttcgcaggacgaaagagcaggcaagtgagaaaatggagggcgggtcctgaaaagccgagaatcaggcctccctttaaagaaagccacgtagaaacccacctgtgctactcaaagctgctcggatgttcccagccctgggattttgccccgtcagccctccatgggga

SEQ ID NO: 244695 - DNA, 344 bp, Homo sapiens
gatttgggtctaccccactaattcatctaaaaggtttgacaaatttctcttgctacatatttcaggtaactgtatttagtggcttatttaaatatagtttccctttgctgacaggttaattaaacgtggtgggttagttggtggatgagaccaaattaaacatggtggattagctgaaaagtttagcactgaccctatacatacctatcaatgctataaaaatcattatggcataataaagtaagtccaaaaaaaacgcctcaagctgccctacagtgtcttcactcccgtaggccagatgttctccaaggatttacccttggggaccctgagattcattcagg

SEQ ID NO: 244696 - DNA, 439 bp, Homo sapiens
gcaaacaattattttattacatgaaagccagtaccaagaaaagattaattcagtccagatgtaaaaatgtatgtgaattttagatttggatgatctcaacaagttttcccttttgtggatgggactgcctggatcccagatggcattcacaaattatcccttaggtagttttctgagttgagaatgagatttcttgggctttccctaaaatcattttaatattaagtcttctaaaggatagaaagttttttgcatttgtacatttttgcatttttctgttcattaatacaaacctcataaatgccctagtttggtagatgaagcatatttctttcataagtgggaaaacaggaggtattcagtttgtgtatccttatgggtaaagcatagaaattttggctctcatttttgcaatttcaactttcttcttttaaagtaa

SEQ ID NO: 244697 - DNA, 328 bp, Homo sapiens
catttataagcacacaaaaaaattgaaatcaaaatgtaaatgatcaactgcaaaacattttacaaatcatattgcaaagaattcattgccttattattacaaaagcatccactagtcaatgaacaactaaaaaataaactaaaacaaacaactaagtggcaaatgggcaaaaattaaaaagtttcactaaaagtaaatttaagtggcttaatcacactgataatacaagataagcaaaataaatattcaaaaccacgtggctttgttaaaaggccacaaagactattgggaggaagcccccagatgtcaaatgtgaaactatttgaac

SEQ ID NO: 244698 - DNA, 599 bp, Homo sapiens
gaccttctttgccatgttaacatgaatgttgctattctgtgtacacacctgggaaccactgaaaactgcaaacctcaagagcgaaagtgatcagatggcattttagatagaatgctttgaaaagactgtgaaagatggagctgaggggaaaacctggagaaaacggaaagcccttagaatttagtagtggtggccaggcgcggtggctcactcctataatcccagcactttgggaggccgttgcggatggatcacttgaggtcaggaattcgagaccagcctggccaacatggtgaaaccctgtctctactaaaaatacagaaattagccaggtgtggtgaagagggcctgtaatcccagctactcagaaggctgaggcaggagaatcgcttgaactcggggcggaggctgcaatgagccaagatccatgccactgcactccagcctgtgtgccagagtgagactctgaaaaaaaataaataagagggtaagatttattaatttgatatgcctggtacaaaatatggagaaatctatgattatatccagacttccagtttggaactgaatgaatgataattccattaactaaaatatga

SEQ ID NO: 244699 - DNA, 502 bp, Homo sapiens
catggctttgcatgttgggaatatttccattttatagacgaggaaatcgaggttcatataaagttatttgcccaaggtcacttcctaaggaagtggtggttttggacttcacctctgtcctcaagaccacattgcttcccttggggaaatcagctcttcccataccatgcattcctagccccacagaaatccactagtctgggctttctctgcgattggctgaggcagcaactggtgaggcacctgggctgtgcaggagcccttggggatcagatggtggatgtggcctgcccaaggtgcatacagtcccttccttagtgtgggtacgggaaggctgtagataggccagaggtcatctcctgcaggaagaggtacaatcagccaggcatggtggctcctagctatagtcccagttactcaggagactgatgcaggaggatcacttgagcccaggagtttaagaccagcctgggtaatgtagcaagaccctgtctctttagga

SEQ ID NO: 244700 - DNA, 454 bp, Homo sapiens
acttaatgccactgaattgtacacttgagaatggttaaaataggaaagtttatgttatgtatattttaccacagtaaaaaatataaagaaaatgaaatagggtaatgtgatggagaatgactggtgcatgtgattttggtgagcaatgtcaagaaagcctctgaggtgacatcttaactgagtttcacttactacagctgtataacaaattatcccaaaacatagtggcttaaaacaatcagttattatggtcatgcatttgtgggtcaggaatttggacagggcacagagggcatagtttgtctctgtcccatgatgtctgtctggtgctcagttggaagacttgaaggctggggttgaagtcatctataggctcactcaattacatatctggcagttgacactggctatctgctgagtccctagttttgccataggccaaaagattcacagg

SEQ ID NO: 244701 - DNA, 484 bp, Homo sapiens
gctggggtatgcaggaagagaccagggtagctaaacaaagcctggcctggcaaggattgaaagaaacacttgcaatgctgtcatcttccttttctcatctgtctgtttctgttccttcccttttgcaccaagtctttccctattgtttccccctttataccctgaaagccaaaatgcacaccatggagctccccccggcggggatcttccttctgctgtggtctctcccatatcatgctccagattccatttgtcatccacacccctacccacctgtcctttcaacattttccaaaaagacctccacctttgggcatgcgcagagagagggctgctgcccacacatgccagtttcttagtatgcccaagggtacatgggcctggtgtctccctttcttcttcactaccaagtgcaggcatgggtccccccacatgcctcctcccagtgcagaggactctgattttgtttgttttgtttcgagac

SEQ ID NO: 244702 - DNA, 664 bp, Homo sapiens
ggatttaagaggttttttactccaacagtcagggcaagggaaagagaaaaccgtgcttctcttggaatctcttccaacaagggggtttcctccagtcccctccagatgcgttgaccgcgctgggaaaccgagtccagggccaggatttgtttttccaaagccgcgcgaccccagcagggcttcagatccgagttcccagttgctcttcagtctcccccgcgttcttccaaacgctatcaggagccacgcaggttaccgcaccaccggtcatttccctgtttcttctaaaagttctccagccaaatttcagcaatttatttaaaaaggcaccaggtcaccgcgaccttcgggcggctcctcaggcctcatggggtagtttggtcaggatctgcgcgcccctcgacgtgatcagaaccgtgtgctcgaactgcgccgacctttgattggttatggagaccaccattcattgcttcctcaagactttaaattcaagggaatcctccgtgaaaaatggctctattagtgatagccatgcccccctccatgggaggaaccattgccgttgcattaatgccaaattttgggtggccctgaaaggagaatctatttcatgtccccaccaatgtggacaggattgaaagccactttttgtagagtatttggg

SEQ ID NO: 244703 - DNA, 439 bp, Homo sapiens
caggtgatattactcttctgcctgggttctgcataaaaagaaaattatggcatattgcacattgttgaacccagtatttttaaaatttgactccctgcctgtgctggagtcaaatattttgatgtctcttgtgcccattaggtaggtgctttggctctcatgtatgacatatacttaggtccacttcacaggcattatgacgaactttatattgggattcacccaataaaagatattttgcctttcatcattaggcttagtgcaataggttaaatcctgggttgcatatttgtaccaagctcatagaatctttcaacaataacttgcattgtataaactctttgttggtagagagttgcataacagggcccagcaaaaagttcagattatgactctcgcttacacaaccagttgaaaataaaagttgtcaccattccac

SEQ ID NO: 244704 - DNA, 265 bp, Homo sapiens
ctgtaacacacgtgtgacgaaattggcctgtgaggacaaggcagtgagcagagaggacagcagtccttatgagatcaagctctaaggtatcctagacacatttggagaattcacctgagctacaggatgtgaaaagttgctaaaactgctgtgagattctggctaagaaagtttcatgagaagttttacagaaaaatgtgaacggaagacagaactagatataaatttgaatggtaatctaaataaaagacatttttcattttaa

SEQ ID NO: 244705 - DNA, 488 bp, Homo sapiens
ccatctggatgtatacctgcaggtcacaggggatatgatggcttagcttgggctcagaggctggacaggtttattcaaaattatgagggattcatttaatatctgaattgttcaagataatgattggtgtgacaatgagtgaccaaatttctcaaagtaagatgaattttcctgcaaggatgaaagcttggaatatggcttctgaccaaatactgtgtctagaattggtgggttcttggtctccctgacttaaagaatgaagccgcagaccctcacagtattacagttcttaaagatggtgtgtcccgagtctgttccttcagatgttcagatgtatccacagtttcttctttctggtgggttcgtggtcttgctgacttcaggagtgaagctgcagaccttcgtgtttcacttgttgatgcccctcacagcaactgccacattgtaaatatggaatctgatgtatgtttgacttcagtcaaaaatgt

SEQ ID NO: 244706 - DNA, 442 bp, Homo sapiens
tgaatttgcaattccaacaagtttcttggtgattgtgatgctgctgctccaaggataacattttcagaaacatttctgtctaaaacattactgaacctagagttagtagatctccaatcatctatggatagatttcagggagagtataaaaaagaaaaagatggtttaaacaattgcatttatattttactaaactactatgaatgtaggcaacaaaccacagaaatattagttgtacctgactttgtcccaatataaataagacatattttcatatcatcctacaatggtttcagatatcttgaaatatggtttatgcacatcaccactctgacataatattggctatttatctgtcattagatttgattatgagttattataaaggccatttcttattatgtctcaataaaacatgttagtaacttattttaatataaaa

SEQ ID NO: 244707 - DNA, 439 bp, Homo sapiens
tctctgtttccatggttgagttttacatgttattgaaggtcaccacacagagtatcctacgtgtacaatccctatacctggcttttttccacatgtgtttcagatctcagcagggtagtgagttttaactcccaagcaattgcttcattaatgaatggatccatcagccacagtatataaaggtcctagtagattgcaaggcaccaagttggtgccaaacacaaggccgattttcatacactgcaatcagctagagggtaggcaggtggtgtgggagtggctggaggcctgatgccattcgagtattgaaaaactatcaggccaggcgcggtggctcacgcctgtaatcccagcactttgggaggcagaggcgggcagatgacctgaggtcaggagttcgagaccaacctggccaacatgatgaaactccgtctctact

SEQ ID NO: 244708 - DNA, 469 bp, Homo sapiens
taaatattaaatcctctctcagttcttttaaactgtggttagaatggttatcttataactgcacatatctttgtataaaaaagatacaaatatctcttaaatattatagaactggttgaaaatattttcttttttttttcttcttttcttttcttttttttttttttttgagatggagtctccctctgtcgcccaggatggagtgcagtggcgtggtctcggctcactgcaaccctgcaacctccgcccttccgagttcaagcaattctctgcctcagcctcccaagtagctgggattataggcacccatcaccactccctgctaatttttttgtatttttagtagaggcagggttttgccatctttgccaggctggtcttgaactcctgacctcgtgatccgcccatctcggcctcccaaactgttgggattgcaggcgtgagccaccgcacctagccaatactttca

SEQ ID NO: 244709 - DNA, 217 bp, Homo sapiens
aaaatacttagaaaaataaaaaataatacaacaataaaaatgacacaaattaaaaaatacatcataacaacaatttaaacagcatttacattgtattaggcatcgtaagtaatctgggggatttaaagtactatacaatacccgtttttcattctcatttaccatcttaagagtgacaaaattcatcagattacttttagttaatagcagctatttc

SEQ ID NO: 244710 - DNA, 518 bp, Homo sapiens
taccttcttcttcatgcctgagttctgtcttcccagtagcttcctagcctagtgaaatgggacagagtcaaaggaatcagtgagtctataacaaatgttatacatgcaggttaaaatgacttcttttgcagaggaatattttctttcaaccaacttgatctgtctacgtctgatggcctggaatccttcaggaaagtgtggtcagctggattttgtcagaacgtggatttctacgggccttctggcctctcatgtttgatgaagggaacagaagaaaatggtttcacttcttcagtgtatatttatttattcatggatacctttttcagtttttatcctgtgtttctttttttctttctttctttctttttttttttttttttgagacagagttttgctcttgtcacccaggctggagtgcagtggcacaatctctactcactgcaacgtccgcctcctggtctcaagcgattctccttcctcagcctcccaagtagctggtattacaggtgcccacc

SEQ ID NO: 244711 - DNA, 306 bp, Homo sapiens
gacccaagcaccaggccagccccaacagacccaggctctaggcctaccacagcatcaggcccatccccaggaacccaggctctaggctcacctcaacctcagactgactactgcaagcctaggttccatgccagcccttgtaccagattccaggcccaccctagcatcataacaacccacctggccaaaggctccaggcaaacccttgcagacccacacactaggtctaatcaagtgccaggccagcccccatagattcagcttctaagctaacccctacatacccaggctccaggcctactccag

SEQ ID NO: 244712 - DNA, 728 bp, Homo sapiens
acatgccctcaggcaaagaataattagccagttcttgaattatttctgctgtagttcaaagctttttttttggattactgcttttaataaatacactattttgcaaattataacaatcttgtgaaagtccaaacaccagtgactaccactggcctctaattgatgaattatatttcattagctaagcaaatagttcttttgttaagggttaatgggataatttatgaggtcctaagaagtctgttgttgcctaaattaatagaatctctggattgagaagtaactttcagtagaatatagctaaaagaaaaaaaaaagaaattttctttggtatccaagaagatcaaaaaaattaaaactttttttaaaaaataaaaagaaattaatcccaaccttgtacccaagcagaacaaaggatagcaattttcaaaaagggaactaacaggccaggtgcggtgcctcacccctgtaatcttagcactttggaaggctgaggctggtggatcatctgaggtcaggagttcaagaccagcctggccaacatggtgaaaccccatctctactaaaaatacagaaaaaattagccaggcatggtggcaggtgcctgtaatcccagactcgggaggctgaagcaggagaatcacttgaacctgggaggtggaggttgcggtgagctgagattgcaccattgcactccatcctaggcaacaagagcaaaactccatctc

SEQ ID NO: 244713 - DNA, 399 bp, Homo sapiens
tgagtgacaacagagagatgagggaggttgttttgctgaccatgcctctccccaactctaactatacccaggcactatgcccagggattcaagagctacgtctggtgggttaattaagcttacgtctttgtgtactccctggagcaaggtcaggagtgggcatgatcagccacagttttcagatgggaacatggtagagttccgaaccgtctgccaccagctgcactgcccggcccagaaggcctgaaggcaccagcatccccatcaccactgccactccacctccgcatcagttatttgccaaatgggagacatcttcccttatctgtgctgtccccagctttctacaaaggcaaacaaattaaattctgtctcttccttcccaccatcaagaccaat

SEQ ID NO: 244714 - DNA, 415 bp, Homo sapiens
aatttttttctcttctgggtcccagaggactcttgtgttggctgccccttctatacctgttaggctcatttcccaggaggctggcttccgtctgtcctcaaagagctgacttctcagaggagaatagttgttacattcatttggcacttggcacagtcagcctcaggctgctggctataaaacaagggaggagcaccctttgggagtgagacagccctgactttcaattcgggctctgacatttactcactgagggaccttgagctagtcaatttccaaggctcagttgactcatctgtaaaaattggtttaataatagccgtattgcatgggctgagtaagattgtggaaatgaacctacatgtctggctgacaagggatgacaataaatggtagcagttcttagtcttggcaa

SEQ ID NO: 244715 - DNA, 365 bp, Homo sapiens
gaacaagcttgtggctgcaggcacagcacagctcaggtcactggatagatggtccctttggatcacgtgctcatccctggcccagtcagctgtgatcagaggagcaagaccgtgagataaggcttgaaacctaaggaatttcaaagagggggccatgatgggcattcagcggcatctcaggagggggcagagtaaccagcaggtgctttgcatgctggtctggtgtgtctggaaaaggcatcccgctaaaacgtttgtcaggaaacttctcatcagcatttccagcatgcaggagcaaccaagagagccacttagataccatttgattataatgtgtttctcagagaaataaatagcccaaatgg

SEQ ID NO: 244716 - DNA, 248 bp, Homo sapiens
atcctaccctggtcccccagggcccttctctcttgtccgtttcaaaggcccttttcgttgatgtcaacgccaaggccagaccgttaacatgcactccccatcaagataaggagtcccagttcaaagcctgtcctgactaactctttccgttaagtaaaaatattaatcttggttttatttaagcaggtttttttggcaagaaatgaatgcctgtggctaaaaataaacccaaagacacacactcagaa

SEQ ID NO: 244717 - DNA, 474 bp, Homo sapiens
tgtgcaccaccacacccggctaatttttgtatttttagtagagacggggtttcatcacattggccagactgctctacaactcctgagttcaagtgatccacccatctcagcctcccaaagtgccaggattacaggcgtgagccaccatgcccggccttaatttttaaattttaaatttaattttattttagattcagggagtacttggtgcatgtttgttacctgggtatattgcattctggtggagattgggcttctagcatagccattaccgaaatggtgaacatataattggtagtttaataggtctttttgagaaggtgaatttgagtggaaatactagtgttctagcagagaggagtaactcgtgagaattatcttagtatatttaagaaacagaaagaagaaaaaacaagaatttacagtatactcacagtgatatatacttgtgtgtctgtgtgtttcctattttta

SEQ ID NO: 244718 - DNA, 148 bp, Homo sapiens
cacaactatatctctagctatgacctcttcacttatctgctatattaatacaatcaattgcttatttgatatcttcatttagatgtccagtagacatccaaaacctaatatatccaaagctaatatatttattctctacacttttaca

SEQ ID NO: 244719 - DNA, 551 bp, Homo sapiens
tgggccccttattttcctgctaaaaagcccggccccccaaaaactcctttgtgacccagagggtgtagggcccccccgcccctcctcccgtgtcccccaaaggggggcttgttccccacgcccccctttttcccgcccaacgaaaaaaattcacccccccaaaaaggccggggtccaaacccttctcttcggagagggatttcccttttaaaaaaacccctgggggggggcccagggccccaccccgtgaacccccccctttaaaacccgagccagggggcccttgaggtcccggggtttaccccaccctagccccccgggtaaacccccctccccctaagggcccaaaattacccggtttggtggcccggcccctttatcccaccccttggaggctaccaaaagtttttcagtgcattttattttaacaaagttgatgctgggttaataattgtgaaatctatttcaaggataatcataaatacaaatgcttactctatgtcagatctcatgctataaactacaaatctacactataatccatttattcc

SEQ ID NO: 244720 - DNA, 375 bp, Homo sapiens
  misc_feature (10)..(10): n is a, c, g, or t
  misc_feature (39)..(39): n is a, c, g, or t
caaggagtcnttccttcatataccaggcaacacttcaangcattttcacatgcgtttcctctgcctagactgctctttcctcaggtatctccatgtttggctactccttcatgtaattgctcaaatgtcacttttcagtgaagccttccctatcaccgtatctaaaattgcagcctaccctttccatacacacaggctcacacatgaacacgcgtgcaggcatgcacacacacacaccccatatacctccttatctcccttccctgctctacttttttcattacatctaccatattctaccatgtgatatgatttatttactttctaaaatgtctctatccactgccctcctcccttaggtagtataaactccat

SEQ ID NO: 244721 - DNA, 290 bp, Homo sapiens
catgatggttcacggctgtaatcccaacacgttgggaagccgaggcgggaggatcgtttgagtccaagagttcaagaccagcctgggcaagagggtgagaccccccatctctgcaaaaaataaaatttttaaagttttttttttggtggtagacagttgtggtcacagctatacgggaagctgaagtgggagaattgcttgagctctggggttcaagactagtgagccatgattatgccactgaactccatcctgagtcaacagagcaacaccctgtctcaaaaaaaaaa

SEQ ID NO: 244722 - DNA, 418 bp, Homo sapiens
cccagcaagaagaatgaagaacagcaggagctctgcatcccacctttctcccaatgacaacattgtgtcccctgattcttgtttactgcccacggagggcctggagtgtctgggtaaggaggaggctgtgtaggacaaagaaaatgaaggtgagtgtgtgctgagaacaagctttccccactgagccggtttgtccaggctcagccacctgccctgcaagctagtgtgcgggaatgatggccagaaaggggcaaagccccttctgttctgtgagctaacatttatccctaaaactacccccctctctcttttattgctgtcagttaatctcaatgagccatttcctcccacctcggtgacattctacaagtccccttttctgataaaagtttgagttaattaaatgtgggaagtttgt

SEQ ID NO: 244723 - DNA, 384 bp, Homo sapiens
tctgagtcctctctgccactgtgagataagacattgagatgaggtgtctgaatcctagtctgggcggaggcagaaggaagggacccaagagatggtgaagacagagagaaaggcaggaccgggagcctggagcagaaggaaaaggacacccgggagccagcctaggagaggcagagccaaagattccagggtctccatgaatagaaggtgccatcttgaggctctgagaagggattggatgcttttaaagaagcatgggagtcgggcgtggtggctcacacctataatcccagcactttgggaggctgaagcaggcagatcatgaggtcaggagtttgagaccagctgaccaacacagtgaaaccccgtctctactaaaaatag

SEQ ID NO: 244724 - DNA, 465 bp, Homo sapiens
caccaggagtctggccgtgctcctagacaacaattatactggcaaaatctgcctaatgtaactatttttgcaactctggagtctactgtaagcttgcaaattccaggggaaggtataaggtaaaagcacaattaattttaattttagctcttaaaacggtagcagctacccatcccccagttcttggagaaacttgcatgcagcctatgggctccagggtgggcaaaaaggatgttgtcttccaaatattagagatctgcatccgatcactgattgctacttctgatcacagaggtgcacacaagaaggtgggcagactttgttgttgtacctccctgaattgttacaggctccttcccatctggctgaagtgacttccagaggattcaaagagccagcaccctttttgtttcctcccttcatttttccccttttgagaatgagagattagaaactaggatatcc

SEQ ID NO: 244725 - DNA, 250 bp, Homo sapiens
aaaggcttaagaatgagaatatcaaatgtagggagaccactttatggctattatattcaatcagtcaagaagccaggagaggctaaattaaattagggtggtacattggagacatgtgagaaatatcaaggaagaatagacataagcggtgataatggaggttacatacaaagcactttactaagagggcttttaggttctgtcttgagtgactgggttgatagtagtgtaattttccaagatagagtgt

SEQ ID NO: 244726 - DNA, 398 bp, Homo sapiens
gcttctgattcttggaaccaggctcggtgacctcacgcgagtgacttcatatccgggactttctgggaattctcagcagcactttttcgccgccacctccaaccaatcggactggctcttctgtcattcgggtcacctccgctgagatgccttccctgaccacccaagttgaaggaactgctaaccttttctcttggactttgttttttatttccttcacagtatttctcccctctaaaattatcttgtctgcttctacctatattgccttccctcttgaaacctaagttccataaactgaggcacaaattctgccttgttcatctctgttctcagcactctgaacagaacctggcatgaatgaggtgctcaataaaagttacttggatgaatcggca

SEQ ID NO: 244727 - DNA, 446 bp, Homo sapiens
tcctcggcggcacgcgtggccgcaggtgtgcagggcaccgggaggggcctcgccgagaagccgcttctctcctctgtgcacgccgccgccggcgcgcaccaccggcccagtcacctctccccactcttccccctaggccgccacctccaaccaatcggactggctcttctgtcattcgggtcacctccgctgagatgccttccctgaccacccaagttgaaggaactgctaaccttttctcttggactttgttttttatttccttcacagtatttctcccctctaaaattatcttgtctgcttctacctatattgccttccctcttgaaacctaagttccataaactgaggcacaaattctgccttgttcatctctgttctcagcactctgaacagaacctggcatgaatgaggtgctcaataaaagttacttggatgaatcggca

SEQ ID NO: 244728 - DNA, 376 bp, Homo sapiens
cagccctgcccttgatgtcccgcctccctccgagaccctgcaaccgtttgcctctgaggcctgttgcctgtcagcagcatggaggtctgcactactttagagacccaggagcagcagatcatccctgtcaggacagaatccctccttatttctctcaacggtgctcccctttctttcctctccctctgagaccccttgcatcatcatttcgtgaaggttaggctttacaaaactgggaatcactgttaccaccttcttttcctgctcagcaaaagtccctgaggtaaggaaattgtaagggtctggctacttgctcggaataagaagaaggagaaaatctgaaggaccaacaaaacaatcaaaatgtgaaaaatta

SEQ ID NO: 244729 - DNA, 495 bp, Homo sapiens
taaattttcgaaggcaaatgctccctcagatacagggggtccagccaatctttctgggctactgcctgtgatgtttattatgggcttaaaaaattctacatagtttatgaagtctgaaagcttctttccgtgaaacatagtaattaaatcatttcttttgtctgttcccttgtgtgtgatgatggtatcagaaatctcagtgttacttcttccttcctggcctgaattcttggacatctctattttattgagcttgtaagtttaccaatgcccagattcaaatacatctgtgtatatcactcacattccacaaaggagctctgtcatctggattataatgaagacaccacagtgagtaaggggactatggagtcctgccaggcccaaaatgtgacatgtcagactagagcaattttctgtggagtggtgacagttaaccatagggttggagtaaatatctcaagagtgtgcactattaaaaaacccccaatattt

SEQ ID NO: 244730 - DNA, 462 bp, Homo sapiens
  misc_feature (64)..(64): n is a, c, g, or t
  misc_feature (69)..(69): n is a, c, g, or t
ctgtacccctccatccttccatccctgcaccctccatccctgtacccctccatccctccatccntgcancctcatatcctgggactcacactccttccatccctgcaccctccatccctctatccatgcacccctccatccctgtacccttccatctgcctccttcattccccctggccatgtaatgggattcacagcttctggggattaggacatggacatcttgtggcgggggcataattctgtcgacgacaccaagaaacacttggatgttaaggattcaccgaacactgttcaggctccaggtgctgggagcagcagtgaacaaagccaacagacactgccaccctcaaggagttcacgttcatgggcgagggaacagatgagaaacccggcaatgaaagtaagtagcataattgacttgaaaagtgccggggagaaagagaagatggatggagaatg

SEQ ID NO: 244731 - DNA, 528 bp, Homo sapiens
gatccacttctgtgcctttccagcttctagaggctgcctgcgttccttggctcgtggccccttcctccaccttcaagccagcagcggaggcctgagtccttctcatgccatctctctgttctctctcctgcctcctcctccacactgaaggacccctgtgatcacactggcccccccaccggatgacccaggataatccatctccctgtttgaaggtcggctgattagcaaccttcattccatctgcctccttcattccccctggccatgtaatgggattcacagcttctggggattaggacatggacatcttgtggcgggggcataattctgtcgacgacaccaagaaacacttggatgttaaggattcaccgaacactgttcaggctccaggtgctgggagcagcagtgaacaaagccaacagacactgccaccctcaaggagttcacgttcatgggcgagggaacagatgagaaacccggcaatgaaagctccaccatctcttccactaaaggcaaccaccattc

SEQ ID NO: 244732 - DNA, 362 bp, Homo sapiens
tcacagtgaaacaaattgcggactggccttgtcctgagtggccttaggaagctgcagtggcctgcagtctcctggccagtctgtagaatttggcaaagatgaggcaccttatagccttacatgttcttatttttctttccttttctcttctttattttcttttttaaggatttgaattagtatatgtaaagtgcttaacgcaggagctggcagagaaagtggatactcagtaaataacagcaattgttaattgtaaaaagcatgccatttatctggtaaaatcccccattctaagcaccctgttaagtagttggtaattcctcacttgaaagaaattaaaaagaatttttgtcagtttttta

SEQ ID NO: 244733 - DNA, 525 bp, Homo sapiens
agcagagaactgggtcctcagcccaacggcccaaaaggaagtgaaacctgccaacagccaccggatgagtttggaagtatatcttgtcccagttgaaccttgtgttgactgtagcccaactggagtaattttcaatgcagcaatagataaagaatataccagaatggagctaccacatggtcaggaggaagagactcacaaagaaagatgaaggttgcagagaggtgctatggaaatagcacatgctaaaggagtcttctaagcagcccagaggcgatgacataccagtgccagcagaggaggagaaccacgcttcagtataacaaaaacttcaatgaatcatgctcaatgtggaaaagtcgaatagacatggctgaggataaaagaaaagaacgtacacataatctcactacccagagagaagcaatgttgacatatttctcttcctcaatgcatatttatatattgttgatatttttactgtctgtgcaattttgctttaattaaacatttagattatgaaat

SEQ ID NO: 244734 - DNA, 757 bp, Homo sapiens
tggaaacctcagagcagtgcttctcaaatgttaacgtgcatacgatgaatcacgtgggcatcttgttaaaatgcagagttttgagtcgagggtctggggagggctgagattgtgcacttctaaggagatgccaggtggtgctaattctgctgcactggacaccacacttagagtggcgaggtcactaaataataggagcgaaaggatcgtgagaacaccgacatcagtgagaaggaggctggctgcagagaccatgggtcttgctccattgcccaggttggagagcagtggtgtgatctcaactcattgcaaccttcacctcccaggttcaggcaattctcctgcctcagcctcctgagtggctgggattacaggcacatgccaccacgcccagaatggagctaccacatggtcaggaggaagagactcacaaagaaagatgaaggttgcagagaggtgctatggaaatagcacatgctaaaggagtcttctaagcagcccagaggcgatgacataccagtgccagcagaggaggagaaccacgcttcagtataacaaaaacttcaatgaatcatgctcaatgtggaaaagtcgaatagacatggctgaggataaaagaaaagaacgtacacataatctcactacccagagagaagcaatgttgacatatttctcttcctcaatgcatatttatatattgttgatatttttactgtctgtgcaattttgctttaattaaacatttagattatgaaat

SEQ ID NO: 244735 - DNA, 452 bp, Homo sapiens
tggaaacctcagagcagtgcttctcaaatgttaacgtgcatacgatgaatcacgtgggcatcttgttaaaatgcagagttttgagtcgagggtctggggagggctgagattgtgcacttctaaggagatgccaggtggtgctaattctgctgcactggacaccacacttagagtggcgaggtcactaaataataggagcgaaaggatcgtgagaacaccgacatcagtgagaaggaggctggctgcagagaccatggtaagctcctccccttgtgttcaggccagacctattgacctgcttctcatgaatggaatatgacaaaagcaatgggatgtcactttcatgatgaggttgcaagaggttgtgatttctactttgctaggaatctctcttgctgctgctttctcctctctattgacttcttggcttgtgtgctttgatgctgaaacca

SEQ ID NO: 244736 - DNA, 181 bp, Homo sapiens
atggcccccatttctgctggctgtcagctcctcaacctgcagccctctccaaatgagagctcaaacaacaaggcagcttgcttcttcaaatccaccaagggatagtcttcttaagacactgcagactcactgtgtaaaaattgtaaaaacacaaggtaatataatcatgtgcattccatca

SEQ ID NO: 244737 - DNA, 402 bp, Homo sapiens
cataacagatctcctgtctctgatctgaagatctacagatctctgattggtaaactttagttgcatgaactcacttgtgatgcttgataaatacagattccttggccccacccactctagagattctgatccagaatctcttttctgagatagagtttaggtgtctgcatttttaacagacatacctagtgttgatacagtttttttgaggaccacagtttgagaaatactagtctaagggaaaggagagcaataattgttggatcacttgcagaacttttaaaggtaggtgcctcggcccacccctgaagattctgatttggtgtatttgggctgagctgattctgatgcttactccttcttaagtgttaataatagtttaaggattgtgtgaaaaaatta

SEQ ID NO: 244738 - DNA, 385 bp, Homo sapiens
atgctgtttcacgtgtatttgtatctgcagctgacaggtatcctgaacatcttctctaacacgtattgatgtctacttataacctactttagtgctgtgtgaatggatctaatataccaaatgtacatgataaatgttttatctctgattctcattgatcagttttgaaatgatcaaatggtgtatctcagtaagacactaattcacattgatcaaattctaaatgatcaagttgacttggtttctgctgaacacaaattgtattaaaacaacattacttgaacatgctgccttctctaatgcaggagttatgttaccagcagttacattataactagagttattgtattataaagatgtctccttcataatgaaaagtttacac

SEQ ID NO: 244739 - DNA, 372 bp, Homo sapiens
gacaatataagaagtataaactgttgttccagtatctgttctcatatgcctctcaaaagtaaacatctcaccaggcttgagtgcgtttctcctgttgaagataacttttcatagcttcatacctcaaacacaagccagccactcccactgacactcattccaatgatggaagaaaagccagctgtgttggacttgaggggtggtgtattaatctctaacatagtgcttttctaatgaacgatgaaggataattttgactggactgagtttcacaatatattatacactgacttcagaacctaactctcccccccacacccccgccaagaagaagcctgggcaacaagagcgaaactccgttgcaaaaaaaaa

SEQ ID NO: 244740 - DNA, 235 bp, Homo sapiens
ccgtgcatgcattccatatgcaccaagacccttttaatctcctggtctgtcactctgaggagtgcagtgagcccaaaagtggagatttgatttctccatcctaatggatgctgggtggtcttccagccaagccaatgttgtaagccccttaagggcaagaaatgtgtcttgaattattctggtgttcctctgagtgtcaaactcagtgctcagcttaataaatatgtcatgactc

SEQ ID NO: 244741 - DNA, 117 bp, Homo sapiens
tcatacattcattcaacagatggtgtttgagtgtctcctatgaggcaggcattattttaggttccagggatacagtggtcaacaaaacagacaaaaaaataagtaaaataaaaatta

SEQ ID NO: 244742 - DNA, 518 bp, Homo sapiens
gtcagggtagcattggtcaaggtccttggaggcctgcctccctttttgtgctggtggggcacatggagtgccctgggaaggataatgctgcacgccctttccccgagtgcctgcagcaatgtagtgtgaggatgctgggcctttggggttccttaacacttcaggctggtcagagaggcatgtggcactttcaaggctccaggggcacgatttgggtaaaaggctttgtgatgctgccacataagtactgatgttgcactccatggaggcagtgtgatacagtgatgaagggtccaggggctctggatgggcatctttcctatgccacctattagtcccatgtccttggacaggctagttaactatcctctgcctcattttccacgtctttgaaatggggctaatgcatcctatttctgggtgttgtgagggctgggtgtgacgttgcctgtaaagcacttacccccataccctgcacttggaaaaggaaggtcatggctgcattatagccatcatca

SEQ ID NO: 244743 - DNA, 522 bp, Homo sapiens
ttatcccttttctccttttcattaaggctgttacatatatacaatccacaggtagaaaccactcttaggggcctccataagcaggcagtagtagaaatagttactgtaaatccttataagcaaaaaataatattttattacggatgattatttaggaatggcttcactattgtctcaaaaagcagaatgataaagcaagtttccttgacagaaccatcacaaaattatatacagtatttcactggttccctctgagctgtggaggaatcagccagagtagagaggtaggtggtcctggttcaagaaaacctgagtaagttttagagcagcactaactcttagaggaggttaagtttgaaaattcggttgaattctaaagataaagttatcccttccgttctgtagctgttttaatgtaaacaacaacttccaagatggctggaccctgccctgggtttgctcgaagactacttttcctgtctagggccatgattaaacagacattttaattgctgtcaaaaa

SEQ ID NO: 244744 - DNA, 452 bp, Homo sapiens
tgagcatctgctgtgtgccaggcattggagcctgggtggcccaccagcagtttccagattgtggaattcacaggccggcaacatttttcaaaaagttttccaagaggaagtcacagaaatgggcgtcacaccatcaaggacacgacgaaaccaagtaggacgtcatggttccagagcaaaggacaatcctgggcatcatggacatgagctgcctctgcactccactgcactgcactccaggctgggtgacagaacaagaccccgtttaaaacaaacaaacaaaaaaaacaccacactgagaaactacttcacaccctttaagatggctgggatggctacaatcaagaagacagacaataacaaatattggcaaggacatggagaaactggagtcctctcacgcaatgatggtgggaatataaaatggtacagttgcttcagaaaacaggttg

SEQ ID NO: 244745 - DNA, 404 bp, Homo sapiens
atccggccccagatggtctcttggacacagaagcccagtcccccatgttccccagcccatctttgcacttcagtggctctccttcacaaacacggcaaaagagctccaagaacacagggcacacaaggcacacacccagttgccacgatgtcagaatctcagttatgtggagcccagggagacaagctctggggtctgctttcattattgcctgtctgactgcacaactgcttctcatcattgtttttatagctgtaattctcctcctgtatcagtttccctgtgaaccaattatatatatataaaaaaatggtatctcagagattctagtgccagtgatggaatgttgaagccactaagagactgaaattctgacattttcccatttccattccttgcaatca

SEQ ID NO: 244746 - DNA, 612 bp, Homo sapiens
tgctattgagttatataagctgcttatatattttgggtattaagcccttattagatgtatggtttgtaaatgttttcttccattccatagattgtcttttcattttgttgattggttcctttgttatgcaggtttttagttttatgtagttttatttgtttatttttgcttttgttgcacatgcttttggtgtcacatccaaaaaatccttgccgagaaaaatgtcaaggagatttttccatatgttttcttctaggagttttatggtttcagggtacaatgtttaagccttactgtggtcttgaatttttgtctttagcttcagaaggcaaaaagctcttctggaattttgccagcttgtttttctgagtgtacagagggaaattacttcctactgatgaggaaaagcaggcagaagttgctgttacagaacaagagatggagagaaggaacttttaggtgagaggtggaaaaggtgtgttcttagctgagatggagagcatgaggtgatacagcaatacatattaactctgtacttaacacactgactacttgagccattctgactgctcaacggaattttgacacatacttgagttaggtaagcaaaga

SEQ ID NO: 244747 - DNA, 490 bp, Homo sapiens
  misc_feature (111)..(111): n is a, c, g, or t
  misc_feature (131)..(131): n is a, c, g, or t
  misc_feature (134)..(134): n is a, c, g, or t
  misc_feature (137)..(137): n is a, c, g, or t
agggtgctgggagctggcagggtccttccagacagtctcagcctctccccgccgcccccaacaggctgtcaaccaaaacgagagggggtggggagccagctcccccccccncccaaggggcccgggttttnagngtnctgtgcccgcaggcacccgtgtgacatccgcacgtccagctccgtgacctgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtac

SEQ ID NO: 244748 - DNA, 463 bp, Homo sapiens
  misc_feature (107)..(107): n is a, c, g, or t
  misc_feature (110)..(110): n is a, c, g, or t
agggtgctgggagctggcagggtccttccagacagtctcagcctctccccgccgcccccaacaggctgtcaaccaaaacgagagggggtggggagccagctcccagngtnctgtgcccgcaggcacccgtgtgacatccgcacgtccagctccgtgacctgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtac

SEQ ID NO: 244749 - DNA, 253 bp, Homo sapiens
gtttttgttaagactcttaaaactttttttttgatgtatcctaatgtttttctgctgagactctactgttaaaacatctatttaaaaatataatctatatgatatttaattaattttaataacaaatgagtgatattgatgacaaataacacagctgtaatctgtgaacttaaccttttctttcttttttatttgaaaattacctgctttttgaaacaaactaatgaaaattaaagatgtacagtttaatacc

SEQ ID NO: 244750 - DNA, 339 bp, Homo sapiens
taaaatcacataaagataactcacttctcaactggagccacggaatcgttagatgtcttggagacttttctagctacctctttgctggactcagacacaggcctgaataattaggtccaaggagctgaactggagccgctcgtggccagaggtcccttcctgggaacagcagtggcggcagcgctgcgctgagcctggcaatttgttcaagagcaggggatgctcaggctgcgctcgcccccttcttatgaacggtttgctttgcgtcttctctgtgccaagggctgccaggcaccagatgcccattttaggaaatcagaaaaataaacagtgtaaata

SEQ ID NO: 244751 - DNA, 355 bp, Homo sapiens
caaaataaaaattttttaaaaagcaaccaatcactgagtatagaattatataattttaacataatggaatgcctggtacataggtagtattcaattagggttaattatttttatttccttatattatcattaccattattattatttttttagcatctcatccagttttcacttctgtaaacaacatagcgattcttcctatgatattatttaagttctcctcataatcctgattgtacttttctggattgactttatctgtattattctttaagtgaggtgtacaaatacattactcaagttcttatcatatttttcttaatgtaagcaatgaatacatttgattaagaaatta

SEQ ID NO: 244752 - DNA, 469 bp, Homo sapiens
aatattatatctctcagaaattgtaattagcacttttcttattttaagtgaagctggacatcttttcctatgtttaattaacatatgtacagtatattcttttctgtgaacttttcatattcatttcattagattgttggtaattttcttattgattcatataaactctttatagataaggaaaattcatccattgtaatatgatccaaacatttctttcacgtgtcttttgtctttgaatttgcttgtggcttttagaaacatatttagaaatagaatatacaaactataggcaccatttaaagaataatacacaaataatgtatctctgcatagtcccctatatgctaatcttaaatgatgtattaccctctccaactattatcctaaattttattaattacattttggttttctttttaagcttatgttcatatatccttaaataaaatattgtttaattttgtct

SEQ ID NO: 244753 - DNA, 415 bp, Homo sapiens
ggggtggttttaaaaatatttacatataaatagtaaaatatttgtatcttactgttttaccatttaactattttgaatataaatgttctcaaaactattttttggctattggtaaatagcctatagagaataatgcagttgccaggtgtagtggctcatgcctgtaatcccagggaggctgaggcgcggcggatcacctgaggtcaggagttcgagaccagcctggccaacacggtgaaaccctgtctctcctaaaaattacaaaattagctgggtgtggtggcgggtgcctgtaatcccagctgcttgggagggtgaggcacgagaatcacttgaacctgggaggtgaaagttgcagtgagctgagatcatgccactcccctccagcctgggtgacagagcaagactccatctc

SEQ ID NO: 244754 - DNA, 432 bp, Homo sapiens
ggcacaaagcggggaacaagagacaccagagaatgagtattgagacactacctatttggtattatgccaattacatggatgataaaatggtctgaacgccaaacccctatgacgtgcaatgcccatgtaaccaacctccagatgtaccccttgaaactaaaataaaagttttaaaggaaaaaaaaggaacctggaagttggtccatcctatgcaatggacactttcaggtgcaaagtttgagaagatgaggatgagagacgttgtccagccctagctgatatatggaaaccttcctttctacttgctatggttgctttgcaacccagtggctagtaaagggctgttttttaaattaccaaaatgctcaaatattagtaactaattgtccaacttggaaaaagcaagtcttctgcagttggaaaaaaaagaaa

SEQ ID NO: 244755 - DNA, 694 bp, Homo sapiens
actacattttaaaaagaggattctattcatttttaaaacattaatttaaattttaaagtacttcctatatacatatatatactttaacaaattacattatttgctttaaaaaaaaatcaagaattctatgactagcaaatacttacatgattccctacctgtttaggagattccaaaagactctgaaggtcaataaatattttcaagacaacttaacttgaaaaggtatctgaatgtatatttgtcttttatgtgcagtgaactgtaagactgatagttagaagcactttgctatcttctcaacattctcatagaaatattttatttacagattcactttcttaaaatttattttagcacatgatttaaaaaatatttacctataaacacttgagacctccaaatgtttgaaaactaacttttgacaggcatggtggctcacacctgtaatcccagcattttgggagaccaaggctggtggatcacttgaggtggagaccagcctggccaagagtgaaaccccgactctactaaaaatacaaaaattagccgggtatggtggtgtgcacctgtaatcccagctacttgggaggctaaggcaggagaattgcttgaactcgggaggtggagggtgcagtgagccgagattgcaacactgcactccagcctgggagacagagctagactccatctc

SEQ ID NO: 244756 - DNA, 557 bp, Homo sapiens
ctcccttggagacaaagaatggtcaaaaaccacttgctttgataaatcttgctgaagcaacaaaaatagctgtgtcatgcagagatgatagaattacctttcaccattacatcagaacaaaaacctccaagaaaggcaaaatttctcattctcccatctaactacattcacaggcaaatccctaaaattcaagccaaattacatacaagtattttacatagctttttgcatttagaacatctgttaattcaaaatgtggttgatgaattaacggcctacaacgttcctttaaaaccaaaccacctaaaaatcaatttattcttacatttaatagttttttttttttttttttgagacagagtctcgctctatcacccaggctggagtgcagtggcgctatctcggctcactgcaagctccgcctcccgggttcacaccattctcttgcctcagcctcccgagtagctgggattacaggcgcccaccaccacgcccagctaattttttgtatttttagcagagacagggtttcacagtgttagccaggatggtctcga

SEQ ID NO: 244757 - DNA, 649 bp, Homo sapiens
tttttttttggtagagatagggtctcaccatgttgctgaagttggtctcaaactccttggctcaagcaattctcctgcctcagcctcccaaagtcttgggattacaggtgtgagccaccacaccgagcctagagcaattattttaaaacaacagtagcatcattcagaaaggccacatctggagcggttaagagcacagacttctggagcagagtgtctgggtttcaatctcaccaccgcttactaggtatatgaccttcagcaagagacagtctctactcataggattgttgtgaggactaaattggctaaggcatgacatgtacttgggacgaagcttggcacataggaaatgttcagtaggcattgtttaacagtgtaatgatatttattgaatacttatgtcatagaaactactgggtacttacatatcaatcctcacaacaatctttggaaataggtactattgatatctgtgctttgcaggagagcaagtaggcacagagcttaaacagcatggtcatgtgcagataatactggttttgcctcttatatactagagttgatagtggttatacttctggcaggccaaaaaatggcccccaaaagtattcacactgaatccctggaagctgtgaatgctatcttt

SEQ ID NO: 244758 - DNA, 267 bp, Homo sapiens
cagaaaagtgatcataaattttcagtagaatttctctttcctggaactaaaatatttgcaataggaaatatattatataagtattagatactatcagttaaattagctttgaagaaaaaaattgctaaaacttgggaaatatttgggaactaagaggcacataatataatttgtaattttaaataaatacaaatgtctctttttagaattatgtaggcttgtatttccatatacggaaaccagaaattgggttaagcgtagtttccc

SEQ ID NO: 244759 - DNA, 374 bp, Homo sapiens
gggttctgaaagcgactgtaaatgtgttgtctccgagtgggcacttgtttgtaagtatttattttccggagcccactcaggagcagagagaagctataggctgttagagacaacggaacaatgagtcaaaacaacgcctccccacttttacactaatgcatgggggaaatccccagaacactagtgtttgattatgaatggagcctgctttggggttggtgtccacaggctagcaaagaagatctggagaccatggtttggtcaaagcattttcactggtgcttagtgctgtttttaaaaaatattcccacagagactgaatgactgtttaattcccacccagtaagtatttcagaaatgatttctgcaacaaa

SEQ ID NO: 244760 - DNA, 441 bp, Homo sapiens
atctaatgtgtatttcattctattgcgttaaaaaattacattaaaataaacaggaagcattatactatccagtgctgttgtacagtgtgaaatgcttcagtatctctaaatactgtatttctctttctgcgggaaggttggaattgtatgaaacagggtgaagttgattaggtggaattttgttttgttgttgttgctggttagcttatatggctctttgaaggacaggagtcccttggtgtctgtggggaattggttctagggccccctgcagatactgaaatccaaggatgctcatgtttcttatataaaatggtgtagtatttgcatgtaacctaagcagagcctcctgttatctctagattacttataattcctaatacagtgtaagtgccgtgtaaatggctgttacactgtattgtttagggaatgatgacaaaa

SEQ ID NO: 244761 - DNA, 311 bp, Homo sapiens
tgtaagacctttttgattggtagtgttggttctgttgtctacacggaggccagatttctttatccagggagccagaaaaacaagtgcatttccttccttcagtaaacaggtcacttcctcatcactagttgaattagcccctttgttttctccttattagggggaaggaacactttatttcttcctcatttcttccagttgtctggtgcctggccacttcataattgtattttgagagaatagatattaattttcttcaacaaaaggcggagttccttgatgacacaacataattcaatttccgttctctc

SEQ ID NO: 244762 - DNA, 466 bp, Homo sapiens
aatatagagaatcaattaattaaaaaatcattcatttcaacttgcaagagggatgactacacatgttggtaataatcaagtttccagcctatttcccccaaaatgcacacttccttgaggtatataaagtttttacaatagaatctcatctactctaacctaaagttggaagttgtccccctagctagtgatgaacacttggtaaactttggagaaaaagttggaaggcgaatgtcccactgcgtgtcttggaatagttgcttctttcttatgaagacagatgtgatagaaaccatgagagcgctgcacaaagcagctgaagctgatgggtgacattcaggtagacagcttggggtcaacagagcaaccagtgcatctacaatattgaaggacaagctggagagaacctcagatatagatcaaaatatccaggtggtaaatcaatacacatgaactgcagatcagc

SEQ ID NO: 244763 - DNA, 688 bp, Homo sapiens
cagtagcatatgcttgtctcaaagattaagccattctgcatttctttcatcactgagatttttatttaattaacgcattaattatcatgaagcttactatttggtgtctgcttatctctttttttgaggaccaagcatataaatatgcgaggaatagtgttttattattctaaataccttgccattattaagagtttttttatgattatactgtctcaatgttgaaagaaaaatttttaaagatttgcatttcaatttttttacctataggcaagactgtaccactctgggcaacaaacttaagtttcagaaatttaacttaggaacttttcaaggaaatttgagatttgtgtcaagaaacctttttattaacgattaatgtaaaatttggaatacggttcttaagttaatgtgaacctgcaaaatctaccatttttgcctccataataagtcagaccttgtacaacttaaaaatgcattctgtcccacgtttcatgctgtcccttcctcagaatagtctgggagttcagcttttataacctttggttgcccttggaaggtatttatggcttggatgggctttgttcataatcactgtgttcttgtaggataacccccctggccttcttgtgacactgagctactgataacaacttctcacgtgtacagataatccaaatccacattc

SEQ ID NO: 244764 - DNA, 447 bp, Homo sapiens
taaggaaaactacaaacatctgataaaagcaaccaaagaataactaaatggagatatagtccatgctcattgatatgaagacaatattatcaagatatcagttttttccaagttgatctacagattcaatttaatcccaatcaaaatcccagccaggggggtggatccatgatggctgattagaaacaacgatcgtctgtggcatgcatggagaggaatgaaaaggggcaaatgaattcagcaccttcaaatgagatatccaggttcttgcattaggactgactggaagaacatctcaacccacagataactaagaacagtgggcagggccaaaggaatccccaccccagccaagggaagtggtgagtgattgtgtgagcctgctgggaaaccatgcttctcccacagatctttgcaaaccacggaacaggagatcccctagtgagc

SEQ ID NO: 244765 - DNA, 449 bp, Homo sapiens
tcttctcctccctgctgattcccaggagttatggcttttcacagtttcttggctactgtccagcaatcattttacagaccttaaccctttacacacccttgtacttgaaagtactgtaactgtaaccaccaataaacctgaatggagatgttcactaaagcaaatacactggcaagaacccaccttcttccccacaggtgcatttctgcacgtaatttgagacttaaagacaattgcttctgtgaagaaactaaggaaaggcaaattagacactgtatctctactcaaattcacttagaatacccgacatcccctttccacaaaggagtcatctggagagacctaggaataatttagctttggagtcttgaagtgagcgaaatctttacatacgtgtgtgtgtatgtatatatatgtatatatttcaaatatatatatgaaattgaaac

SEQ ID NO: 244766 - DNA, 384 bp, Homo sapiens
tcaagactcctagatgaaattaattccaaggttaacaaggcgcttgcttggcatcgtgctctgtctcctaggcctttgataaattattgtttttcacatgctaactaatgaggcacaaaaatcaaaatcaatagagatatgcatgcttgtatcagttttattttggtatcattttcaataatgaaatactccaagtgcttatttcagagtattttcttttctctttatgatttatctactttggaaaattgaatattatggagatttattatggcactgcattgctattcctttgttctttggagaaaatatactcttaatctcaggaagtaattaattttattttctagagaaagtaattattgaagtgaactaaaggttctt

SEQ ID NO: 244767 - DNA, 424 bp, Homo sapiens
tcaacgttcagccagttagtctacaactctcccttagcctccttgcactgctaaggcaaggaggcttgcactgagcctaaagatcagccagaggtatgtaccttttataaggtcttttctgagcatggctatggctatcagcatatgcattacactctggattccctggtgtatgtggaagccactcgaagcccttattttaccaaataggttcttttttattcttctctttcctaaactttttagtccatctacttgtcccacctgctgtctcttttgccaggtatctgtgagtagtatatgtcatctttaagtgattttgacagacaatgcttggaaatctgctctagcctgaaggagctgacacaaaagcaagcctctctgccagtctatcaggtcaaaataaataaccacaaatatttga

SEQ ID NO: 244768 - DNA, 318 bp, Homo sapiens
tatgtaatatatattttatacctttgaatcaactgagtaaaaggatactataaaaatacctattagggaaacctcttagaaaacctgttagacagcatctgctaaagctgaatatacgcccaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacccagctttaaaatttctctc

SEQ ID NO: 244769 - DNA, 421 bp, Homo sapiens
atccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgtt

SEQ ID NO: 244770 - DNA, 688 bp, Homo sapiens
  misc_feature (211)..(211): n is a, c, g, or t
gatcttgctctgtcacccaggctggagtacaatggcgtgatcatagctcactgcagccttgaactcctaggaatcagagatcctcctacctcagccttccaagtagctgggactataggtgtacaccaccgctcccggctaaagccgggactttatttcagactcttcatttcatattgttaagggggagtcagaccttctgtatcaaggntatgcatcaagactgtggacgctggcatttgtgtaaggagaacgttttatgagatggttagccagcccttcccagcagtaagtcagcttgctgcatttgaaacttacatactggcaagtcaaaaagaaagtcttcatcattgcccatgctcaacagaggaaaggaacccatggcagacatcattaataactaaaactaaatgaaaaatattccagccttagatattctgatacactccttatttttgagggctgcagaaaaggttaacattcagcttctggaaaagaatactaaaattccttcttgatactaaatatgctcaagccactgttgaactatctaccaagatgaagcctgctggagtttcaaaaatgtcccagtgctctcaacctctgtgcgctctcttcacatcaagagtgaggtcagaagttatgtgaattacccaccccacccccccacaaaaagtgacccaggccc

SEQ ID NO: 244771 - DNA, 435 bp, Homo sapiens
actgaggcagaggctttgcagatacacagaggacatgtgaggacaggtgaaggtcatgatcattgtcagccccctcccccaactggacattcccagatctggtggacttccagccagaggagacagaaggactggatcactcaactctgccatgggtgccaggacccaatttttccctggctaactcggtcacctcctgtctgggatctccaactactacccatcccagaagtctcagctaaaacagcaattcaacggggaacttttttctgaggctccaggattgggccaggccttctccatggctctctgcccttcccctactgcagaacttagcacctgtatgtcactattggttcaaacatgtgtctttcatatgctctccacgttatctgcagcatctgctaagaataataatgaatggtaaaacctaat

SEQ ID NO: 244772 - DNA, 514 bp, Homo sapiens
tagtagagacatggttttgctaagttggccagactggtctagaactcctgacctcagtgatccacccacctcagccttccaaagcgttgggattacaggcgtgagccaccacaccaggcctggccatctactttcaacaggcatggttgaaagactccaggcagcctcttcctgtggctttgagctcaggagagtgaatgggaagagacaggattaaggacaaaagttaaccactgaccaggcttagcagttaagaattgcaacgtggcatcaggggccccgggattatatactggctatgacatgttgcatgcagtatgattcgaggcagtatttcccgtctctgagcctcagttttctccactgcaaaacaggggtagtaatatttccttccaagggctggtatgattcttaatgagacaggtcctgcaccacagcccagaggtgcttctgacacgtaaggagcaatgagctattataatattacatcttagctagcaacacaggtataagg

SEQ ID NO: 244773 - DNA, 180 bp, Homo sapiens
cataatgttatacaaccattaccactatccatttctagaacttctgatcatcccaaacaaactttgtacccattaggcaataatttgccatcttcctctccccagcccctaataatcactaatcacattctatctatggatttgttcattctagatgcctcatataaatggaatcataac

SEQ ID NO: 244774 - DNA, 378 bp, Homo sapiens
gagtatttgttcattctttcatttattcaaaaaaaattcatgtggttccctctacatataagtgctttgtggtagacactgtaggacacagaaatgaatcagacagtgatactcatcctgttctcaagaagtctgtattttagtagggttgactgtaatgtacaaaaaataagataaaatcaaaagcggtaagaattataatataagttattatgggtatgactggtattatagcatttagatataccatgtgtttcatatgtgtattatatgatgcattattactaatactcagtgtctcacagaggagataaaatataggcacacatctgtgctgacatatattatatgtgtctgcaaataaaaactgaaaaaacc

SEQ ID NO: 244775 - DNA, 594 bp, Homo sapiens
ttgtcatttccgaggatgtatcctattagaagtctagccctttattcctacaaattgaatttccactactgtaggctaacatctgaatggactcatcttactattccatgcatagtaccaggcacgttgcgtgcttttactacattttgtataatttttacgtctgtgtttgatgtcctgaaaaataccgtccacaattacttcacagctagccccagcacttggcgcccagcgggttttcctagtccctccctgccaaatcacgttgggactgagacaagaggcactgcgggtctcttacctatagttacgaagcaatggactcccttattacttcgtttcccaaatagggggtgggacacacaaccgagggagtatgaggaaaacaacttgcgggtcttcgagccacttgcgtctttctgtgggccaattacattttctttactcatattgcataaatagcagaactacatttaccacaaaggcccgacattcatggtcatggatccttgcgcatgttttctaagagcaaactgtacaaacacataaactctgaaacactgacgcacaagcgaaaacacacgcacatgtttg

SEQ ID NO: 244776 - DNA, 694 bp, Homo sapiens
agtcttgttctactataatactagaaatgtttttaaactttcgctcaaggatggagggtttcatatccttctgtattaccccttgctaaaacataagtaagcatagttatggaaaaaacacatgggcagtcattgctaagactcagtgtattgatgtcgtgtagaaaaacatgatacagagatctgtttttgtggtttatttaattgtctttgttgtttatagtatttgctctgaagtataactctataaaattttaacaaagacaaagacaatctgtcttagcccaatattagccctattccccacttgggaaaaagtattttataacacatatcaaatcagccttggagaccatagcatccaattatgcctagagtgtactagatattcgataagtgtttgttgagtcaattacttaatggacaatatataatgggttgttgtaaataaagcagagcagtgactaaaatgttgacttggtcatattgtgggagcattaaagaaggaaaacgcctgggattcaatgcccattctagggctgtctggtgctatggctctgggtaatccataaccacccggggccccagtttcttcattacttgccctgttctttggtcagactgcacagtcactccctgtacatgcagcataatttcccagttcagggtccttgtccttatggttatctaaaat

SEQ ID NO: 244777 - DNA, 389 bp, Homo sapiens
tgaccccttgtccctaaacatcaatttgaactcaaaatcctgctgaagcctagggtacacaaagtagcctgggaacacgcttcacgtcagctttccccttctgcaatccatataacatttaggaactgtctgatggagaccatgctaatgtcctagtctttacatcctggacttccataagcaatgcgattccctagttttcaagatttcaacaaacatgtaagtgctcactatatgcttgggactgagctaggcagtgggaatacaaagatgacaaggagctcatttatatccttgaaggtgagaacaaacaagatttagaaactcagtgggaaaacaaagatgttatcattgtaacttccatactgaagccattaaataaaagcaaa

SEQ ID NO: 244778 - DNA, 237 bp, Homo sapiens
acgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctg

SEQ ID NO: 244779 - DNA, 413 bp, Homo sapiens
tcgtctaataatttagactttgtatatcacaagttttgagagttaaaatagttacagatacttagcattgatgaccctgttctcaaccaggagtgattttgccacctgacgacatttgacagtgtctgaagacatttttggctgtcacatgggggaaggactgctattggtatctagtggctagagtccaggggtgctgccaaaattctacaatgcgcaggacagctgcccacaaaaaggagtccagcctaggaatccagatatttcttaaaatatcagcagggcttcagttgagaaacactgcttcaaactgagtcatcagaatctatactgattacttcttccatctaagtaagtggatactcttaattttctcaagctatgaaaagttataggctgcactgaagcttcgc

SEQ ID NO: 244780 - DNA, 524 bp, Homo sapiens
gctgtctgggagccactgattgagagagtggaggggaagagacaatggaatttaaggcttgatgtaaagaagaacccagttcaggataaaagtttgctgccaggagatgattttattcctgagccacaaatggcaattcatatttcttcaggaaatacaatgaatataacaatatccaaaagttgtcttaatgttttcaacaatttagcaaaaggtttttcagagggcactgcttctacttttgactactctttaaaggacagagctccttttacggtaaaaaatgctgtaggtgttcccattaaggtgaagcccaattgtaatctcagagtaatgggcttccctgagaaaagtgatatttttgatgttgatgctggccagaatttggaactggagtatgccagcatggtaccttcaagtcaagggaacctatctatattgagccgtcaagaaagctccttcttcactctgaccattgtacctcatggatatacagaagttgcaaatatccctgtggccagacc

SEQ ID NO: 244781 - DNA, 819 bp, Homo sapiens
ctggccatgcaggggccacgttctgcccagccccactgccgggcctttgcttgtgcctggaatgcccgcctctctctgccatcaaagtcctacccacccttcaagtcctggttcacgtggtcgcttccactcccagaaagtgttcccaggccttctctggactgttgactaaggacctagcttctccggatctcatggggtgagggctccctacactcagacagcttcttgtgtggcacttcagataatcagacaccatcccagagtccccagcaggtggctgaaccagcctctaggtcagcctcacgacccgtacatggtcaaacgccccttacccagagcgtattgctctcatagggcaggggccccatgttgggggtgcccaccacactaccactcttagcacaccaggcaagccagtccctggtaggctcatttctcccaccaaggggcaggatggtgtggtgggcaatggaataggagaaattggtttggatcctggcacatagcaggtgtccaacacacccctggctgtgggtgctaataacggaggccgtgagagctgtcgcctgagttagagagtctgctctggaagcgtgtgcctggttgacctaggagtctcattcgttcattcattcattcaacaaataattattcctgcctactagaggccaggccctgtgctagaggttgggatcaacacgtgaacagacaaaactccctgcccccatggagcttacatcctagtggaagaggcagattataataagataagcaggataaacaagacaggttggattgtgatcagctctatggaga

SEQ ID NO: 244782 - DNA, 332 bp, Homo sapiens
cactgttcacaatagccaagatttggaagcaactgaagtgtccatcagcagatgaatcgataaagaaaatgtacatatggaccacagagtagtattcagccataaaaagaacaagatcctgtcatttgcagcaacacggatgaaactggaggccattatgttaaatgaaataagcctgtcacagaaagacaaacatcacatgttctcacctgtgggagctaaaaattaaaacaattgaactcatggagatagagagtagaggatggttgctagaggctgggaaagataatgggggagtgagccagcagggaagtgaggctggctactgtgta

SEQ ID NO: 244783 - DNA, 515 bp, Homo sapiens
aaggtaggaaaataaatgttgtttaaaaagctttctatggtaactcgtcctggaaaggacgtcattacacctatgatttaagaggacagctttttatgcttccgctaatacaactcacttttggctggcacaaaatgatctcacaggaattctttcagtcatcagggcaccaaacacaggctataccgatgcaaacctcctttcgttgagggtgacacaccccatgacaaaatcctgtgccaaagagtgtgctacagtctgggacaggaatcccaaattggttactgctcatcactggttggttcctggacacctgcaggacctgtgggctctgtccccactcaccttctctgttccccagctggctgcaggcagacaggacaatctccgatgccccttctgttcacccagtccttttgctttgtcactactcctggagctttctctcaaactttcccagaatttacaggggaatctcttccataaaaaaaaataaatttggctctcagaaggga

SEQ ID NO: 244784 - DNA, 1237 bp, Homo sapiens
caccttgaagggtaaaccttctcagaactttccgtgctccctctggttcttatttctgtttttgttttttgtttttttccagaaaaaatcaaatcagactgtaggtaaaatagggtgtccagagaaggggactgttttctaaattatgaaaacaagtaacaacagagggacatctgtgtcaatatggctcagcatataaagaacccaatttttgctgtattgcttttaaactactctatagacaacatacaaatatatatttagagagctaactgaaaacagtttattagagcatttattgaaatgtcatggtggctcacacctgtaatcccagtactttgggataccaaggcagatggatcaggaattcgagaccagcctagccaacatggtgaaacaccatctctactaaaaatagaaaaattagctgggcatggtggtgcaggcctataatccagctacttgagaggctgaggcaggagaatcacttgaacccaggaggtggaggttgcagtgagccaagatcatgctattgcattgcagcctgggtgacagagcaagactctcgtctcaaaaaaaaaaaaacatttattgaaatgtaattcacataccatactatttgcgcacttaaaatttaaattattgaattttaatttaaatcaatttaaataaatttgcaaggctgatttattagctatacatctcaagagtctgtagggtatttccaaaaatgatcttatactgggacataatgtgttgaacttctaaacttcataggctatattttctaaccacaacacaacaaaatagaataactaatggttaaatttaaaatatcagctacaacaaatgagaaaatattctgaataatttgggaatcaacaaagaaataaaaccaaaaatgacattagttagaaaataacaaaaatgagaagcttatctgtcaaaacctatagaatgaagccaattatatagttaaaggtttatgttttaaatgccttaattacttttaaaagggaagaaaaaaaacatgggaaaagcaaaatgataatccagtgtggctcttggaaataaccaagaaaataggtgaagttctagccaaactagttaagatataaagacacaaaaatatacaaatttacagcagaaaatagaagtactgcacacatatgtactaaatcaaaagctttaaaatagttttaatggaatgttttaaattaaattgatgtaagaagta

SEQ ID NO: 244785 - DNA, 831 bp, Homo sapiens
agcttccagtttgcaaaccccaattccttcttcctcatcccaatgtatgtatggaacttccaaccagtatccagctcaagaaaccctggactcccatggaacaagcagtagagaaatggtgtcctctttaccacctatcaacactgtgttcatgggaacagcagctggaggcacttaaaccaccaatgtgggagggggtgctaaaactttaaaaaaaatctctactgtgcaaatatcattattcactcagacttccataagagtaaataaaaatgaatatgcagtggctgacattgttttaaagtcactggtactatggacaactccatagtgaatggagatacttgcagagcttgtcatgcacactaagagtttaaaatgtgagctcattattaatcatagtttcaaaattatcaaataaaaccagtgaagatctgaagatgcaaacatttcaactatgaagatttacatttcactttctaatttattaaacatctgtgtgcctttttatctttggtttcttttaaaaagtatatttaatgtctttacaatacctttaatttattaggatctcagaatcattgtttactatcccttatttgacaaaaagtcaaatgtgtatgttctacctccaacggaaatgtttacaaggtcaagacttaattcaattcagacaagaccaaagttgcttgacttcaattcctgtgcattagtgtgatgatttctgccacatagcagcattccgattctatgtaactgaatggagatgataagtgctttcccctctttatttaaaaaagattaaaaggaataaaagaaataatgtatgga

SEQ ID NO: 244786 - DNA, 458 bp, Homo sapiens
aggttcctccacctaccccagcctgattctcagacccagcctacgttcggcctttttctgaaagacaatttcctgagttagttctgctgttgggctcctccacatccaggctccgaaattttctcttgcctcagcctccatgaaacggagatttcgcttcctcccgttcccccttctctctccctctctctcgcccggccagaaagacggctcccttattattcgttcggattattattgtggatttgagttcgaggtgggtttttcttccacaccagactcctggaaaatccgatcgcctgtctcctctcggcctctccttgcctccctttccgcccctcgcctaatctcgcaggcaggagcccgcagtgcctcgcgcaggacgcccggccgggcctcgggctcccggcgccgctcgccccgcgcccgaccgccgtgttccggccttcgcggccgct

SEQ ID NO: 244787 - DNA, 272 bp, Homo sapiens
gagacagggtctcactctgtcactcagtctggagtgcagtggcacaatgtcggctcactgcgacctttgccccccaggctaaagcgattctcatgcctcagccttccaagtagctgggattacaggcgtgtaccaccatgcctggctaattacttgtaatagtattttaacatgtttttgatgacaaagaattgacactttaaaaatcaaagttaaatgaagtgttaaactttaatttttaagtgggcatttctatattcttttctagggtt

SEQ ID NO: 244788 - DNA, 464 bp, Homo sapiens
tggcacatgtatacatatgtaacaaacctgcacgttgtgcacatgtaccctagaaattaaagtataataaaaaaataaaaaaataaaaagaagaaaatgtctctcaaaactgaagggtaaataaagacaaaatacatgaatacactttaaaaaagttaaaatttcaagttacttttatttcatatgtaattgtagaatgcatgcactgaaagggtaaggaatttggtttgttactagaaatgtagactacgatatgtttgacttctgagcattttgaatatgatgtttatttcagctagtttattactgttttgtaaagttgagttagtgattcacatgacctaatcttatgaagtgtcccttttaccctgtgactttgactagcttgctttcatttatttatttatttatttatttatttatttatttatttatttatttattttgagacggggtctcgctct

SEQ ID NO: 244789 - DNA, 480 bp, Homo sapiens
tattgagactaatgaatataatagttgagtaatttaaatgtttatttttaatggaaggatttttactaaaaagaagctaattgacatggaaatgtcagtgaaattccttacctacaaggaaagtaaacattttgtatctaagtaaactataatgtgcacattttaagtataaagaaatctgatatttgaaagaaaaaaaagaaacaatttgctgaaatcacaaggaccattaaacaatagttttgcctttaaagttaagtttacaagataaaagaggcaagtattgaaactttgctttaatgaactgataccactaagtctgcagatgaagaaactttgacagattccctaaactgcaggaaaattatcagcaatgatgtatatgtcctttctaaatgtgagaacacagtttactaagtatcctaattaaagaattcttgtgttcttttactcaataacacattaaaaaggggttaaaaa

SEQ ID NO: 244790 - DNA, 512 bp, Homo sapiens
aatgatttcattaaatattaatttatgagttacttggaagctgaaagctatctatacatgagtatgcagaatatcaaattggttgcaaatccaaactctatcagatgtactgtaaggtatcagatgcctattagatgttaagaccagctacaatgctcatagcatatcagttggtgatgcctttaattattttaaaggaaataatcagtttccctactgcctactcttctgagcactggaagaaaaaaagcaaagttaacaaaatgagcctgtgtgcttcagaatttggacttttgtcaattaaaaggagaaataagtattacacataaaacagcactacttagtttctaaactggtgattatgtccaagaattctctattttaaaaaaatctaatgtccaaaaagatgaacttagctcttggtagttaagcatgctgcaaggaggccttctctaactcttgtcaatgtcattttttcctacccccaaattccctgccctgtgtgaagaaaa

SEQ ID NO: 244791 - DNA, 177 bp, Homo sapiens
tcaagcttctaacgatgtacggggacatgttttcactctgttcttagtcccaggagccacaggtaatcgagaatgtttgtgaactctatccacatcccctcccccacctgccaaataacctgttcaaaacaaagaaggcatagaatataaatgaatttcaaaagttaaaaaatggga

SEQ ID NO: 244792 - DNA, 554 bp, Homo sapiens
ggaattacactattagcttaaggggcaacatcataagggtcaatgttgtgatttctaagaccctcatttttagacaagcatgtttctaatcataaaagctctaatttcctcaggagagtctctgtctgtactagtttctaaaacagctaagtgggacccagattttcttgaacaaaatctaggtaaatatgacttacaaaagaaaaggttgtgtacactacaaacagggtaaatagttctcttggtggttggagtggggaaatcaatatttttggaaccaagagtccaaattacagaatcagagttggagaagacctgggccaacctcttcattttacagatgagagtgctaacaagcagagacatgaagacagttgtcaaagggcataacgcttaagttaccaggaaagccaggactagaacttaggtctcctagttctcagaccagtgttctttatgcttaacgggggaggataaagctcagaacagtaaatactattttaaacattagaggacaggaaactctgtgttggtaggagcataactggcacagg

SEQ ID NO: 244793 - DNA, 345 bp, Homo sapiens
agcactttatcttcttggtctccattccctgaattctctctgattttatgcccagcttccaatggaacctttagaagtttgtcagggagtgaaaccctcagcctccttacttgtctctcacttggtagtgactccagtgcccacacacatcttcgattccagcctttaagtgatccatcagctgccaaacaaacacaagaaaatgattgctggagaaacgcgaactctgaaagacacacaggacaactaagacactttaaaaaacaaaggagcctttaattttctggagcctatctgactttctatcactgtgttcatgtaataaaatatttggtgcctttcata

SEQ ID NO: 244794 - DNA, 511 bp, Homo sapiens
tgctatttactgtctagaataatatatgcttcattctttcatttgtatttccagaagatattttcttcatcttatatttctagaaaccattgaaaccctattcattcttaaagactaagtaattttttagtgttctactgtatgccaagcactgttgtactcttgtgggccctggaattatatcagaaaaaaacaggcagaatttgcctcctcatggattctgatctctctactggtcctcagtgacagttgaatatgtacatcagatagttgtttaccccatctcctactacattataactttcacaagggttggaaatcttaagtccgttttctatctccttagtgcttggtacctagttctgccccaaaaaacttaattccctaggacactaaccatgtcgaataaagtcactcttgggaggtctacaacagcaccgcccagtagcagtataatataaaccacatatgtaaatttaaattttttagtcttcttattaaaaactgtaaa

SEQ ID NO: 244795 - DNA, 642 bp, Homo sapiens
ctcttctatataagggaagagaacaccaccacttctgccttccttataaaatgataaatacaaacaaaataatatgaatacatttaacatgttttataaatgctgttatgattggtgtaatcttcctttaaacatttttagagagttttaatattataccatagagtttgaacttaaggcattttaagctgaaaattacatagaaaaatcactctggcagccatcagggcaaggttggaaactaattagaagactactgcattggtccagaaaaaataaaatgagagcgaagaaaaaggaaggagtaatagatattagagtaggatttcagcaagatatgttaatgagtttgaattggtagcacttgataaccttttggatgaagagaatgataaaaaggtaattcccaggtaccagcttaattatccatttactaagactgagagtgtagaataaagattgcatttgggagcaatttttaagtttcaggtgactgtaggacatccaagtggacctacgcaaggaggatactatacactggagtctaaactcaatagaaggccgggcgcggtggctcacacctgtaatcccaacacaataggaggccaaggcaggcagatcatttgaggtcaggagttcaag

SEQ ID NO: 244796 - DNA, 442 bp, Homo sapiens
gataaagtaatgatctgtgtctcagtcagctcaggctgccataacaaaatacctgggcagctggtattttgttaaggcaaaatatcatagactggttggctccaacagcagacatttctttctttcttttttttgagacagagtctcaatctgtcgtccaggctggtgtacagtggcatgatcacagctcactgcaacccctgcctcctggattcaagtgagtctcctgccacagcctcccaagtagctgggattacaagtacacgccaccagcctggccaatatggtgaaacccgtctctactaaaaatacaaaaattatccaggtgtggtggcaggcacctgtaatcccagctgctcgggaggctgaggcaggagaattgcttgaactcagaaggtggaggttgcagtgagccaacatcacaccactgcactccagcctg

SEQ ID NO: 244797 - DNA, 424 bp, Homo sapiens
ggacaagtaaagcacaagcaaccaaaaacatttttttaatcaggcttcatcaaaatttaaaactttttgtaactcataggaaactatcaagaaagtgaataggcaactcacaaaataggagaaaatatttgcaaatcatatatttaataaaggtctaacatgcaatggtcagttcaacagatgttgaaaaaaatatttgccaatatttaacatccctttatgataaaaacaacaaactgggtaaaaaagaaacttacaccaaaacaataaaagctatatatgacaaacccacagctaacaccatatcgaatgagaaaagttaaaagcctttcctctggcccagcactttgagaggccaagacaggaagatggtttgagctcaggaattttaaaccagcctaaacaacatggtgaaaccccatct

SEQ ID NO: 244798 - DNA, 376 bp, Homo sapiens
gaaggacacccagatcctggtgagcagaacactggcaaacaacctctgcgacagtgtctggtggataaagcatttggagcacctgcttatctggttcagcagcctgagccacgcaactcttcctgtgggacagtgggaccctctctgctctaagcccaggcaggtcttcaggcatttggagcacaagcttacttgggtcagtagcccgagctgctccatccttcccgtgcagagatcctcatatagggggactctctctgctccatgcccagacagatctccaggtattcagaacacctgcttgcccggttcagcagttcgagtcaccctaccccttttatgcagagatcttggttcagggggagcccactatact

SEQ ID NO: 244799 - DNA, 439 bp, Homo sapiens
ttggctacacattggagtcatttgggaagctagaaaaaaaaaatgcccaggacctgggcaagacggctgaataagaacagctctggtctgcagttcctagcaagatcaacgcagaagggaagctggcagcctgggctcttggagattgtatctggtgccggagaggactggctcccacactcagtgagggaggaattttactgacccagcatccagatgaactttggtgaggagaggaggtgaggaagtcaatgagccttgctttttcacttgcaattacggcatttcctttggaaatggacataagagcctggtggttgatgatggaagagatgaaactgtgaagagaccgaagaagctaatctatcaatagttaagattccatttctaaaagatcttactttgagtctacctatgcctgggatgtcaagaggtatga

SEQ ID NO: 244800 - DNA, 231 bp, Homo sapiens
ttctgcatacaacagatagttttttatgttggccagacactgagaaacctcactttcagttggtgttaaggtacgttgtttggatagggtttacttcaatcagggtgtatttgaatttgagatgaaaaacataaaaataaaagctaattctgtgaatagaacagaaatccactggagaatatttatgtgatacaaaattctttagtcacgttcctccttattatttcaagt

SEQ ID NO: 244801 - DNA, 487 bp, Homo sapiens
tggggaagaccacccggcaaagcactggcagggctcgaagtgggaaggcaaggtcagactggattgagagttgcaactgtgattgaaggcggtctttcaaagcaggctcttggtgagggttgggtaagaatcgcgatattgcagcgcagagttggtggaaacagcaagcaagggtttcgaggacttcaaagactcctaggggcaaacttctactgcttcctactgaagagtggatgggccttcagggaagttcctggcaggaacagtcctcccatttgtctgggcggatggtccggaagagcaaagacatgctaatgagacagaggaatagcaagtccccttcaagccgacaggaaggggcctcagttctcagcgccagcctgagtgtgggggctgcttggctcggcctgtttccacgctagggacgttctacgtgttttcttcttcatggctttttgttttctaataaaagatgtttctattcata

SEQ ID NO: 244802 - DNA, 454 bp, Homo sapiens
agacttaaagctatagaagtactagaagaaaacataggggaagtgcttcagaacattagtctaaagaaagattttatgactaaaatttcaaaagcataggcaacaaaaacaaaaatagacaaatgagattacattaaactcaaaaacttcttcacagagggaacaactgacatagtgaagagacagcctgttaagttgaaaaagacatttgcaactatctatctataataataagggattaacatccagaatatacaaggaactcaaacaacaaaaaattaaataatcccattaaaaagtgagcaaaggatctgaatacctatttctcaaaagatgtcatagaaatggccaaaagactataggatataaaagctcaacattactaatcagggaaatgcaaatcaaaataacagtaagatagcattttactctagttagaatggctattatcaaa

SEQ ID NO: 244803 - DNA, 375 bp, Homo sapiens
tgtccccattggcacggatcacacccccatcttttaatccctccctccgcccgtgtcccctcatttgctagacttgtcctcttccaggcctagtgctcggcgcttctgagaggaataggctcacagaatagcggcgctgccgagacccctggggtacgcgaggcagggggattccgcccctttggaaggtggccgagaccctcagccactaaaggacttcgtcgagacaggagagcccgcagagatcgttctcttctggataaccagattattccacaatcaaactttaacccttttgggggcgctgttccctttaacaaactctggaaaatgtacacaatcttgtgcacaacacgagagttatggacctgggtt

SEQ ID NO: 244804 - DNA, 497 bp, Homo sapiens
aaatgctaaagattgataggcatatttcccttggagaagactgtagaaacaatattgtctttaaatgttttaggaataggcatatagaataccatatgtaatatttttgggttggtccaaagggtagagttagagatttagattttgagttacttttaaaatttttctggagttattagtgaacttgatgttccagaagatactcacatgggttaggcatgtggctcacgcctgtaatcccagcactttggaaggccgaggtgggcagatcacctgaggtcaggagttcaagaccagcctgtctaacatggcaaaaccctgtctcttctaaaaatacaaaaattagccgggtgtggtggtgcactcctataatcccagctacttgggaggctgaggcaggagaatcagttaaacctgggaggcggatgttgcagtgtgccaagattgcatcactgcactccagcctgagtgacacagcaagactccgtctctcaaaa

SEQ ID NO: 244805 - DNA, 299 bp, Homo sapiens
atgacatctaattcccttccaattgtagtctctccattttcctgccaattggctatactgcaaacacaaacattattgactctgtaaaaagccttaagggaaaagggccaggcgtggcagctcatgcctgtaatcccagcactctgggaggctgatcacctgaggtcaggatcacctgaggtcaggagttcgagaccagcctggccaacatggcaaaaccctgtctttactaaaaatacaaaaaaaaaaaaatagctggatgtgatggcgggcacctgtaatcccagctacttgggagg

SEQ ID NO: 244806 - DNA, 462 bp, Homo sapiens
gcaactgttcccatctccatactgatttacagcttctcctggggcagtgtcattccttttcttccatccccattattcatgtttctgtttagacccctcgctatccatgaatccttctttaatcacctaggtccacattaatctctccatacctgtattttctgtgaattactgactataccatataatttgacacaagataacttaatctcttacattgcatggtatgatactactacatttttatatcacaacatatgtagcaccagtggcagagagtattacatgagtgactaaaacatgtattgatttagagagcagtaaagtgcagcgtaaaggagtatgtgctgttttcctgtatgtaacataagactggttgaaaagaaacatctcgttcagcctttgggaagagctttcatcactacttgctccaaaattaagactttaaaaatcttcagtaaa

SEQ ID NO: 244807 - DNA, 272 bp, Homo sapiens
cattatcacactgaaaatgtagatctctaaatacaaggatgcaagtttagaaagcataaaaagtaaaagcagtaagtcactcatcttactgctagcagctaccattactctttagatgtaaacattctagacttttcaacctgcttttacccataactacacttttaagaatgatttttgtgggccaggcatgatgactcatgccagtaatgccagtgctttgggaggccgatgtgggaggatcacctgaggccaggagtttaagaccagtc

SEQ ID NO: 244808 - DNA, 387 bp, Homo sapiens
aagaacacattcttttcaacctacacgtacaaatacgtacatgaaaggaatgtggatcaaataaagatcaaataagattatacattaaaatacttagttctttgttaggcaggtaggaagtactcatcctggagctttaaaaaaaaaagccgttttctttttaaaaatttctttgtagccctgaaagctgttaaagaaaaaaacgttctggccaagcacaagggctccctgaaagtgtaattccaccactttcggaggccgaggtaggatgattacttgccccaggagttagagaccagcctgggcaacatagtgagaccccatctcaatttatattatttaaaaaataattaatgtaagagaaattaaaacagatttttaaaaagg

SEQ ID NO: 244809 - DNA, 485 bp, Homo sapiens
cccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtgggg

SEQ ID NO: 244810 - DNA, 470 bp, Homo sapiens
tacatagtctggttataaaccctttgttcatttttatgttgtaggctgcctttttacccttttaatattgtttttgatatgccctctctatgccctactggataaattccaacccctgtttgggaaccttcagtttctggaattatttcttctaaaatctttattgtttgcctttggcatttaggtctataatccatctggaacacatttgttatgtatggtgtgaggtaggggattctgtcatttttttccatatagatatccagttagtctagcaccgtgtataaaagagcactttccactagtagcataaaatcgtataggcccatgataaattcctaacagtataaataaaaaagtgaatgtctagtccatatctgtacatccagttccccactctcaaccccctgaggcagtcatagtttcttgcttacagattttaagaatcatgtttaaacatctctagcatt

SEQ ID NO: 244811 - DNA, 522 bp, Homo sapiens
tcatagagaaagtatacatcactgaaggactttagctcctcttctggggagggggttagtgtgttttggttatacacagaatagctgtatcaggttaggtggaattacagccttgttagtgtctttatttggagattaagtatggcttaaggagatacatataggtgccaagttgatgagattagttgatggacttgtgatggctagtattttatgtcaacttcactgggctacaaggtgcccagatatttggttaaacattattgtgtgtgtgtgtgtgtgtgtgtgtgtgtgcgcgtgtgcgtgtgtgtgcaagggagagatttgggatgaaattaacatgagaattgatagataagcaaagcagattgccctccccaatatgggtgggcctcattccatctattaaaggccggaagagaacagaaggctgagtaagagagaatttgctctcttaagctgactatcttcaagtgaggaaatcacatcagtcttctgtttttgaactcaggctcagattgg

SEQ ID NO: 244812 - DNA, 350 bp, Homo sapiens
gacgtacacactctgagttttgtttttatctcattaccttatgactctgactactacatctctaaaatagggtaaactatttttggtattaggttttgcttgtattactcaagtttttgtttccacccactgctatagttatctggacttgtgtgtgcacctggccatagctacatctatataaattttattcacgggtgcacattttgcatatacctttgtgtagtttaaaaatgtaagttatgtgctgatacccttccttctctattttaacttcttggataacactgccatttcactttatcattttaaacctacttaactctacccaatctgcagaaatgtcaacc

SEQ ID NO: 244813 - DNA, 267 bp, Homo sapiens
gaaagagaaaggactagcagagttacaggttagagaaacaggtaaaggctactatggacggcataatagttgcatcccatgttttgtctcttaagaacagttgcaaactattgaaggttttaaagctgtgtgttgggccgggtgtggtggcttgtgcctgtaatcccagcactttgggaggccgaggcgggtggatcacgaggtcaggagtttgagaccagcctggccaatatggtgaaatcccgtctctattaaaaataaaaaagt

SEQ ID NO: 244814 - DNA, 281 bp, Homo sapiens
tgtagaggtttttcatcttcttggttaaactgcttcctagatatttaaaaaaatttttgtagctgtggttaatgggattgcattttttattttttattgtatgtgtatagaaacactacttatttttgtgtacttattttgtttctggcagctttattgaattcatttattggttctaagggttttggtagagtttttaggtttttgtttatataagattatgtcatctgcaaacagggacagtttgcttccttcccaatttggataccttttattttttt

SEQ ID NO: 244815 - DNA, 368 bp, Homo sapiens
tagatggagtcttgctctgtcgccaggctggagtgcaatggtgcaatcttggctcactgcaacctccgcctccccagttcaagcaattcttctgcctcagcctcccgagtagctgagactacagtggaccagaggagaagatatggatgaactccttggacccaccctgttcccagctcatctgggagaatgaagctaattggtaaatccactgtttgatgcttgtaatgaagactcaaggagttctgtctctaccaagttccttgcccttaatgactcaagaattaattttatcttttcctctcaaaaccttgaaagaaatgcttgagtccttgtaacctgtaaaataaatgttgttactgaaggga

SEQ ID NO: 244816 - DNA, 314 bp, Homo sapiens
ccctttttaaattcattatctagcaagatagtcaaacttataaataattatttatgatacattgtgataagtattattccagcagtatttaagtgtagaggaggaagtaattcattctgtctccagagtttggagaatgtgatgcctaagagatagcatgccatcccagctgtaaaagaagaatagatttctctgggtaaaagaggtaaagaaagcctataaaatatttttgtatatcatttgattaaatttcatctttggtttgactaatttgtcatcctgaaaatcaaataataatgaatccaaagtctcaa

SEQ ID NO: 244817 - DNA, 554 bp, Homo sapiens
cataagaaaacctagaacttgctttccagagaacaggacatgaatgggttcatttacaggagaaaatgaattctgatatgtctaacctaaaagataacagattgtttctgaaaaaactctctaatgctgacagtaaaattaacagcctaaaaattaagtttcatcatgcaagagaaacactcagagaaaagacgtcagttttagaatgtttccaaagagaccttggccaaacacagtgtcaaaagaaagaaattgaacgaatgtataaaaatgaacaaagcaaagtaaataaatacgctgaagaagcaggaatctatagaggacagatgtgctcaactacaaagtgaaaataggttgcttcaacagcaactggatgatgcccacaagaaagctgacaatcaagaaaagacaatcagtactatccaagaccaaatccatgccgttgtaaaaaaatctagctgggagtgaaatgcagagtcttctgctagaagagaaaaacaaagacttaatcaatgtatgtaataatttgaaagaaagaatatatcaatgtgaaa

SEQ ID NO: 244818 - DNA, 237 bp, Homo sapiens
tggcagggactgtacctatttctgctcaccatgatattcccaacgtgaccctgcagtaggctctccatcaatatgtgtttaattattgaatgaatgtactgagtttggctttgttcaaagtcatactgatttaaggacaatccataatgaaatccatcacttacaacaattcatgctaatcatatgattcacctgtgtaattcattaaaagtttacactgaatgtacaaagcaggga

SEQ ID NO: 244819 - DNA, 555 bp, Homo sapiens
aatattgagaaggacatgtatgctcaaactccacaatttcacaccgcagaaccactgaagcttaacagtgaaaggtgtatgaaatgctggtgctcatggaaaaatgcaggcacagttttatctgctagcagccgagaatcaaagcaacagcctgatcctacctgataataagatgataagaaggccaagtggtaatacaatatgtgaagctcttttcttacgtaagtacataagtggagtttcaccttgggccattctttacacactaatgagtgtatgtgtgagtgtgtatgtaagaaaaaatttcaaaattttctaaagctacatatataaagataatgtctaaatgtgaaaatcagcccaattgcaaaagggccatcctacttgaaacttgcagaataaatatttcagttaagcaagggcaagttctcagcccccagcggaacagaattctggggaagaggagtcacagatagactatgatgagagggttcttgaaaactaaattgtaggagtcaacacagtgaggtgaaaggaagccttagatttggagtc

SEQ ID NO: 244820 - DNA, 472 bp, Homo sapiens
gctctcggtactggaatagcaggcatttcaacctctgtcaggaccttccatagtctctctaatgaattctctgctagcatcacagtcatatcacaaacttcatcagtcctccaggcccaagttgactctagctgcagttgtcctccaaaaccgccgaggccttgacttactgctggaaaaggagaacatctgtatattcttaaatgaagagtgttgtttttacctaaatcaatctgacctggtgtatgacaacataaaaaaactcaagaatagagcccaaaaacttgccaaccatgggggagtaactgctgatgagtatgggattctcttttggggcaatgaaaatgttctagagttagattgtagtcatggttgcacaactcaatatactaaaaaccactgatttatacactttaaatgagatgaaatgtatgattttatgtcaataaagctgttacagaagggaatgtct

SEQ ID NO: 244821 - DNA, 598 bp, Homo sapiens
gcagagaaaccaagcactaggacacatccactactgccaaaaaaaggagcagaagtactgttggaacctggacagatggaaagcaagggatggttatatgctgagggctcagcagaggtgtctgtcctcaccaggtcccagtgcaactagtctagtccagttgcacacaatatccatcctccatttcttcaataataataaagtgtggttgggtataaagctacctaaaatgaaaattacatttccaagttcagttatcctgaactgcacttcttttgcagctcagggtacttgtgtctaaattgtggctaatgagatataagcaggaggtctcatatgacagcttccaagagtcttccttaagatactggacataagcaccctctgctttgtttttcatcccttcctatctcctgtggcctaggatgtagatatctgcatatggggcagtgaagtcgaagtcatgcatggtgagacatcaatgtcaaaggaatctggatccctgacaccttggaggactctacagccctggaatgctgaaatacacatttatgtgaaggaaataaagttgtaccttcccacagttaaaaaaggtttt

SEQ ID NO: 244822 - DNA, 869 bp, Homo sapiens
gattgtagaacttaaactggaagactggattcctcagatctcaggactataacattccagataaatttttacattccctttgctgtatattaactgatgatcatttatatgttaagattttttaccttaatatttctgaataaaactcttattgcccatttaatattttcataggcaatcaaatgtgagtaatactgctaagagtctgatttattaaaaatatttgtataattcattcagtttagtttttcagtttagtctttctgctttcacttttctctgtgctaacaagtaactaatgtctgggcattgacttcttattgaatcaaagttgggttaggcatagctatgcacacctgatgtgtaagattaaagaagagattaaataagaaatcttgggtaagttggacttttctgtatagctcttttttcctctgagttgtattttaatgtagtttataagtgataaaatgatccttgttttctaaaagccagtccttcccttcagctttccacagtttctgtaaatgtttaatacttgtacagtcaatggcaattttaaatatatatatataatatatgtatatggaaaaggttcaaagatgcttttaatttatttaatgactattgccttcctataataataattttcatccttaattatgataatacttttagcaagaaaaattcctttttactacagtttttagatgcaaaatgcagtttggttctttagtcaaatccacttagagggtatattgcagtgaaactgtgaaggatacttcactaccaatgtataagctttgttgaatttgtatcattttctttcagtaatgaaaagctattcattatacagtatggaaataaaa

SEQ ID NO: 244823 - DNA, 265 bp, Homo sapiens
tcccaccaccccctgcccccaccaccccaagaggtaaaaggtaatgctggaaggatttttaatgtatattaatccagtagttataaatgcatctttgttacaggaagaatatgttattaatactgtatgtctcataataaaaattcaaacattggacattttcagcattgtaaaatttaactgaatattcattcagacagacttcattttgcagcataccttttgatgttttcataaaagctgcttcaattagatagaaaaaaaa

SEQ ID NO: 244824 - DNA, 181 bp, Homo sapiens
tgatctgattaagttccttataggttctggataccagacctttgtcagatgcatactttgcaaattctgtattctatttgacatgttctggctctgtgtacccaaccaaatctcatcttgaattgtaatctgaattgtaatcctcacgtgttgggggaggaaccttgtgggaggtgactgg

SEQ ID NO: 244825 - DNA, 618 bp, Homo sapiens
gaaagaagagtgtgagtatagagcaagcttgtccaagctgtggcccgtgggatgcatgtggtccaggacggctttgaatgagaccaaacacaaatttgtaaactttcttaaaacatgagattttttgtgtgtgattttttttttaaagctcatcagttatcgttagtgtattttatgtgtggcccaggacaattcttccagcgtggcccagagaagccaaaagattgaatacccctggtatagaggaataagcagcaaacaaaaaatgaaatggggagtccctctgaaactaatctgcttctgggactgcccaattaaaaaaaaattaaaaagggctgggcacagtggctcacacctgtaatcccagcactttggaaggccgaggcaggtggatcacctgaggttaggagttcgagaccagccagaccaacatggaaaaaccccgtctctactagaaatataaaattagctgggcgtggtggcgcatgcctgtaatcccagctactcaggaggctgaggcaggagaatcacttcaacccaggaggcagaggctgcagtgagtcgagattgtgccattgcactccagcctgggcaacaagagtgaaactccgtctcaag

SEQ ID NO: 244826 - DNA, 506 bp, Homo sapiens
gtgttggatccatgggtgaactgaaatcaatttctaacatataggtaaggtggattttatataactttttcattgttctgtgattaaatgagtattgattgttgggattttcttactacgtgtatatagcaagttttggttatccctcatccattatatatgctccacattttttattagaaaaactattcttcttcgtcacaaagaattttattctatattctttcctaatagaattagtatcaaattataaatatgtaaagtttagtgtatagtctcagatgaattattatcatttcttgtactttatcctttgtgactatttctgcctgttatttggatagttcactttgaattaaaaagagaactgtgaaatgtgtgtgtgtgttcaatcttaggggatgttagaggaaatatgttacattcatattgaacactgaaaattctaaattctatgctgattttcagttttatgttagtgaagaattttgacatggaaaaagttt

SEQ ID NO: 244827 - DNA, 497 bp, Homo sapiens
aaggaggtggagtacttgagtagaaatgatacaagataacctcttcaggaaatcagccaagtatcatagcttttcacataggtgtgtaatgtttgtgtatgtgtgtatgaagagctgttgtggcctagaatcaggggcctttagatcccttgtacagatagaaaagtaaaggctgaggcccaggagcgctccaggccactgcggtagagtccctgtctgcccctcccagtgcctggtcacttctcactgcactccctgccttactgctaaagccatcttccccgactctgaatgtgtaaccacaatggagaatatgtactccagggtcacagtttgtggagaaaaagcccagcagatgaaaattatgtttacaaggtttgtacctagaaagagtggccatttctatgatgtctttaaatgtccctgtttctcatacattttataaacacgacaatagaaggagattcggaaacagcaactttagaacaaggggaaaa

SEQ ID NO: 244828 - DNA, 528 bp, Homo sapiens
atgggcaaaagatttgaacaagaacttcaaaaagaaaataactgaatgataaaaattaaacacataaaaatggattcaacatcatagtactcaagaaaatgcaattgaaaaccacaagataacattccatacccactagaatggctaaaataaacaatgtctggcaattttcaaagttagtaaggttatggagcaactggaatcagatcagtgctattgtgaaatgagtttcaatttctgttcatgttaaattctattcaaagtgatttgatttatgtgataaaattgtttctggaaaatgttattcatccatgcaattacccaacaattatgtatttatagttcataatgggtgaaacaaagttgttcgtaccttcaaagagcatgtagacaagtttgcaaattaaagccttgttaagtcagccactatatagttactgttgtttatcacattttcttgaatcccaaacacatgtattgtcttacaaccaatttcaaaataaatctgacaactgattgatcttctta

SEQ ID NO: 244829 - DNA, 480 bp, Homo sapiens
tcagctatgagccaaaggctacataggtgtttactaggacacgtgggttagggcacaaaaagaactatcaaaaggccaggtgaggccaggcacagtggctcacacctgtaatcctgcactttgggaggctgagacaggggtatcatttgaggtcaggagtttgagactagcctggccaacacggtgaaaccccgtctctgctaaaaatattaaaaaattagctgggcatggtgatacacacttgtaatcccagctactcaggagattgagccaggagaatcacttgaaccaggaggtggggaaagaaaagaaaggaaaagaaaagaaaagaaagagaaagaaaggaaggaagagagagagagagaaagagagagagagggagggagagaaggagggagagagggagggagggaaggaaggaagggaaagaaagaaaagaaaagaaaagaaagaaaggaaagaaagaaaaagaaagaagga

SEQ ID NO: 244830 - DNA, 224 bp, Homo sapiens
ctacactttggggcagagggagtcttatgacacatggttctcagctccagctgtgacagggaaaaagggctgttgatagaataatcctgacccagataatgagatccttagctacctgcatctaatagcttcacaggacatctcaggatggaagtcagccaagaaagccattttcgtttgccttttactttaatttggcacaaacagtggacacttatttctct

SEQ ID NO: 244831 - DNA, 460 bp, Homo sapiens
tttgcagatctccagaattctcctgctgtaagatgctctcttacagaagccatattgcttttacttatgggaccatgcataaaactgaaaaggaaacccttaaatcttcagaagacagagcaaacaatatacaggaacaaagtacaaaagaaatgcaaatgtaaacatataggaaatagtcaaatttagtattcaaaaaatggaaattaaaaaaatctaaatttaaaataaatttaaaatgcaatgtttataaacttctgcttccagccgagatggaatacgagagaatagaattaacctcttgccccaacaacaacaaaacagacaaaatacattaaacagtggttttcaagaccaagagagataaaatagtattgacctcatagggttattgtgggaattaaatgagttagtatttgtaaaacatagaatggtgcctgacacgtggtaagacttattt

SEQ ID NO: 244832 - DNA, 406 bp, Homo sapiens
tctgaggccagctcgaaagttaggaaataaaatcaggtggggccccatcccgtagatgctgagggacagctctgacctagagttcctgctaagcaaatgttgaaccacggcagttgtaaaaaaatgtagatttaggaagccatttcgagataaagatttacagaagattgttgcagaaattaaagaatattcgaggttcattgttcaccattttagagttgcgtgtcttgaaaacgggaaggcaatcatgtcttctcataaaatgaattgtatagaactggaagaagtcctaacacatgaattccttagacttttgtggtccctgcttctgtcacgctgggttcacacaggttcatttcagagcatggtgaagatcaggacaagtgtacagttttccctgtagaaa

SEQ ID NO: 244833 - DNA, 401 bp, Homo sapiens
actcatttttcctttttgtgttatacccttaaaaaataaacagcacaactcttcatcatcttgaagaccacacctttttgtgatattggccatcaaccatctgagtacacacacacacacacattattacctggggaagataaaatcttctaacgtgatggacttaaccttaactaccagagacgcaccgaactgcaaaagttctcatctctcttcggagaaatagccctccttttcaccattttctcacaacttgggcagaaattccatggcctctgatagggggcgtgcttagcatatttgacacctgggacaaattattttataatacccccctcctctataacagaattattttggtaataatcataaaataaaataaataataatttcttgggaaa

SEQ ID NO: 244834 - DNA, 195 bp, Homo sapiens
cccaagtaggataatgcttacaaatgatactttgccaacccacttaggctgaaccagcatcctagagtgtattcaggtgaatcccacaaggaaaaggaaataatgggatgctggcacattactcaaaatccctccaccacccacactttaagcatcttatactatctagtagtcttagtaatttatagaatttct

SEQ ID NO: 244835 - DNA, 1720 bp, Homo sapiens
  misc_feature (97)..(97): n is a, c, g, or t
  misc_feature (137)..(137): n is a, c, g, or t
  misc_feature (802)..(802): n is a, c, g, or t
  misc_feature (827)..(827): n is a, c, g, or t
  misc_feature (939)..(939): n is a, c, g, or t
  misc_feature (976)..(976): n is a, c, g, or t
  misc_feature (1022)..(1022): n is a, c, g, or t
gccattgtaatgtcagaaaactaaataacattcaaattttgaacatgtaatgctactattagtaaaaataagtgtaattaatgtaaagttgtgtaangattactaaacttgtatacttgaaatgattgaatagttcntagaagtcatttgtttctcttttatttaaaatgtagcaagtttctaattttaaacacatacatattaagagatgcatttacatttttttagttttagttattatggatacataatagttgtacatatttatggggtacatgtagtattttgatagaagcatacaatgtgtgatgatcaaatcagggtaattcagagatccgtcacttcaaacatttatcatttatttgtgttaggaacattttaatttcattcttttagttattctgaattatataataaattatagtcaccctattgtgctgttggacactagaatttattctatctaactgtgtttttgtacctgttaacctttccctctttgtccctccctccctgctccccttcccagcctcttaaccatcattgagagagatgcctatgtaaatcttaagattttcaaaaggagcacacacatttggtaaagcactctaactgtaatgcacggtacacacaatgcgcattttctctttccttgctgtaacctctggtctctcaggtccctgcagacctttatatatatgtatatgtatatgtatatccttccagatacatataaacacacatgccaccctttaaaaacacaaacggtagcttattttatacactgttctatgctttgctnttttcatgtaatatacttgaaggtntataatcagtaagtactgtagctctgcctccttctttttaatataacattccattctgtggatgcaccataatttatttagtctagcttatgttgattgctctgctctgggntgtcaaagcctcctgagtacagcagaggcacacacantacgtggatttgggtgtgtacgtgcgtgtgtggattaggggagtgncactggcttagatggcaaagattggcagctgagggactgtttgctcccttttattcctgaccctacaaccagctgcttgtcccttggcactctggcatcagatgtggtgtgaggatattccacctgttctttgagctggtccagtgttgctggagagctctgcttgctgccttggtctgcagtggcagctgtgctttcctacaagcccaacttcatatattctgtggttttgggttttgatgtttcctagtttaatcaaggatgggcatttctgtttccattttgtgttatttttagttatccatggaaagatacaaacagaactatctttaatattaaaattacaagtttccaggaatcagttctgaaattattttgcatctttgaagtgtcttaaattttaaaaattggtcttggccaggtgcggtggctcacgcctgtaatcccagcacttcggaggccaaggcaggcagatcacggggtcaggagatcgagaccatcctggtgaacactgtgaaaccccgtctctactaaaaaaatacaaaaaaactagccgggtgtggtggtgggtgcctgtagtcccagctactcaggaggctgaggcagaagaatggcatgaatccggggggcggagcttgcgctgagccgagatcaagccactgcactccagcctgggcaacagagcgagactctgtctc

SEQ ID NO: 244836 - DNA, 230 bp, Homo sapiens
ccgcccagataatttttgtacttttaatagagatgggatttcaccatgttgttcagactggtctcaaactcctggcctcatgtgatccacccgccttggcctcccaaagtgctgagattgcaggggtgagacaccacgcctggtctaaactgtaaagtttatcgggccctttgacatgtattggtttattgactcccaaaaatctgaagttcagagaaatttaatgactt

SEQ ID NO: 244837 - DNA, 452 bp, Homo sapiens
ggcgctgggaattacagcaaaggacaaacagacaaaccctggccgccctggggctaccatgctagcgggccgctgagtcggaatccgtggctgtgttaggataacttgctcaggattgcacggctggtgagcagcagtcagaactccatccacctctcctgataccaggccaggttcctttactccagagttctcaaagcaggggtctcacgtcttctttagtctttagagagacattttcaactgactccttagtggctaagcaagcttcagaaatttctcaacaagaagcttccacacaatcaaaggtccctgcctgcgtctgtagcagccaagagctgttaagaaaggagattggagcaggtggccttgtgcaggggaggggatgggtgggaggtggccgtgcaagctctgcattgtcatggacggaataaaggatttccacaacactc

SEQ ID NO: 244838 - DNA, 558 bp, Homo sapiens
gcttattgcattctctcagagcagctgtctcaaaggaggctgctcccatgccgatctttttgtgcccaacttacagggaaagaactcattgcctgcccagtgcctgccagcctcagacttctgactgcaaatccaacaggacaatacagagttggcaggacccttctcaggagtgaggagcgggtgcaagaactcccaggtcactgctttattcagaggacctaaggaattgggttgagcggaagcgcacagagctgcagattttctttgatgaatgaaagcttcaatccacaggtttctaatagtactctcattcattttgcttacaaaaggtacagattatcactaatcctcttcaaaaggtatttgtaatcacatttccttgtatatgcaaaaaaaattctatttaaagtgtatgtgaaattaagtttacttttttgaaacacatgtagaaaaagaacaaaggtatcatcaaactagtctatgtagtctcctttcactaaaatattgatggttcaacacttaaggaagtctagaaataaaatattcaaatgacaa

SEQ ID NO: 244839 - DNA, 369 bp, Homo sapiens
acagcatgcagttgagctcagtgaactgatttattcttaccttctttgatcagagttttttttccatcagttagtcacagtatggcagctttccaaacaggatgctgtccatcaccttggaactgccatctgtaaataaagtggctttttgtttgccaactagggcctggtagaagggcacacatatgtggcagtaggatctagtaattctccagatgcctccagaatcagtcataagttaagggaggctatctgcttgtgaatatgatgagtatttccttgcttttctcttttcctgtataaaccatttccattttattatgaaaattctcagtactgccttccttgttagaatgaatgtttctctga

SEQ ID NO: 244840 - DNA, 585 bp, Homo sapiens
cagccccttgggtcagcagatgggttttgttggagtggcccattgggtgtgggtgtcttgggctggaggtgatgtggatgacgcacagggcttattctttgtgccctctcaagcttcacctttggccctggcctacagggattccgggttcaggaaagactttgaatctgcagccacatgaaaatacatggcactgctgtggacccactttttaaggaggggggggcggggaaagcatagaaaagatttgacagcttgaaactacatcagccagtttgtagaggttttggccactcttctagtttccatacacatgatccgtgatggatttggaggggcatgggaaagaggacaaagccagaggctcctcattagtcttgggaattcaaggagacttcagtttggtagctgcacttggagagattgtgtgtgtgcgcacacacatgtggttgctccaaggcagtttctactgctgcttgctcatgtgtctgtagcttccaggcagtttttcagcaagactgtaagccagatgcaaaagcaaacctgaagagatatgtcaaactgcattaaaaaaaaaaaaaaaaa

SEQ ID NO: 244841 - DNA, 449 bp, Homo sapiens
tgatacacaagaccctccctgagctctgttctgtcctgagaggaggcccacagtgccaaagaattcacatctagagctgagcctccgcacatccccactctgctgcagcccagccgcgtgaacttggacctgcctttctggggcttagggttctcactggtcctgaggaaggcttaagaatggagcaaccgccgggtgcggtggctcacgcgtgtaatcccagcactttgggaggccgaggcgggcagatcacgaggtcaggagatcgagaccatcctggctaacatggtgaaaacccatctctactaaaaatacaaaaaattagccaggcgtggtggcgggcgcctgtagtcccagctactcaggaggctgaggcaggagaatggcttgaacccgggaggcggagcttccagtgagccaagatcgcaccaccgcactccagcctgggc

SEQ ID NO: 244842 - DNA, 224 bp, Homo sapiens
atttttagtagagatggggttcaccatgttggccaggtcaaactcctgatctcaggtgatccacccgcctcgacctcccaaagtgctgggattacaggcgtgagtcaccacgcccagccttgtgtgtttattcttaataccttatttttggaagaagaatctccattctaattatccaaacctgatagctgtaaaattgaatgggaaagactagaaacaagagg

SEQ ID NO: 244843 - DNA, 2445 bp, Homo sapiens
agctgctcgggcgcggggcgttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagatttattaaaacttgactgaacaaaaggggaccatcaacattgtagacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcat

SEQ ID NO: 244844 - DNA, 710 bp, Homo sapiens
  misc_feature (667)..(668): n is a, c, g, or t
  misc_feature (684)..(684): n is a, c, g, or t
  misc_feature (698)..(698): n is a, c, g, or t
  misc_feature (709)..(709): n is a, c, g, or t
agctgctcgggcgcggggcgttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggttnntccaaggggaaaatcntcctcctgaattcnaaggattaacnc

SEQ ID NO: 244845 - DNA, 2307 bp, Homo sapiens
agctgctcgggcgcggggcgttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagatttattaaaacttgactgaacaaaaggggaccatcaacattgtagacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcat

SEQ ID NO: 244846 - DNA, 481 bp, Homo sapiens
ccttgtacacactgttccagccatggaagaatccttccattcttccaacaagccaaacttttgtttttatctcagggtctttgttcttgctgtcccctcagcctggctggttccttcttgtcatgcagttctcattataaacatcgtttctccagaagcatcgtttatcattctatataaagccatctctccctacacatacacagatgtgcatgcacacacatgcacacgttactctcaatcccattaccctgttcttttctttttgctgtacttcatcattctctgaaattaccatgtgtttacatgttacatagactttctgtgaaaacaacagctacagatctaaaccaatcttgagtgagtgactcaaaaatcacaagcatcgctgtcactgatgatgtggttttctgaaatggagaacaactcttagtaaaggtccaaacaaaacaaactacaagtgtctctccattcttcatag

SEQ ID NO: 244847 - DNA, 394 bp, Homo sapiens
ggcttgcggatcttagaagagtggatctgacccggtttgtgaggaggcggctggggaggtcgtgtgggagggagggcattctaggcaggggggaaagcccgtttgagagatgggaacctgaacacattccggtcgaaagggaaggtgtagtttctggtgcatgaaaagaggcagagttgtggggcagggactgatttcatggggcttatgatccccaacgtgttagaggagatactgaaggacggaaaggatgagcagccaaagagaggaaggagacccatgagtgctgctagtcaaaggaatagagagtgagcagatgcagcagtcaagtccggttatactggacttggatgtgatgcccactggatttggatgtgagctatttgtaagagtt

SEQ ID NO: 244848 - DNA, 490 bp, Homo sapiens
acgagtgccgcaatcttcagggtattgacgcccacccgggtcctccgcagccaagagcaagggactgcggaaggagtgccgcaatcttcagggtattgacgcccacccgggtcctccgcagcctagagcagggaactgcggaaagagtgccacaatcctcagggtattgacgcccacccaagtcctccgcagccttccgcaggggagatacgcagctaggtctcagtgcgcagcttcagcatccctacaatccgcagggtactgatgcccaccaaggtcctccgcagccgtcagcagggtagcgacacccagccaggtctcagcgcatggcttcaggagtgcctcaattcacagggtactgacggtcacccaggtcttctactgctgtatgcagggtcgggacacccagctacgtctcggttcgcgacttcagccgcaacatgatccgcgtagtaaggacgcctgcccgcccaggtcttccatgtaccgc

SEQ ID NO: 244849 - DNA, 472 bp, Homo sapiens
cagtaaaattatgaccaacttacagtcctaggagatggattgcagaaatctttaagaccatccataagaaatggctttcaaacttatttgaaatcaatttgacatcacaacccacttttcatacatgtataaactgaaattggtttcacaaagtattatttcccttataacatgctacatattttcccttctattaaaaaagttggctgtcacccatgaagtttgttaccagttggtcatgactagaggttaaaaagcactgatcaattgctttaatcttaaaaaaaaaaaaaaaaaaggcaacataacacagttgctaagagtactaactttgaagtaggactgcccaggttcaaatcctgacaccgctacttggctatgaagcccaagtcctaggtcatgtcactaactttggtgcttcagtttccccctccagaaatcaagagaaaccttctaataaaactttgttatc

SEQ ID NO: 244850 - DNA, 1325 bp, Homo sapiens
  misc_feature (1)..(1): n is a, c, g, or t
  misc_feature (15)..(16): n is a, c, g, or t
nccttgttggaactnnggatccagattgctgcctactatgtgaaagttaatataaactggaggaatcgagcccagccattgagagtccaattaggagctactacaatgatgacggtcgctacaaaataaaaagaactcaaaagagggagcaacaaattcagctgaagtatggggaaacaaaaaagcctcagagaagtcatgttgcagctcaatactgaaagataagaagcagtctagacaagtaaagcaaggaaatttgtacagaagaccatatgaatagcatgtttggagaacttcaagtagttcttcatgatgagtcttgaatgaggtgaattatagctagaaaggcagattgagaaaaaaacagtaaagaatattttacaagaagagaaagtaaacacctcctggacactaaggaatacttttaagcaaggtgcttacatgaccagggttacattttagaaagattcttccaaaatcagttagcctaaaaacaaatataagaagtctagccacctaaacaagcatcgtgcttcccaataaatacactgtctcaaagtcctaatctagtaacttaccttgacaaccaaatacagtacaaccaagtactcttaagtttcagagaccaagcaactaggaccaagttcaggtcacactatagttgactagctattaaaacaacaaaaaaagggaggagtcaccatagaaaaaacgctaaaaacgtgaaaaatgcagtggtgtcaggagataagaagagtcaagtacagaatactcttcttgattacactcagaaatgggctaataacagagaaactgttttattccagtgtaagaatacttccactttttgccagttacacagagatgcaccccttatatgtaataatgaattatggttcctgacaagcagctcaaccaccaaatttaatttaatacacaatacttcaaccaaagattagattagaaacagcaaagtacaacagcactgtggtgtgcaacagctatacactagttaggttcccacagcttaaaactctctaacaagctttagagcagggtgggggaggacttactattttgcagaggttcctattcaatgaactggaaaagttcttaattcaaacatgacaagtgacatactgaagaattcaactgttttaagaagatgaatcctacctttccagggtcatccttagatcgaggcactttaaggaaacatttgttcaatgacagattatgtcgtatggaattctggaattaaagaagaaaagccataaggtcaataaaatccaaaaacataacccaaatttaaaaacagaattaga

SEQ ID NO: 244851 - DNA, 390 bp, Homo sapiens
tgctatcctattaaatgttgtggcttttaaccttttattctacgagcctcatttgtcctgtgttctcctcttcctcagagccaggctattttgagttatgctgttagccttaaaggggaacagaattgtcctggcacttgaggcttgtgaagctaacagatcacagatttttaaaatgactaattattataaaatacttagttttgcctcagaataatgaccttggtccaggtgttttgatttgtttctttagttgttaactgggaaccaagtaccagactttatatttaggcctggctgtaggcaaggggattaattagtcaatacttgttgagtagtttatggatcaaagatagtacaagtgtgttgtagtgaaacactacaaagcag

SEQ ID NO: 244852 - DNA, 421 bp, Homo sapiens
ctgggttcaagggattctcctgcctcagtctcctgagtagctgggactacagatgtacgccaccacgtccagctgatttttgtatttttttggtagagtcggggtttcaccgtgttggtcaggttggtcttgaactcctgacctcaaatgatctgcccacctcagctccgaaagtgctgggattacagatgtgagccaccgcacctggcctaagatttgtaatttaatatagattattgcaggtgtagattttgcagcttgtctttgcaaatatgattcacaccttccctttcactatagggtacattgtgggcctgtgggtagtgtgaaatggtaaaataatggacagattgagtgagataaggatccctattcatgaaacaaactggtccaatcaactacagttagagtaaaatgaagt

SEQ ID NO: 244853 - DNA, 559 bp, Homo sapiens
agagactttgtttcttaaaaagaaagaattaaccataggaggatttctctgaaaggtttttcatcaaattagaagagagcaaaacctttgtcccgtagaattaagttgacttgtacaatctgaaaagagatcagcatcttaatacattgccaaaaaaaaaaaaaaatcacacaattggagtgagttaagatttattctgaatgaacaataaagaattatgcttattatttttgggctttctgcatgtaggttaaaaaaataggttgccagtttgaatgttttttcatttttcacacctgtaatcccagcactttgggaggccaaggtgggcagatcacttgaggccaggagttcaagaccagccaggccaacatagcaaaaccctgtctctattgaaaatacaaaaaaattagctgggcatggtggtgcagacctgtaataccagctacttgagaggctgagacaggagaatcacttgaacccagaaggcagaggttgcagtgagccaagattgtgccactgcactccagtctgggagacagagccagactctatctca

SEQ ID NO: 244854 - DNA, 371 bp, Homo sapiens
tggtgatgattgtgccatttatcatttgtagtagaaacagcagtttgtgctgatcagtgactttgaaaccttcttaagataagcaagttttaatggcttacctcaagtaacaggagcacttgcttcttgtcagcatctatcacagtgactcattttatggagtcaaaatagcttataattgttaccacaagagtccagtcgttcctgccatttcttaaaaattaatggagaagtcgtgccgattttgtggccatggctacagatttttagctccatgcctgctcagtaagccattattatgtggttaccgttttgtcctcaaggaattttcctgttgctaaatcacgcatacttgaagaattcattatttt

SEQ ID NO: 244855 - DNA, 280 bp, Homo sapiens
tcaaaaaaaaaaaaaaaaaggcttgttttgttgttgacagccatgtctaaaaagaatatacgtttcctacctttgagtcttaaattcttcagtattaaatcactggcctctagtcttcagtccctgtggcttttataatttgttttaaaaattgatgactggttggcatggtggctcatgcccgtaatcccagcactttgggaggccaatataggcggattgcttgagcccagaagttcgagaccagtctgggcaacatggcaaaacctggtctctaccc

SEQ ID NO: 244856 - DNA, 413 bp, Homo sapiens
cagagcaagatgctatctcaaaaaaaaaaaaaaaaaaaacctgttattgaaataattcacataccatacaattcactcattcaaagtaaacagttgaatggtttttagtatattctgagaattgtacaaccatcaccacatttaccatactcatgacagtacagaaataaacacatgcatctatggtcaactgattttcaacaagggtgtcaagaccattcaatagagaaagaatagtgttttcaatagatgctactgggacaactgaatatccatatggaaaagaatgtggtttggacccctacctcacaccacatacaaaaattaattccaaatggatcaaagacctaaatataagaactaaaactttgatctgcagtagctggaggaaaaaaaaaagagagaaatattta

SEQ ID NO: 244857 - DNA, 279 bp, Homo sapiens
tgacaaatgatgttaacagtttcattttgggtgtttaatagcagtacagaagatttcactaacgttacaggaaattgccctgataaagtcccactaccaaccctgttggtatctgttattatttctgagtgtcaacataggtgtttcaggatgtagtggggtccacaatagtggggagtaaatatcaagttgctttacttttaagaggacattattattttaacccacacatctaaaaatcctgtctggttctcacatgttgtgagcattctctaagcc

SEQ ID NO: 244858 - DNA, 666 bp, Homo sapiens
ctgggagtacaggtgcatgccacccctgccagataacttttgcatttttatagagatgaggatttactgtgttgcccaggctggtctggaactcctggactcaagggatcctcctaccttggcctcccaaagtgctgggattacaggcgtgggccactgcacccggccgtaactgtttttctgttttgaaaccaaataccgtatatcatttactaatagcatagatcaaccttaatcaggttaatgaagaaaatggaagaacttgaggcatttttgcctgcattgaggtaggctatatgccaaaatttcttgaataatttagtccaaataccatttaaatataagtaaataactgaagacaaaatctgaggccttcctaaagtcaacttttctagttaaaaaaaaaaagctaggaattaggagacctagtccttcgattaattccttgtataacttggcagaccactgtttctggtgttcagtttactcagcaggaaaatggagataataataactaactgccccactcctgaggctgctccaaggagaaactgaagtgctctgaaaagtcacagccaccagtgggtggtagtggtgatttatgtcttcatcgaatgggttaaaatgaatctctgctgaatgtgagtgaaatatagaatcttgttt

SEQ ID NO: 244859 - DNA, 413 bp, Homo sapiens
ttacaggagagaaacctgaaagcaacttaaccaagtgatcacagaatcactggtaataactcttgttgatatcatgtgcccccaatacagtatgatgaaaagacccatcatctcggtgatatttatcctcaaaatctataatcttacaacaattatgagaaaatatagacaaacccaatttgaaaggaagcaagtctacaagatacttaaccagtactttacaaaagtgacaaggtcacaaaagacagcacaagactgagaaactcacagattggaggaagccaaagagacatcatggctgagatcatggtggtggaaccctggtttggatcctggaacagaaaaaaagaacactaagtggaaaaactgatgaaatataaataacataataaaaatctataatttaaataatg

SEQ ID NO: 244860 - DNA, 585 bp, Homo sapiens
caagaccagactgggcaacaaagtgagaccccgtctatattataaaataaaaaaatagttcagaggagaggtctgggctagagatggaaatgtagaagttagtaaatttaaagctgttgaactagaggagatagctgaggaagtgcattcaaatagagaagatgtcagaggagaactttggggttctctcagtggttagagataggatatgaggaaaaacagtgcaggagactaaggaggagctctcattgagttaggaaaatcaagagggatgccctggaagccaaatgaaggcagtgttttgaggaagaggggtgatgggccatgtgaaagccaataggtcacatgctgctaatgggtcaactaaagtgaggactgagaagtattcaccaatttagcaatgtggagctcattggtgaccctcataagagctgtgttggtggaatggaggaggtaaaatcctggagggagagaacataagaatgagagaacagttgacagtgcatgtaaacaactctttcacggaactttgtatttctgaatttttgtttatttggctattaataaaatcatatctgatataaa

SEQ ID NO: 244861 - DNA, 374 bp, Homo sapiens
ggttgggcaaattattacaggggtgcctgtggctgagatctagtttccccattttttctgtcgataacatttttatcataaacctggagcaatctgagcagtatcttttgcttaatcatcatcagaaagaatactttaacatctcttttctgaaattaaggccaccgtatttgacagatgccttcctacaattaaatgaatcatatttttgagcaatagtttttaattttccattgtacaaaatggctgctttatagcttttcttcttaaacttcctacatgacaccatccgacctccatccctcttcagctgatgatcatgcctcatttttatggagaaagtaaaagaacttgttcatctttccataatcaac

SEQ ID NO: 244862 - DNA, 407 bp, Homo sapiens
actcccaaactcaggtgatccgcctgcctcagcctcccaaagggctgcgattacaggcatgagctactgggaaggttttctagtttgggttgaaaactagaaataagtaaataatttaggcaaacaataaatatagtactttacaaaatatttgaaaagttcattgttcttaggtcctttcttgcttcctttgcaactttctaattctatatttttgctttatcttggttttatctaccaatctagaagaatatcaaagtttaggaaaatggagcatctcatgagcagtatattacttttcttcttactgtaaaatataggtgttggaatttttttttttttttggagacaggattttgcattccagcctgggtgacaagagccggactctgtctcaaaaaaaaaaa

SEQ ID NO: 244863 - DNA, 283 bp, Homo sapiens
caaaagggccttgaggctttgatccttgcctcttcctacctttgtagccttgtgattgtgtcactggtaggacatgacatcctgtcatccttgataatacgctttaaaattaccccaccagtactgggttttcttttgggatgatgaaatattttggaactagggagaggttgtggttgtacaacattgtgaatgttctaaatgccgctgaattgttcactttaagatggttaatgttatgttatgtgaatttcacctcattaaaaaaattaccacaccagtg

SEQ ID NO: 244864 - DNA, 909 bp, Homo sapiens
actcaatcaggtttttttgagtggtgaactgaatcatgttgggttatcagccgttgagtgtcgttccttttgctatttgttcgttgtggtacagggtctccgtctgtctttaaaaaaaaaaaaaaaatgatcctctgcctgcattagcctcccagttggctaggactacaggtgctcactaccacacccagctcacttttttattttttgtagagacagggtcctgctatgttttccaggctgggctcaaactcatcttcccaccttgacctcccaaactgctgtaataacaggtatgagccaccgtgcctggccccattttgtttatttgagtcttctctcttttctttttttgtttttgtttttgtttttgagacagagttcatccagcctgggtgacagcgtgagaatccatctcaaaagaaaaaaaaagagtccatttcatttagcttttcaaaaaccaattttgttggtcttttctatttattgtctagtctctaatcatttatttctgctctgatctttgttatttccttccttctgctagctttgggcttagtttgttcttcttctagttctttgaggtgttacatttgtttttttgataacttttttcattttgaaggtagacattttttgctataaactttactcttagaactactttcactgtattgcataagttttggtatgttttgttttcatttttgtctcaagactttttaaaatttcccctttaatttattatttgacttaaagaataggtagaatgttctttatatgtcagttaggtttatttggtctgaagtagagttcaagtacaatgcttccttattgattatctgtctgaatgatctgtctgttgttggaattgagatattaaaatcccctactattatagcgttcctc

SEQ ID NO: 244865 - DNA, 889 bp, Homo sapiens
atcaattgtaatgtctcctcttccacttttattttcttttttgtcacccaggctggagtggagtgatgtgacacaacgcactgtaacctcagactcctaggctcaagtgatcctctgcctgcattagcctcccagttggctaggactacaggtgctcactaccacacccagctcacttttttattttttgtagagacagggtcctgctatgttttccaggctgggctcaaactcatcttcccaccttgacctcccaaactgctgtaataacaggtatgagccaccgtgcctggccccattttgtttatttgagtcttctctcttttctttttttgtttttgtttttgtttttgagacagagttcatccagcctgggtgacagcgtgagaatccatctcaaaagaaaaaaaaagagtccatttcatttagcttttcaaaaaccaattttgttggtcttttctatttattgtctagtctctaatcatttatttctgctctgatctttgttatttccttccttctgctagctttgggcttagtttgttcttcttctagttctttgaggtgttacatttgtttttttgataacttttttcattttgaaggtagacattttttgctataaactttactcttagaactactttcactgtattgcataagttttggtatgttttgttttcatttttgtctcaagactttttaaaatttcccctttaatttattatttgacttaaagaataggtagaatgttctttatatgtcagttaggtttatttggtctgaagtagagttcaagtacaatgcttccttattgattatctgtctgaatgatctgtctgttgttggaattgagatattaaaatcccctactattatagcgttcctc

SEQ ID NO: 244866 - DNA, 352 bp, Homo sapiens
ctgttccttaaagccaagaactgtagagtcattcattttccccctacacctagcccagctctggactcaaaggagacagccatgaagatgatgaaatcacaacccctctcagatcctcaataccacatctccatgggagcactgatattttcgattaccagcacctggaaatacaatcgttctcaaggaggattgattgacagatttagcaaataaaaatacaaattgactgggtatggtggttcacgcctgtaatcccagcactttgggaggccgaggcaggtggatcatttgaggtcaagggtttgatgccattctggccaacatggtattttagtctctactaaaaata

SEQ ID NO: 244867 - DNA, 188 bp, Homo sapiens
tctttaaaaaatacaacggaggtggtacatgattgggattagtcacatagatgccaagtaatttagacccaaaggcaaattctgcttctgccgtgaggagctgcgtgactaaggccagttactgaacctcaaccacgcaacaaatgttttttgctcacgcctataatcccagctactcggcaggctga

SEQ ID NO: 244868 - DNA, 321 bp, Homo sapiens
ctatgatacattgggctgagatggaggaaactgcaagtagttaagacagaaaaatcaaaaggatagtctcaaataatctcagtacgcatgtcaggaaaacaactagagcccacagatgggatccctggactaatgaattccctggatgaattttggagcaaagactttaagccaaagaaaaggttgagatggcagttcagagtctgcagggagcctttgcaataggcaaatataaaaattaatttgacacttttcccacatcaatttatttcaaaatacccacattcacatagatttgggtcatatcagtagttttacttt

SEQ ID NO: 244869 - DNA, 415 bp, Homo sapiens
aaatattctctgtatgtggtccagcgtggcagcagctaatgggctactgagcacttgaacaggcgtgtaaatttttaaaatttaataaataggcagaagctactattactaggcagcataggtctataaagcatagtacatagctttcacttcccactgcagtcgtggaggttgaattccatgagacttttatgctagcaaatgtggatttacaattaccttttaattcctcttaggccgttggattcttgccagaagcttcctggagataattttaactagtaccttattgaagaaaagttgtcctagctaatgaaagaatgcagctcagcatcttgaagacggggcaagccttcctcatctccccacatcccatagtttcttatacccactgaattaaactgaaaaatgaaga

SEQ ID NO: 244870 - DNA, 545 bp, Homo sapiens
caggatttccataagaacaaatgagttagcgtgtgcaaaacatttaaaacagtgtctggtgtgtagcaagcaaatatgagtattagtcttttccttgttaaaatgtgtgcatctacatgtggtgcacattacaggaagtgtatagtatggattcatattttggaaaagtaattttagaagttatttctgaagtgcttattataatagtgtttcttgaccacatgcttttaaataatgtgaaggcaatgaagtaggcaatattgcttgcacatccccaatttaaacacctgtctgtccctccttccctctctccgttcttttcttcctttccctctctctttattccttccttcattcccttcaaggttgcggattattctattatataaatgtatcaatttattagaatagtttctatgatgtctatgataggttttaaattgtttgcaatagtttgccattataaataatgcccagtagcgctgtggtctgatttaacttgtgaaggtatatttccaaataaatcgctatgattggaaagttgt

SEQ ID NO: 244871 - DNA, 358 bp, Homo sapiens
acattttccagctctataaatactatgttttcttcctcttaagattccacatttccaaaaaccccaaaaacacccaggcaaaggaaactccatcaaaagcacattacgtcttagcactagtcagtcagtgcctgcaccccacaaaccaacgtgcaaaacctgggcgtatgacccagcagtcgtgctccaccactgactgctggaaaaaccagtctcttcaaataggcaatgcagaataagacaaaaataaaataaaataaaatgaaaccttctctgtattgttgttaactgcagtctttattttacacaataacagtgtatttctgatgccttaaagcagttgctatacggatcaaca

SEQ ID NO: 244872 - DNA, 397 bp, Homo sapiens
cacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctca

SEQ ID NO: 244873 - DNA, 460 bp, Homo sapiens
tggtgtggttgtgcctgttgttaaacgtttaaaaatagttctatactggttttcaaatagcttcctgccccagcctgcccccagtgttctggcccctcccagggtctccagatctgcccatggcccagcaactaaagggtttacacctggtgcagcaggtggacgggcggcctctgcactgggggctgcagctgttccaagcagcggaggctcaggccagagcagccgctagagatttaggtcctcctcttgggtgaagagggagagaaaatgaaagcatggggagcttctcattttcacacataaagactgaatttctttataaatatttcctatcattattagtataggtaatattgatttcaaattagtctctttttttaaaatacaaagaactgtattttatccaggttagagctgtaatacatgtgtattattaaacattcaaatgaaacagaaa

SEQ ID NO: 244874 - DNA, 522 bp, Homo sapiens
aactatactcttcatctattcaacaattaacaaaaagacaactctctattcagacttgtcagaagtgcagcaatgactaagaagaatatcaaagaaacagagagtgttaaaggaactcgagagaaatgcctccatcttactatatatgtatctatatggtagaattaaccagcatatgaagctgtgattctagaagtctgtgaatggtgatggaagatcatatcaaaaacaaaaatactattgactcctctagaaggatccagttggcaaactaaaggatatttctcttcctggcagacatagatcttttttagaattaaaaaaaaaacattatgaacatgtacagttaacattcctctgatggctgagtaaagtagaataaatttggatgaaaattactatctttctccaaatgtgcacaagcacaggagaaaaaaaatccagatgttcatgtgaaatggcaatcgcacaaaaccagtgtggtgtgaaatcaaagaagccgagatggattcggcgaacaat

SEQ ID NO: 244875 - DNA, 345 bp, Homo sapiens
tctgcgaatatgatttgaataggaaagaatgggcagatacaagacatattgtgaggggaatctgaggtttgagtaaaagatttcttgccatcctaaaggaaaagagttgagatgaaggaatgagtcataaaattaatatgaagatttttacatctacagtcttaagagtaatcggattttcaaaatttgaccaaaatataagcctcttcagccatcagaaggacactgtcttctgtagaaattgtagatctagtaccttctctgggctgctccttgcctaggtgggtcaggcatctcaaatgaatcttttgtatttaataaaagttatctatgcaactggtacaa

SEQ ID NO: 244876 - DNA, 233 bp, Homo sapiens
tctagattctggaagagtataccagccccttcctctactcagcactgagtgatgccagcattttaatcagttgactttatccagaggctttggaagaggcagtctactgataatgattttacctgcatgaaaatgttaaaagcaactcacgttcaaaatatgcttcttaggatcaggaaagcacctctgtagaagatgaagactgactagaaggacaggaccagggaatttgt

SEQ ID NO: 244877 - DNA, 197 bp, Homo sapiens
aggatcagtcgctattgagtgttttcactcttgagtgcatgcctaatagttttggattgtattgtaaactcggtgaatgatacattttagagactctcgattctgttatgttcctccaaaaagtactgattttttttttttttaaagaagacagttaacatggctagaattaaactctcaattcctccctgccccca

SEQ ID NO: 244878 - DNA, 572 bp, Homo sapiens
tttttttccttatcactttttggacctcaagtgcagagtaattttttttcattgaaacacattgcatgtattatttaatacaatttgccttttctttctgaaacaaatcagatttggacctaagtactcatcaatttctgcaaacaactggtccactacctccctgagaaatttgcctgatcctaaggttggtttaggtgttattctctggttctattgttattataatttgagtaactacttatgtgggtttattgcccattaacctgttgggacctcaagagaaggacatgtttcttgttcgctttgagtctccagcattgactcagaggaagtctcaataaagatttaggtatgaacgagaagaaaattactcagatgcactttgacctgactctcaagatccccgagcaacataagccactcaaccagtgccatctccttctatgtaaaacccagtcagcataatccaggtaaccttacttactatatggtttctctagagcctattgaaatgttaaaataggcctgcagacctttattactgtcggtcagttttttaggaatctatg

SEQ ID NO: 244879 - DNA, 358 bp, Homo sapiens
tttttaaactttcttattgaagtatggcttatatacacaaaggtacaggccaggtaggccaggtgtagtggttaatgcctgtaatctcaacaccttcggaggccaaggcaggaggatcatttgatcccaggaattaaaccagcccggccaacatagcgagaacctgtctctacaaaaaaaaaaaaaaaaaaacctaaaaaaatcacccgtggtggcacacacctatagtcctggctacttgggaagctaagatgggagaatcgcttgagcccaagaggtcgcagctgcagtgagccatgttgttgccactggactccagcctgggcaacagagtgagctcctatctaaaaaaaaaaaa

SEQ ID NO: 244880 - DNA, 521 bp, Homo sapiens
agcggggaacaatcacttaaacttattatgacaagtcaacttgccttggggcaaatctcagaataaagcttctcttgtttaactgagaagtactgtaagacttgtaaggagaactattttcatatggtcataattaaatactcgtgaggaagaggagctttcttattacttggcaaaaaggaaaacaaaaggatatggagcctaaagagactaatgcaacataaagctggacttcaaattactgtgttcatcaaagcactctattattctcaactactaactcacaaaaatgccatacacttaaaatcattttaaaagcctacaaaataggccaggcacggtggctcatgcctgtaatcccagcattttaggaggccaacacgggcagatggcttgagcccaggggtttgatgaacacagtaatttgaagcggggaacaatcacttagttcaagtgattgttcaagtgattgttcaagtgattgttcaagtgattgtcagtgattgttgcaagtgattgtt

SEQ ID NO: 244881 - DNA, 1044 bp, Homo sapiens
agcggggaacaatcacttaaacttattatgacaagtcaacttgccttggggcaaatctcagaataaagcttctcttgtttaactgagaagtactgtaagacttgtaaggagaactattttcatatggtcataattaaatactcgtgaggaagaggagctttcttattacttggcaaaaaggaaaacaaaaggatatggagcctaaagagactaatgcaacataaagctggacttcaaattactgtgttcatcaaagcactctattattctcaactactaactcacaaaaatgccatacacttaaaatcattttaaaagcctacaaaataggccaggcacggtggctcatgcctgtaatcccagcattttaggaggccaacacgggcagatggcttgagcccaggggtttgagaccagcttgggcaacatgggtaaaccctgtggccagaaaaaatacaaaaattacccaggcatggtggtgtgtgcctgtagtcccagctactggggaggctgaggagggaaggtgccttgagcccaggaagcagaggttgcagtgaaccgagatcgtgccactgcactctagcttgggcgacagagggagactatgtctccaaaacctacctaaactataaaatactaattctgcctgaagattctactgctcaaatgtaaagactagtgtttctggacatggcacacagcctcaagtccaaacctggtccagctaagagggacgagggtgagatggggaataaaagccattattagtgcagtcatccacacagctgtagggagtccaactttgaagtctggaagagtactgtaaaagaccccttgctagaaaattggagcttgctggtcaaagttgctgcacaccctgcaccatctatcctgaagactgtaccattctacataagagattggccatttctggtgagataagatcacttccatgttttagatgaaactcaatgcttacagtgtgtgcttccattcccatctctgacttgagttattctaacattgaagtgattgttccccgct

SEQ ID NO: 244882 - DNA, 722 bp, Homo sapiens
ctgcaccatctatcctgaagactgtaccattctacataagagattggccatttctggtgagataagatcacttccatgttttagatgaaactcaatgcttacagtgtgtgcttccattcccatctctgacttgagttattctaaaactttcaacttcctgatgagtttaggcaagaaatggcttggtgtgccaggggcagttctaatgtaagttacaaacatttatgccttgcccatgtgctagtcctgatgctggcctcaggcacacaacgctgggaaatgttcaggctctgccttcaaggatcttgaaatccatctatggagctaacagaggtgttgctaaccccttctacacacatggacccctctagattcttactcacactcagccagctaccgtggcctgtgctcccaagagcaaatgatgcggactcaggttagatcaagggagagccccacagtcactggctgccttcttctgccctgctctcctcgtccagccgccttcagcctagttcttcctctacaatgcactgtaattcccttcccgatttcctacatcctcacgtgaatcccaaatttaactctctgagggaagacgctcgctatttagtgtactcagacaaaagcaggggggaaaataaagtggggatagttttaacttcatttataatcactttggcttcagttttttaatctgtcaaaaggaagggctgcattac

SEQ ID NO: 244883 - DNA, 485 bp, Homo sapiens
caactctataaaaccaaatggatgaatctcaaaaacataatgttgagtgaaaagacccagatacagaagagtatacaatgcacaatctcatttatataaattaccagaaaatcaaaacaagttatgctgttagaaatcgggatagtggtgacccttggtataggtgagtgctaagagtgacttgaggccgagcgcggtggtcacgcctgtaatcccagcactttgggaggccgaggcgggtgcatcacaaggtcaggagatcgagaccatcctggctaacacggtgaaaccctgtctctactaaaaatgaaaataaaataaaacaaaataaatagccgggcgtggtggtgggcacctgtagtcccagctactcaggaggctgaggcagaatggcgtgaacccgggagacggagcttgcagtgagccgagattgcgccactgcactccagcctgggcgacagagccagactccgtctcaaaaaaaa

SEQ ID NO: 244884 - DNA, 377 bp, Homo sapiens
ctttgcattctgtttatgaagcaaatataacattggtgccaaaatctgacaaagtttgcacataaaaaagaaagaaaatcccagatcactcttatgtattaatatgaatttaaaaatccaaaataaaatgttattagacatatgctgggattacagccataagccaccacgcccggccgagaaagctattttaaaatgtcaaaaagcacaatcccagaaggttccaaaggataattttataaaatcttcaaaacatggggaattgcaaacatagataaaacagaaaatttcagagcacaggaaaaggaaaactttgcattctgtttatgaagcaaatataacattggtgccaaaatctgacaaagtttgcacataaa

SEQ ID NO: 244885 - DNA, 361 bp, Homo sapiens
tttcagtaattataaaattattaacatcaactttcagttatctttagacttcaaaggtagaatttaacctttaactctgtcccaatctgtcatgtaaacaacctaaattaactaccctttgagatcaaaaattaatatcttacaagggtttactcagagtatgctaattctttgaagcttcctgaaaaccaaattcaaattcaagacaattaaatgttaataaatttctagtgatcagagagacaaatataaggaagattaatattctttctccatgctttggagacaggctctcaaagtgatcaaataaaatgttacctttgaaagtgacaccttacattacagtgcttggatgtccttc

SEQ ID NO: 244886 - DNA, 463 bp, Homo sapiens
ttcatttttaaaactcttgtggctcctccattgcttatggattaaaattcaaacagctgaacctggtgtatacaaccacgcaaaatctggcaccagtttaccttacttgctactgcttctcaattttccttccaagattctgaaatttggcaacccagttccttgtcaattccaaacatattagactattaggctccacaccttgtgattattatttccgctgcttcttttgaagacttctcatgttctcactaaatttaacattcctttttcaatatttccacagtactccgtttcacacttggaggaaaaattttttaagtattataagtatttacttgtatgtttatttccatgactagattaagaggtatttagatcctattcaactttgtgatcctgccacacttgtaagaacagtgccaggtaaacatgtgtataataaatgttgaatgaataaata

SEQ ID NO: 244887 - DNA, 322 bp, Homo sapiens
aagtaatctcatatcagatgtattttgtgaaggttttgtgccttacccaaggcttgcaagaaacaggacttacacccaggcacactcagcaaacattgcttctgtcaagctgaattagctccaaaaaattagtaggcaccaggctgactgcagacctactctccattccaatttttaaaatgttagggggagaaagagtgtgtgtgtgtatttatattgttgagcagggataaaaatatcagaggaatatgtaccatatgtattttagaggttgtcatttctatattatgaatttcaataatagttgaatttcgtgtcatga

SEQ ID NO: 244888 - DNA, 452 bp, Homo sapiens
tgttaaattcaaacaccctgggtttggtttttgctggtgggggtggagtggagttcctggagaagcaaagcagtcctaaatcaccgagttgatgggtcttttgggtgttcccaccagtccttactgatctctacaaaatcccaagttaccaagctcttcaacaaatagaagacagctgtcaaacaccatgggctacagatacaacgggcatattcagccatctttcagaagagtgataacaaatgacttaatttggaagattcactcaagatccaatttgattcatcgcggacatgcctgcacctaagttcctggggccaaagtgaggaggcagcagttctccacccaatcagaccatcatcctctttttgtaactagtatctttaacactccccttactatcctgaaaggtaatttgtggataatattacctaccaatacaaatttcaaaa

SEQ ID NO: 244889 - DNA, 324 bp, Homo sapiens
caaggtcttccttgaggtatttttacttcaaagccacgttggtcaggttaattagcccaattgattgcttacaaattttctttatccgtttaaaaatcagaatcaggcgtgagccaccgccccggtatgatacccctcaccttccctgatctgatctttgggaattatgctttagtgaattaacaggtggaagcacagttctgactttgtttctgaattggaggaagaactgcatttactggagcaaaatgttcttagaatgccccaccccctccggccttcttcctctgccctcctccagccagagtcagcagccactccttc

SEQ ID NO: 244890 - DNA, 394 bp, Homo sapiens
agtgtgtcaggcaatctggactttccagtgatgccacttagatggcacctgtcaaaagagcagtggttccatttctagattgtggatcttcagatacattctgccattttcatttcacttcctgaaagtcagggtcagcttgtgaaaagttgttaaacaacatgctaaatgtgaaatgtcaaccctcacgttaaactttccctgttcagagcatcagatgaagacttcattgggttttatggtggctttctgatttttggtagtccattgaagaagagagtttgaaaattgctgtatactgttaacgattgtctgcccatgtccgcctgaaataccatgattgtttatggaaagtatctctaataaagctggatacagtttggcttggaaaaaa

SEQ ID NO: 244891 - DNA, 442 bp, Homo sapiens
ttttttcccccaggctcctcccttcccttcttttctcccaatccagagtagatctaggaatctgaaatttccaccttggctacaaacagcactgagtctctttgaacagccttgtccataaatcttagattgtttttcatctttgaaaaagttacttctggcccagcacggtggctcatgcctgtaatcccagcactttgggaggcagaggtgggcggatcacctgaggtcaggagttcgagaccagcttgaccaacatggagaaaccccgtctctactaaaaatacaaaattagccaggcgtggtagtgcatgcctgtaatcccagctactcgggaggctgaggcaggagaatcacttgaacccgagaggcggaggtttcggtgaactgagatggcgccattgccctttagcccgggcaacaagagcaaaacaccgtctca

SEQ ID NO: 244892 - DNA, 268 bp, Homo sapiens
agaaaagagcgttgagaaatcagaaacaagtaaaccaacacccagcattgtgtctgcattttggatacaagcaattcacaagtaatgttttcagattccagagcaatccacactcaggaatattttgcagttctgacaaaatgaattgtcttataatgctttcatcattgattctgtgttattcagttcttgctgtacatacctgccttagagacactagattcaagaatgttccaagaaccagatcatcataaataacaaattcata

SEQ ID NO: 244893 - DNA, 516 bp, Homo sapiens
tagttctggggtgttgtggactagattaggaacaatctaggctcctctttaatataagactaagaaacaaacaaacaatacaaaccccgctgtatgatgatagttgatagattgctatatatctttaatatatttattttcagttaaacatagtaatatatgatcttctgttcttcaaagcatttcatagctattatcaatgaatattatttatagggtgtagagaaagaaagatatagatatgttgataccttgcaaattccgaagaacttctctagtactgaactatctcaaaaagggttttccagatgtgaaaaataaatataaatgttgtttttaaggtgctttcatagatttttacttaatcttgagtcatttatttatttctaatttttgtcttgttatcttggggtaaacggaactaactaaaactttctgcaaattttacaaacctctgaaatttgaacatgctagaatatacccaagaatctagtccaaaactaaacgacctgtagt

SEQ ID NO: 244894 - DNA, 674 bp, Homo sapiens
ttgtatgtaagaaaacattgagtcagaagagagcgttagtcatagggctactgaaacacaagctgtctgcctacggaaggctccagagtccctgacgcatatttatatctccacttcactgaagtcacaaggaacaaacacacacctgccatttcccaaatctcataaaacatataaatggatgagaccaaagagaggcatgagattccattcttatggttcacaggaagcacctggcacacagtaactattattaatttctgcactggaggcatcaggaaagccttcacgctatagggggcccttttaagttaagaagttggagagcaagcctcggggaaagcaaagagataacttagtagaatggagcaaccatacgggaacagtgagagtccatggatctccctgggctaagatcatgtatggatttggcaatctggggtggaagccacatgtgctgttattaagtggaaatgtctcgtgaacatgtggaaagtgatgactggaacttcagatgaaagtcaaagctggagataggagattcagaagtcaccccaccaaagaaggaatggttaaagctataagaactaatgataatccccccatactttgctgactctcttttcacactcagcccgcctgcaccccggtgaaataaacagcctcgttgctca

SEQ ID NO: 244895 - DNA, 254 bp, Homo sapiens
ctcagatggggtctaggaaatattgtttgcagactaccagccccagtgccacagagcctttgaaaactagaaactagaggtatccacaggtgctaacaaccagttctggtgaggggtattcgatgaaataaaatgtgtatgtggttggtaggaatgtgaatggattcaactttgtgggaagatgatttggaaatacctataaaaagtttaaatgtcaattgtctttgacccaacaaatctatgtcaagaaattt

SEQ ID NO: 244896 - DNA, 372 bp, Homo sapiens
tctgttgttgtaacccttaaaggaatgatgactaatgctttgaggaaacagcagacgtcagacagcaagcccagaaaaacctgccagcaccaagagggtgtcctcaacaggcgcctgggggacatattattctaactaaagagaccagagcttccccaggaagggaagaggagagaaatgaagaacgtctgtgttcatgtttgccaaaaacaaaagtctgagaaatctctgagagactctacatgggaggtgaaatttaccttttctaagaccattgttgattttccttttacccttgaagtggactgaaatatcactaatggtgagaggaaagctcagaggttctattaaagaatgtgaaataggttaaag

SEQ ID NO: 244897 - DNA, 404 bp, Homo sapiens
tcaccgggccaccgagtgtggaccccgcctcacttgaacgaccaagtctacaccgaccttatatccgccgcacacgcggaacttcccatccctattatctaaatccgcatccccatctcaccggacccgaccccccagctctgacacagaatcccccattcccacagcacattttacaaagaagtgcacaggtgggcctagcagaagattccaaagtctgaccaagcagttacagcaagcaaagaatctttgtcaccatcaatcatgaatctctcccatgatcatggccacatcgtcatacaacgggacaaccatggattggactctaaatgttctcattggttttactaaaatacctattttagcctcagctaaataaataacaaatatcataattttcattt

SEQ ID NO: 244898 - DNA, 395 bp, Homo sapiens
aatcatttgtatatttcttgtgttcattgtggaatcgagcaccatgttgaatgtttgttgattgacaagtgtttcacctttctttcttcctgtcagtttaggttttagccagtgcattattataagccagacaattactggagttactcgaagcaacagaaaatatgctcccaagttcaataagcaaaagcaatagatctaaatgacaagcaacatgtatcaaaagaggccacacattcatctttctgtgtgatcaattttgggcagatgtgatactacttttcttgtaaaacaagcagtgatttttatgttctgcataagggttgtattctatttctacattttgaatgaaggtaggttttacccaagtttagtaatgatagctacgtttattg

SEQ ID NO: 244899 - DNA, 502 bp, Homo sapiens
atgtccacattttagtcttcttatgctataatagaaacactaattgtttttcattctctagggaaatttttgtttcattaactttaaaaaaaaaaagatatacacacatttttaaaaactgatttggataaatgctctcattcttggcttactattaaagtagctcaaatttttaactctttcaaaattgatatatttctgctgtaatttcctagcctaactaataatgcagaaaataagcaaattatttgggaatttatcttggcaatatttgcttaagaactgacgatgccgtaaagccaaatatgagacttttttcctgattattaattttactttaattcaacaaatatttcttgagtggtttttatctacttggcattgttatttttaaatggttttataattatatcccatcttaaattgcttttaaaatattaattatagctttgaataaatttcctttgcatcttctttgttacttaaagaaaagtctttaaaa

SEQ ID NO: 244900 - DNA, 342 bp, Homo sapiens
ccacctgagggcttttgctcttgccatttcctctgccaggcatccatgtggcttatctaaccatgccattcaggtccctgttcagatatcgccaagcaccatccttccctgacctgcttctagagtagcagcccctccctccaccatctctcagccagactctccctcctgccccctggcctactcaggatatgtgtttgtgtgtttatttgttgtctccctcagccttgacagcagtggcatctcatacactatcatgtccatgcctagcacactgcctatcacttggtaagctcacagagaagcttgtttgaagaatgaactcattttggagaagacaaa

SEQ ID NO: 244901 - DNA, 445 bp, Homo sapiens
tagctcaggaaggtctccgttaaacactaagaaactgagatgcaatcagctggcctggaattcaggaaagtgctggttctgaaattgaggacagaaagaacatgtctcggggcgagaagacgtgaacctgccaaccagcctgtgttcttcttccacctgtcctgccacgtgttctgccacgtccatgcctcctgtcccgccaacaccccaggagttggcagattgggaccctactccgtggggaagggaacgctcagtgactgctgccccctgctcgctggcgtccacccgtaatctctcagttgtggtctcaaaggccaaacatgaaccaggattttccattatggttgcaattttggcttgtaattttatcactcgaatctaaatccacttcagaaatgccataaactaattgtcactgaataaactgaaacttttgaggagt

SEQ ID NO: 244902 - DNA, 414 bp, Homo sapiens
cagcataaactattacagctaactattgatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtccta

SEQ ID NO: 244903 - DNA, 777 bp, Homo sapiens
  misc_feature (21)..(21): n is a, c, g, or t
ctcaacgctttatacttccanaatgacacgctttgatctcaacgctttatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggaggggaagccagagtccactttgtcacaattcatttctatgaatagaaaataaacacttattccagttccaagaaaaaacaagagaaaaaaaaac

SEQ ID NO: 244904 - DNA, 852 bp, Homo sapiens
  misc_feature (21)..(21): n is a, c, g, or t
ctcaacgctttatacttccanaatgacacgctttgatctcaacgctttatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtccta

SEQ ID NO: 244905 - DNA, 1326 bp, Homo sapiens
gagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccagctaatttttttgtatttttagtagagatggggtttcaccatgttggccaggatggtcttggtctcttgaccttgtgatccgcctgcccgccttggcctcccaaagtgctgggattacaggcgtgagccaccgtgcccggccaagaaggattccttttttaaaagtttacagaacttggagaaacttcagaactaaagactaactgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctattttttttttttttttggtccctatagcttctttctagaaaaagaggcaaacgtgccttgaaaagccagagtggctcataataaaaggaatgcgctagatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggaggggaagccagagtccactttgtcacaattcatttctatgaatagaaaataaacacttattccagttccaagaaaaaacaagagaaaaaaaaac

SEQ ID NO: 244906 - DNA, 474 bp, Homo sapiens
ttaaaatgttttatttttaatttttgtggctacatagtagatggatatatttatggggtgtatgagatgttctgatataggtatgcaatgtgtaattatcttgtcatggagaatggggtatccatcttctcagtcatttatcctttgtgttacaaacaatccagttatactcctttagttattttaaaatgtacaattaaattattttgactacagcaccctgttgtgttatcaaatactggatattaataatcacattatgcagcatggggtatctgtccctcaagcgtttattctttgtgattacaaacaatccaattatacttttttagttatttaaaaatgaattaagttattattgactatagtcatcctgttgtgctatcaaatagtagatcttattcattctttccaacttccttttttccccccattaactattcccacttcccctgaagcacccaatacccttct

SEQ ID NO: 244907 - DNA, 427 bp, Homo sapiens
acaatcctttaaaaatgtaaaaatcttcatagttcctaggtcatacaaaatcaggctgtaggccatatttgaccatgggcatcgcttgccagtccctggtatagtctggtcaaatcttcgaaggatcatgtatatttggaagccaccggggaagcaaggagcatctgcaggaaaaactcatgccatatgatggagtcctcattgaccaacgtctgtgctattgaagatgtctgtgcttcttttgaaagaccaaatctctaagcaccagcagctatgcagaggaacctagaaaagatatggatgtcccctttctccccacagcttagtggacatcacttctcagaaacccagacagtggatgaagagaaatcttcaaaatgtacctttaaacatgaatgcaattaaatattttgaacttggctggaaa

SEQ ID NO: 244908 - DNA, 544 bp, Homo sapiens
tttttcatggccctttaagggccactcattaacatgaatgccttatcattcattggaatagaaaactgggaggctttacttttagttacaaaagttaatgtatggaaaatacattaataaaaccggcttagcttcatttttcctactttcttgtgatatttttcttagacttgctattgatacctcagataaatatccagcagtttagagatgtggaaaaaaatatggcagttggaatcagagaggcccaggttccagttcagattctgctttttcccaagactttggaaaagccattttctaaagttgctttctgtgctgtgtgtctataaaatgagaaaaatgagtgattagattcttaataagttgcaactggtattgttgtctaggttgccttctgaattatgtaaatataatgtgcctccattgcatatttatgacaatttataagtgtttaaaaaagaaggggattctagttcattaactgcgaggttttagagtgaactagaatttgaagaatgacaaaactttaagaggttgccaa

SEQ ID NO: 244909 - DNA, 237 bp, Homo sapiens
gattgtgagctaagaggcctgggactttccccctgttgctgccagccaggttgatgaccctgggcaagtctttttccttaccaggtctcagtttcctcagctgtaaaatgagaggttgatctggatcagggatagtaaatgggcctttgttcagttactgactgttgtataacaaaccacccccaaatttagtagccttaataaacatttattagctcctgagtgagtggcttggca

SEQ ID NO: 244910 - DNA, 372 bp, Homo sapiens
atctccatggcaaaattaggagggaaaaacagcatggatgaaagttgcatttattaaataataatcgcgaacgctcacttcatgcctactgtatgctagctgctgttccaagtgttttacaatgaaataaatttttaaaatttttgcacaactctttgagataggcactattgctttcttcattttacagtcaaggaactgaggcacgagaaagttatgaagtttgtccagggtcataaagctagcagatgagggaactagactcaggcagtataactccagctacagtcattacaatgagccacacaacgcagtgggtcaaggaggagccactcacacaaagatcgtcccataagattataaccgtatttt

SEQ ID NO: 244911 - DNA, 456 bp, Homo sapiens
tggccctatactcttaaaataaatgttacagtcatgaaagacaagaaagcattctgaggtactgttccagattaaagaagacaaagaaacatgacaaattcaacacataatcctggattggctcctgaatagaggacattattgtgataatcaggaaaactgtaatggggtctgtggatcagataatactggatcaatgttataataatttcctgattttgatattcatactatagttatgtaggagagtatccacttgttttgagaaaatacacaccgaagttttaaagataatggggcatcatgtcttcaacttattttcaaatggctcagaaatatgaattgaatctgggtaatctgtgggaggatgtatgggagctctgtatactatttctgtaacttctacaaacatcttaagttacttcaaaataaaatttctaaaactgcttcaaagta

SEQ ID NO: 244912 - DNA, 311 bp, Homo sapiens
gagatggaggaacagtgggtagagcagtcagaacgcacagaacacttaacaaataaagtctgccctcttatctgggcatggtttgtggtaccccaaaacaattacaatagtaacaggaatgatcactgatcacagatcaccataatagatataatgataataaaaagattgaaatgttatgaaaattatcaacatgtgacaccgagacacaaagtgagtaaacgctatcagaaaaaatggtgcttatagatttgctcaatgtaaggttgccataaatttcaatttgtaaaaaatgtaaaatctgcaaagtg

SEQ ID NO: 244913 - DNA, 440 bp, Homo sapiens
aaggcctcacagagaagatatttggagagagacccaagggtgtctggaaagcagtattagctagcagtattataggagcatgtgtctagaagagaacaaaggcgtgcagtacctcaggaccctggaacagagagtaggaggtaggggtctagggaggctggtctattgaagccagacccttttctctgagccataggctgtctcagagccaggtcagctgcactgtaccatgaactggcttattggatccagtattctatccaaggttactgagttggtttacattattccagcatttgagacgtggggtaggtagaagtatagttggaaacagattagtaatggattgaagatttttgatgctgaatatcaagtatattgggtatattatactatactattttacatgtctgacactttaataaagttatttcatcata

SEQ ID NO: 244914 - DNA, 642 bp, Homo sapiens
aagagggcagagagtgtattctggaggccctaagtaacactctgtttttaaggggacaattttgatttcactagtctggtagctcagtgatacagaaattgactctattttccaggggtacattctttccccactaaaatattatgaaaataacccaaactttgagtgaagttttggccttcaggaaacaatttccaagtgtgctattgcaataaaaagacactcatattcttaaaggtgtccaaaagaactagttcagtttaaactatgtccctctaacacttccagaaataatgtaaattattgagactaccaaccttcctaataaaccttgaaaagtatccgagaaggttaattaaaatgaggaaggacatggagtaatttccatactgaaacactcacaataaaaaatagagtcttttttttgagacagaggttcattcttgttgcccaggctggagtgcagtggtgtgagccaagctcacaccactgcactctgtcctgggcgacagagcgagactttatctcaaaacaaacaaacaaacaaacaaacaaacaaacaaacaaaacatcaccaggcgtgagctctgggcagagagataataaagctgggtgacagagcaagacactgtctcaaaaaaa

SEQ ID NO: 244915 - DNA, 342 bp, Homo sapiens
  misc_feature (13)..(13): n is a, c, g, or t
  misc_feature (15)..(15): n is a, c, g, or t
ggatccggtaccngntaccgggccctttccacctccgcctccatgttcactcaatttctgctcatcctttaagcttggttcagtggtcaccttctctaggacccctaggctgagtgaggggtcctttcaaggcatcccttaatatgaaacctgcccccatattacccgtttacctgtctgtctcccccacatagacaggactgagttttactcaccgtcacatcctcttcagccctgaacacagaacccagcatattctcagcatattctccagtctcgaaactttggaaaagcacatctgaatacatttaaagataagatctgttccccataagggccatg

SEQ ID NO: 244916 - DNA, 369 bp, Homo sapiens
acagcatgaatttaaaccaaaatgaaaacttacccttaccacctctaccttgcagaatttcattaacaaaaatgatctacaggacttaaaagagaagtgatattactgaaattagcactatatgttgtaggctcttaaaaacatatgtctgctgagatgtggtcaacctgattgtcaggccattgaggaagtaaaggaataacaagaaaagaaagcacagagtgtgggatcatggagaccttggaatttatcccatgtggtattcctccaaggattccacagagtctctagtgacctcaggagtatgtgcagtttgctccaacactgaaaactttaagaatagacaggaatttaagcaaactcacaaga

SEQ ID NO: 244917 - DNA, 427 bp, Homo sapiens
gctctctgtattaaatcccctctgagtatctagtagtttttgttgattggtagaaatagcatggtcaggaatgccaggtactgcagaaagatggaagggatggaaatggaaaatggtcagatctttgagcaatgggggtagagcccagaattccagggcttgagaaggggatttctgccaaaccgatgggtgtataccaattctcatgaaggtcttaatttggacctactttgagactgcatactttttcatatttatcagacagctgggtacagtctgtttttgaagtgctttttcagctttagctgtcctccttttttggttttctgacttttcctcattgatttggagttctttgtatattctagatatgaatcctttatcagttatgtgtgttacaaatacctattctcattccagagctgct

SEQ ID NO: 244918 - DNA, 296 bp, Homo sapiens
cctgctatttgcaagcatctgttaggatggccataaaaggtactttctctgtcctcaagaatcttatagctgttaatagttagaagatagactcctacttcaaaatccttccatgtcatagaaacttccaaatcattgatctcctatcagatacgttaatttcaaatacttttgctaccaggccttttcctggctttacttgctactttttttttttttttttttttttgaggcagaatctcctgagatcgcaccattgcattccagcctggtcaaagaagcgagactctgtctca

SEQ ID NO: 244919 - DNA, 133 bp, Homo sapiens
aaaaaaaaaaaaaaaacccacaaacctaagttcacacacctagaaattccattcacaaaaatttatcatacatgtataactgcacttgtctgcaagagtacaaaattgcttactacaacactgcttacaatat

SEQ ID NO: 244920 - DNA, 776 bp, Homo sapiens
gtttcatcagttattactatctgaaacagtttttgtttgtttactctgctgtaggaacgtaagttccaggagagcacagactgcctttttattaccactgtagatgagtgcctagcacattgtagctacctgtaactcaaaatacctgtattagatatacccgtattataggaactgtggaagtaccaggttaaatattggtcattaacaaaggtgtttgttagggagagagtacctgttataaagtttccagcatctccacataattgccatattttaaaaatgtgtttataatactttgtctgtaatatatttgactttaatgatccatgttcataaatcagttaatatgagacatcttttgaaatgtgacattcaatttttaaatttgaaacttgtaaggtttttttgtttgtttgtttgtttttgagacggagttgtggtctgtctcccaggctgaagtacagtagcatgatctcagcctcccaagtagctgggattgcaggcacccgccaccacgcccggctaatttcttgtatttttttctagagacggttttggccatgttggccaggttggtctagcactcctgacctcaaatgatccacccgcctcagcctcccagagtactgggattacatgtgtgaaccaccatgcttggccttaactttttctattaatataaaaaataaatatgaaatatactcccttactacctaaaataactgaaggattatctttatgactaggaaaaaaactagttttccttctagctt

SEQ ID NO: 244921 - DNA, 970 bp, Homo sapiens
ttttgattttaatgtttaacacaatgaggatcatactgatacctagagttggttctttaataagtctcccattgtaaaaatatgggaaaaaacaaactccctttatcctactatactctcaccacacagaacgcttctgtgaccaaacatggggactgtccctcacacaccaagcaagtgatcatttctacagtggacaccagatgaatgtcctataatttgattcaattttgataatgtctatctggaggtagcatcagatcctacaagtttgagagctcagtcccacaagactgccccccatttgggatatcaatcaaaagtaatacattgtcacctatacctctgactataaaccagggttcccacaaccccctccttgggtttgattagtttgctagagccgcttatagaactcagggaaatacttatctctacctgtttattatgaaagatgttaacaaaagatacagatgaacagccagatggaagagatgtgtagggccaaaggagaaggggcttccatgctctctccaggcatgccatgctccaggaacctccacgtgttcagctatctggaagctctcctgagccctgttttttgtgtttttatggaggcttcattacttgcccatgattgattaaataattggccactgaaggttgaccagttcccatcctgaagctttataggagcctccagccaccagtcatctcattagcatacaagatactcttagcactctggtgattccaacaagggttttaggagctgtgtgtaaagaaaaaggaagaccaaatacttatatcacaatatcatacctatatttttaaaaagagagggctggacgtggtggcttacccctgtaatcctagcactttgggatttgggatgccaaggtgggcagatcacttgaggccaaagttcagtaccagccttggcaacatagaccacatctgtacaaaaaag

SEQ ID NO: 244922 - DNA, 465 bp, Homo sapiens
ttgctctgtcgcccaggctagagtgcagtgccatgatcttggcttactgcaacctctgcctcctgggttcaggcaattctcatgcctcagcctcctgagtagctgggattacaggtgcacaccaccatgcccagctaatttttgtatttttagagacgaggtttcaccatgttggccaaatttgcctcaaacccctgatctcaagtgatctgcctgccttggcctcccaaagtgctgggattacagccatgaaccactgtacccgaactgcacttgccttttatacatgcaagaaatgtgaaggggacagtccccaaaaacccactttgaggatatgttctgaaattagtatctactgaacttcagtctcctaagttgtatatattctgtccaacagtgcaactcgaactggactctgcagaccagccctagtcccagaataagcacagaaactgagagtagacc

SEQ ID NO: 244923 - DNA, 550 bp, Homo sapiens
gtgagattgagacttccctctaacctcttgctgtcactccatgtcatcctctgctctgggtctttcacttgctgctccaggtctttacctgctccaggactgtgcactccctgcactggctctgctcaagaatgtccctgatctcccctggctcagagagtggggcttcagaatgcaggacggacatgtgaacaggctagacagcactctgctatgaaaacaccgaacctgaggagagtctcagaggccctaagagggcaatgtaaaccagaaacacttagggtggatgcttgtggcagggcggtctattcttagtccaggccagtttctagagaggggaggctcagaatcaattaggacagttttggagtttctccttctctcttattgctccaaccgcagaattaaaagtactcctagaggggccaggtacaattgctcacgcctgtaatcccagcactttgggaggccaaggtgggcagatcacttgaggtcagaagtttgagaccagcctggccaacatagtgaaacctcatctctactaaaaata

SEQ ID NO: 244924 - DNA, 599 bp, Homo sapiens
gcatgaagtctgacttcagtgtagcattgaggagggtcctggcctcagatactgcaccagttgtttgttcagctctgggcaagaacattagtcagatcattaggtatttttgtccctttctgcattgtccttcgtcatatatttattaaacacctactgtatcctaggcagtatttcccagggatgcaaagatgaattagatctggttgcttttcttcagagtctgaagttaagtgtcaggtttgtggggaaggttattcttgccttgtgtattttgtcccaacttaagctataatttttgaatttgtaaaaccttatactgtttagaaaaaaaaaaaacacagtaaaaaaaaaaaggatgggtgaatgcataaatttagtttttgaaaatttaagcgactgtttctccaaaatgtcacttttcatccccagtttgccttttgtctgaaatgcaccagtgaagcaatcaagaagaagaattgattaattttgtgctgtatgcctttcagttctgtattttgtttgtgcttcaaactgtgacagttgaaatttcatggtaaaaaagaaaacggttttgaatttgggatatagagaaaaat

SEQ ID NO: 244925 - DNA, 418 bp, Homo sapiens
gcatatttatccattgttttaaattactcattttgttataatgttgtatttttgtgtgtgtgatgttctttttctttgctagcataaccccagatgtctgcttttaatttttataccattacaaggaatcatgtagtcaacatcaagtttagaattataattttcaaaaatggatcataatcaaaacatatatacattgattagcatttaaggcacgccttatcaatggtaaagaatagtgctatctgaaacaaaaccaagtagcaaataatagcttttccttgtggtttttcccattcagttactaacttgttatagagtcgtgttttatttatatatcagagatgcttgttctgttcatggtcatgtagcgtaaatagtatatactattgttttaataaagcttataattttctaa

SEQ ID NO: 244926 - DNA, 2578 bp, Homo sapiens
agcttcctttgtatgagggctgttgcgcacttccggtggaatgcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaaccttt

SEQ ID NO: 244927 - DNA, 734 bp, Homo sapiens
gtgagtgaggagttgactgggaaaaggagagatccaattcttgttctagtccttggcacatacactctctgggttttgagaaaaggatggtcctacaacgattctaagttgttttctcattggtcctacaacaattctaagttgttttctcaaaggcaaaagcatgatttcaaaatgacatcacttgtcagattttctggtgtatggaaagatttaataatcctgcctcttttgaagcctgaaacttacaatttaaagcctgaaatctaccataaggaacttggtaaattgtgtcagataccatgaaaatgcatcttttcatagttaaccacagattgtttatgtaaaggcaaattggtggtcaggttcaaggtaaaatggattattgggttgattagtagccaaaaactaaatgcatgttcaggtcaaaatgaatttgtttgttttagttggtgccattttccttttattattcagaactacagagtgtgcattttattaataggaatgaaagctcatgcttgaggatttgaatagggtggatgtatatattttataaactcaagttgcaaaatatgtaaagtcactactttttaaatagaatataaatgttaaaacagacaaatctatgttatatattttttaatacatgtatcagacttgttagttgaatgcagattactttgctttatggaatttcataacttttaataataaagcagttgttattggaa

SEQ ID NO: 244928 - DNA, 441 bp, Homo sapiens
gcataaaggttttgtaaagcggattattttttccttcagttttcatttgtgacctgatctgtataaaatacagtgtcatgctgaaaaccctatgtaattaaagccatgggaaatagagaattttaaaatccatgactcattcacctgctgcagtctggcccacacctttactaagtgagatgtcagcttcctaactgaaccacatgtgtatgtgaagtctagtaaaataggttgtgagtcagtttttattatgatatccatttttagttactggtagccattaagagagtttctcaggcattcagaaaagtccatcccttagtgaaaaggtttggtctctgagagaaggacctagtcatttgagactcaatttatttcaggagtagagatccattgatcaatgatcactgtaaagcataatagccctaaaatacatacact

SEQ ID NO: 244929 - DNA, 334 bp, Homo sapiens
ttcccaaattcatttgtctgtaggattctttgtttgttgaatagcatcaagtagcatctcaaggaacaccctttgggaaatgctgctgagagaagctaagaacttgcttcacgatcgtcaagcactgaaaaggattcatacttgggaaactggcaaactgtttttctgaccctgacccttgccagtagtataatcatgggcaagtcacttgatttcttcacatgtaaaacaaaatgataatatatcctccatggacagccatagagagaagattcattacaaaatgcatttacggtaggaacagaagttgacaataaaagttaatattgtcaca

SEQ ID NO: 244930 - DNA, 660 bp, Homo sapiens
ggagctaaagtcatgaatgacagctatctctcccatataaacacttctgggacattgaccaagtcagcgtaattaggctggatggtctcattctgtatggcacttccaatttcatttatcctgaagtatctatacctgtgagtctatctcagttattacccttgagcattatgtaatatagctaagtggatgctctctttggatgaaaaggaaaataaactaattctaataaacttttagcactattttgtagaattatagttagccaattcactaacttaactcttagcattctaaaagcaaaataagtgtagctgataaatcccttatcataacacaccatgccaccacgatttcacaccctactaagaaccaccctatgtctcaaagtctactgctcaactgtatactacactatacccaagtgtagtaatgtggcacatcaacctttcttggtaggaggttttttaaaaatccaacactgccagatgaaatgtgaatttggactcctgatcattcctttaattatgctatcaatcagccattaccaccctcttcttctatcacagtactatgcttctccttaaaagcactacaaacattactcagtcgctcgccaggcgcagccatataaagtcagggacaagcctttggctgctg

SEQ ID NO: 244931 - DNA, 839 bp, Homo sapiens
tgatagatatgtattttttatttcccagaacctatcacaatgcctggcacagagcaaatactcaggaaatctataacaaataacattacccaatcagtaaattgtcagtactgtaggaattgagaggaagaagtagtcacatgcatttggggctgtaagagaaagatttaatagaaagatggcagtggcatttaagatgcacaaattattaaaattttaactattacagtgtagaagtctaggtagagggaatgatttgtacagtaaagtagaagtggacagagtaatgctttttgtttttgtctgtctggacagtagttggctgtaacaaagtttgtgtctaactaaaaagtacctgttgactcagatagccacagtaagagactagaacgtgatggcataatggtgacaaaaatgagttcaaatctacagtccaccacttcctagttggctcaccacttattacctacacttaatttttgctacctaatctgtaaagtggaaataataaaatacatatctgtttactgagagatgaacaaactatttggtttcttccagactctcagtaaatactctgttcagtttttaatcctttattttgtaggtataataacatgtaataattggtaaaggatcattaaataatgtcttcaagtcataagaattgtactttgaaaaactaatttggcagaaggggtaagtaaaaggatgagaagtctgacatggagaaaccagtataatataatgaaagtctgaagtggtgtggtggcaataggaaaagaaaagatcaggatgagaaattgctttaaaaaataaaagtacattcttcataagca

SEQ ID NO: 244932 - DNA, 592 bp, Homo sapiens
ctttatgatctttgctaatctgaaagacgaaaaatgttattttgctattattttaatctgcattttaaaattatgagtaaggttgagcatcttttcatatattaaagtcatttatattttcttcccttttgaaatgtttattcatatccttagcctttttttccctgttagagtactagttttttccatattgatttataaatgttcttagtatattaacgaaaataaccttttgatgtatgtttttaaaactgttttttaccaattgaccgtttgttttgtcattacatttattacagattttgagtatcctaacatagtaaaatttatcagtgttttattttacagtgtgtatggctctatgacctagaaagacctttttggtgcagaagttataaaaaaatattcctatgttttcttctagcatttttatggtttcagtcttttttatgtatgataaaaatcatttgtatatctgaaacttacttggcataaggagttaaatagggatgcaacttaattttttttctcagaaggatacctggttattatatcaccagttatttaaaaaatcagcctttccttattgatt

SEQ ID NO: 244933 - DNA, 416 bp, Homo sapiens
  misc_feature (413)..(413): n is a, c, g, or t
ctcagcgatcttgtgtttctcgaaaggtctgcgcaacaaacagctgagtgggcttcgcccagcccagtctccacactgcgggaaaggaatcataaatcccagatagaagcggagccggcgccacgcattccactttttgaagtccgcagaccgacggcactggcaaattcctgagtccagtgctaacgctgggtttccacagtttggacaggggagtctccccggagttccctggccctggtcccgcacagtccgggcctgaatcagcgtctaggctacttaggagctactcccacttagctctggcaacaccaccttcccttgcgtggggggaagaggacagtgggtaggtaggttagtgtttcagcctccaagggcaacagagcaagaccctatctcaaaaaagcaaaaancca

SEQ ID NO: 244934 - DNA, 707 bp, Homo sapiens
gggagagtaaaacttatggaactttgtaactagaatacaacatagaaaccataataatcccaataaaaagacacttgcccagttgattcttttctaatgtttgtacctaaaatcatagccattgagttctttgtggcctcatatcccaggcctcatcctttctcccttgaaatggagactggggatatttgtatgatttcatcaaaataaaatgcttcattctgtattttaatacatggagaaaggtctaagcacattagttgttcaggatgttaaaccaggcccttgttgcactaaaagaaaacacttctgtggatgttgtgtattagtatcaagatctttttattattattattgcaagggattttccatttaagtgtgagaaaaaatgcccttcattgtttcaaaacatcaatatgctggggaaaactgtgcatgaactaacacaatttctttatcgtaacaacattatttcattttcttatttttcagtcacatatgaggttatttgcatcaaagaaacatagtttttagtgaaacaaagtggttatataggctacttatatatagtataatacaataatcaggtatctgactggttaagtaaaaaatgcagtatgctctttttattgttatatttttccgtttttatagatttctctgaggatttactgtaccactctaagccattatttgtcagttattta

SEQ ID NO: 244935 - DNA, 353 bp, Homo sapiens
cggcacgagggaatcaagagggcttcttgattctccaccagctctcatgagcggtttccccactactgtatccctctccagaaccaggggaactgttgtcactgaagtcttcaaactgtaaaggagcatggagatgcgtaattaaaccctggacagaaaagcttttagcgagctcttcaccgcatctgttctggaaagcctgagtacctgtccacacccattttattccgttgagaaactaggtcaccgagactgcagaaatagaagcccttgttgaacccctggaatgtttccttgctgaggctaaatgagagatgggccgaacacacaatttttactcagaaaaacttaga

SEQ ID NO: 244936 - DNA, 463 bp, Homo sapiens
ctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccaaatagacttcttgacgtgtattattaaatttaatccaagacaagaggatagagggattacctttttatggctaaggtaacaatattgctaatgaataaaaacctgtatatgttgaaagttacatggctattataaaaaaaaaccaaacaatccatactgtctctcaaccagactactgtggagctttctcatt

SEQ ID NO: 244937 - DNA, 563 bp, Homo sapiens
gaaggaaaatccaggtgagtctgggtttccacttcaacgacaagttagggagaggagctgagagtgagcgtcgagagctgtcagagcgggcattgaagaccgtggtgaggagttggaggctggttgtaaagtcatgggaaactatatccaggcatcacccagatgagcagggaggaggaatggatctgaggggcactgtagagaagggacttgggggatggattgtctttggtgtataaaaggaagaaggtgtcaaagaggatccaaggcagcagctctacatccttgttgagtccagaacccctgtgtgacgtgcaactgagaacgcgggatgcttcccccagaaaatgcacacaacccactcacaaacatcagcgtcattttgggggagttgcttggttcaagattaaggtttctcgccctgtgaagggcctgaagtggtgagaacatcggcatcctgcgtttggcttataggactctcaagacaattgtatatttattttcagaaaagaaaggaaatatctctgaaacttgaaattaaaaaccttatttattttaatata

SEQ ID NO: 244938 - DNA, 408 bp, Homo sapiens
catttcattaaaatgtgtcctctgtcttgacatgggtatcacagggagttgaactaactggttcttatttacaaggccccaactgttcttaagaaaaatgttagggttcccagaaacataagggctttgaccatatcatttccaggacaagatcacagacataatcagtgccgtctgtttaaaggctttaagagccagctgagccaatttagcatcaatttagtacaatcagcaactaatgaaagagaagtcagggtggccataaaatgatcaggattgctcatgttggtgtaagggatcattcagttgtattctgcaggaacaacccgtcatcttgaatatcagcaaaaagctctatttagagacaattacagtaataatatcaggttataataccatgttcacagg

SEQ ID NO: 244939 - DNA, 430 bp, Homo sapiens
agtattgccaaagcatgtgatagttttgagatgctgacaaacgtgaaccatagacccatgttttccttaaacctggggtttatctttatgtgtaaattacggaataggagatgctagccttctgtagatgaaaggtaggattgttaaaaatgccaacatctcgataagaatgggtggagtgtacaaattatgtccttatttatggaaacattttaaggtaaggaaaaataattatgccatgtggaacccattatgccagattctgttttcatacaccaataattctgtataagaagcaaatgcgtagtttatgaaacaacatagtgttaaaaacaggaggctgggtcttcagtctgttgatggcacagtcctatgatagaaaaatatcttccttctgccaaaatagtttaaaagtaatggaaccaaaaaa

SEQ ID NO: 244940 - DNA, 701 bp, Homo sapiens
gattctcctgtttaggttttcttgctgtcaagagcccccaaagactgtacaccaggaaagtgctgtccttagagtcaaggttttcactgaagggggcacatgaccctcctggctgactttgaatacacgatcaagtcctcatgaataatgaatactaatgacaatatcaaaacacctatttgcattgtacactcactaaagtcagagggagaattggggctgctcccacaaaagggcacgtgactctctaaataaagagctttaatgcattttatatttaaaccataaggccatgggctcaaacccaaactgagatgggctctgcttcttaagtactattctggaaaggcattgaaatatttatccatctatctgggttctgtgtttctaaagcagttcctttccttgtactgcaatccagagtgggcctgtttgcaaatcccctttaactggagagtggctgcccttcagaagcaaaaggagtcctttgggaaagtcattgtctatgaaacttattcaatgagaactatgaagaacagcctttttttatttaaatgcatgtaattcaaagattgtctactctgtgcactgactgggtcaaattcttactttcactgctccatctctatgtggccttgggcaagttgtctaacttctttaagccttaggggataattgttcctaaattaatagtattacca

SEQ ID NO: 244941 - DNA, 787 bp, Homo sapiens
gaaaaaaatcgtactgtgggtcggtgtggaaagcttttggtcttcttgaattttactcgttttcacagagaaggaagatggtgtgaagcattctgatggactccacctgtttttaggtgccaagataattaagctagagtagttgcatttaaaacctaaccatgaaaataaaatgaatacaaagaatttctgtttggtgtcagagctaccttagaattagggaactgtgaaagaagatcttggatgaatctgatggcagatttcattaaagttgaagttacatattcatgactgattttgattgcaccatttctaaggtcttaaagcggtgggggtggggaggtcttataaccgaataacctactctttcgttctaaaagaaaaagaaatcgtgcttttgttttgacttgaaattttattctcatgctggcccaagagtaaagtctgatacctggaatgtactggcagcaaaatgtactgtttaaaaatctgaaacatcggccaggcacagtggctcacacctgtaatcccagcactttgggaggccaaggcaggcggatcacgaggtcaggagattgagaccatcctggctaacacagtgaaaccccgtctctattaaaaatacaaaaaaattagccgggcgtggtggtgggcacctgtagtcccagctactcgggaggctgagttaggagaatggcgtgaacccgggaggcagagcttgcagtgaaccgagattgtgccactgcactccagcctgggtgacagagcgagactctgtctcaaaaag

SEQ ID NO: 244942 - DNA, 346 bp, Homo sapiens
ccctggggctggggctggctcccagatggggtgttttttatctgtaaaaattgtttttaaataactcattacattataaaaataaagttttggccagaagtgctgggattacaggtgtgagccaccatacctggctgctgagaccgctcatctctcttccttcccattgtagggcaagctggtatttccattctccaggaggactttcctgctttattcaacaacaaacatccattgagcagctatggtttctaagtgtgcaccactgggcttagaattgttgatgggcttgaggggattaatctcaactccagcttgggtgatagtgagactcctcaaaaaaaaa

SEQ ID NO: 244943 - DNA, 319 bp, Homo sapiens
agaaaaagaaaactttggtaagagaaaattgaagctctagatgagtgaaaagattctaacagcaccaagctgccgtaaatgagctcaagtctcctggccaggacaaattacactccagggagtagagagaactcgcctctgaagctgtaaagcctctgctgataatctttacagaacatggagactgtgaaagaaattggaacgctagaaatggcaaaatatagctctgattagtaaagagggggaaagcttctgcaaactacaaaagtggggctatcctatccatcctcattaaattccctgatcagactaaaaaaag

SEQ ID NO: 244944 - DNA, 331 bp, Homo sapiens
agaaaaagaaaactttggtaagagaaaattgaagctctagatgagtgaaaagattctaacagcaccaagctgccgtaaatgagctcaagtctcctggccaggacaaattacactccagggagtagagagaactcgcctctgaagctgtaaagcctctgctgataatctttacagaacatggagactgtgaaagaaattggaacgctagaaatggcaaaatatagctctgattagtaaagagggggaaagcttctgcaaactaccctggagtacttggtcagcgttaaatccttgggtggctggctccccttggctttcagcagtgattctc

SEQ ID NO: 244945 - DNA, 445 bp, Homo sapiens
tttctgcttgggaaatgctcagctgtgcctcagtttcccttagtcttcctctgagctgcaggtaattgagactgagaggctttccacacttcccagaaggggcagacttgatggtgcttcctatctccacgcaagagcaactattgtggatcctcacctccgacagtgctgatggaaacacccacaactgctcgcagcgggtctgggctttcctagtcaatcattttactttcagggcgtagaggtaggagaatgaaacagattgcacagcactggtgaaaagaaaaggagaaattcagggaggaggaatgagggatcctctttcttgtgtgtgggtgttagcttgcctcccaaccacactgacacttgctgtgccattgatttgacttttctcctatcttaacaataacaaatcattaaaaaatcagtttatcaaaatataaaa

SEQ ID NO: 244946 - DNA, 286 bp, Homo sapiens
tataaacccgtgcagcattttactgtacttaatactgtaggcagttgtaacacagtggtaaatatttgtgtctaaacatagaaatctaaacaatctaaacagaaaaggtacaataaaaatatagcatacaagattaaaaatggtacgtaccatgtatagagcacttaccatgaatggagcttgcaggactggcagttgctgtaggtgagtcagtgagtgagtggcgagtgatattactgtacactactgtggactctatactacactgtgggtacactaaatttgt

SEQ ID NO: 244947 - DNA, 220 bp, Homo sapiens
aaaatcaagaaaaatgtctagttctcatggctccacattagaatcagaaaagatgaaagaactaacacttttcaccctttgctcaataaattcagtggaatatacatagacaagtacttgatggcctctcatttaagccttaccatttcccctaaaaggtccggtatgtgatactcttttacagaatatgaaatgaaactgaaagaaaattaactttcca

SEQ ID NO: 244948 - DNA, 415 bp, Homo sapiens
gagcaaggaattgaagaagaatacagaaggaagttgtttttctctgcctcagttcatatcctgcctctgccatttagagtctctgacctttggcaatttttttcttttcactctagtttagttttctggtctctaaaatggggggagaaattgtgcctacctaaggtttgctgtaaagaatgaccgaggtaatccatgcctggcctataagtgattagtaaatgttagctgtcagcctttacaaaggcatagtgctatgtcaaagcatagtgctttgataatatagtttaataggataaattttcagatagtaaaccttttcccttcattcagggtaaaaataatagttctataacccatcaaagtttagttctctaagcttttgtatccctgttttaaaataattcagctcaaa

SEQ ID NO: 244949 - DNA, 394 bp, Homo sapiens
ggacacgccactcgttcatccactcattcgatgacacgtgcgtcgtttccaccttttggctactgtgcatgatgctacgggcattctagcacctgtttttgtctgaatgtgtgttttcatttcttgtgggttcatacctaggagtgggactgcagggtcatatggtaattctgtttccttctgaggagctgccagcctgttttccaaagtggctgtactttctggcattcccacccacagcatacgtgggttccagtcccctacgtcgttgctaacgtttgttattatctgtcttctcatcacagccctcctggtgggtgtgaggtagtatcaccctgtggttttgatttgcattttcctaatgactaataacgttgaggaactttgcatgtgc

SEQ ID NO: 244950 - DNA, 371 bp, Homo sapiens
tgcactttagtgcacaccaaactgccttcagaaaagatgtacctgtttacactttcatcattttatctgttttatatgttttcagacactttatcctgcaactttgactacttaacggtgggttccaatagtaaaaatagtaacatatgctttgtggtcatgttagcactgattaattagtaaaccttccacgttttccagtcagtatcaacgtggtcttccgtttattttcctaatctcacttttcgtaacctccctttctcttcttgtctcacttccttacatttcttctgaacctccgtatacctgtctcattaaatttaatgattaaactttttaattacaattgtaaaagtatctctaatcaatta

SEQ ID NO: 244951 - DNA, 436 bp, Homo sapiens
ccaaaatagtttgaatcagaaagtggtctttgaatagtgattcagcctaatacatcactaagaaggagaaacaaatgaggcattggagacctttcatccaagtgtcaaataggaaaagtcgttcatgtaccatggcatgtacaggaaagcagtgatgtttcaagaactaactggcaacgactatcagattttagaaacaaagtctgcatttcatgatgccccaaaatctagttgaaaacataatattcaatatttgttacctctttttttgtatatttatttgttatactgaactgaattattcacttattatttgaagttatgttcttataggaagctaggcaccaaccagcagttgctaataatatactataatttagtaagtaattcaattgaataaaatttatgacaaatttaaaaaaaagttaattaaaat

SEQ ID NO: 244952 - DNA, 277 bp, Homo sapiens
ctttattcttgattttaaagagtgcaactaagttggaagattcattatctcatatcagtaggggcagtagccagagctaaatgttgaaagcataaatgcagtttaattcgattaatgtctattaaatgtcaactatttaccagtcactatgctcagctttgaaagtacaagatagatttaatatcctaatagctctaatttattgtggacatttaattcattatgccatttagttcttacaacagccttctaagatagaaagctgttatccatattt

SEQ ID NO: 244953 - DNA, 508 bp, Homo sapiens
ctcgactcctccgtccccatctctcctccctttctggcactgtgtgactgtctggtgggctctctctatctggtgtgcttgtgagcacaggctctgtgtggcattctgtttctgtgtgtttctcttggtccccggctttggttatggggagcagtgattttactgtaactacctcactcacccctgacgtgcaggtcagcagggtgggagtctgtctagctgagtggcttacagcccaccgtggacatgggttgaatctggttctgtgagctacctggccttgggcagctcacttcccctgtgagcttctggttctagcacttacacgggaataagaaaattcaaaaattagctggacgtggtggtgggcacctgtaatcccagctacttgggaggctgaggcaggaggatcacttaaacctgggaggtggaggtcacagtgagccgagatcatgccactgcactccagcctgggcgacagaatgagactctgtatcaaaaaaaaaaa

SEQ ID NO: 244954 - DNA, 460 bp, Homo sapiens
ctcgtttattgtaacacatctgttgccaagttgcacttttttttagaaacagtcttcgaggcctcttgctttagttcaggggtactcagtcatatccaagtggtcttcaatgaatattgtacgtttcggaaatcaaaagtgatcttcctggccaggtgtggtggctcatgcctgtgatcccagcactttgggaggctgagggagccggatcacctgaggtcaggagttcgagaccagcctggccgacatggcgaaaccccgtcactactaaaaatacaaaaaaaattagctggatgtggtggcaggcatctgtaatcctagctacttgggaggctcaggcaggagaatcgcttgaaccagggaggttgcagtgagctgcaggcggagtttgcagtgagctgagatcgcaccactgcactcctgcctggttaacagagtgagaccctgtctcaaaaaaaaa

SEQ ID NO: 244955 - DNA, 506 bp, Homo sapiens
cttgctgttgcccaggctgatcttgaactactcctgcgctcaagcaatcctcctaccttgacctcccgaagtgctggagttgatagctttggtcgcctggccaactttttgtcttatcatttttgcttatttggaggagtttaacaaaatggcactgtcgctatataagagagatcaacatttttcagagatgcgtactttaagcaaatagaagcaaaataatatccaggacttgttttaaaatacttaagaaacaacaacaacaaaaagactagatcaaacaaatataaaattgtaactacttaatctgtgcgatgggtatatgggacttcattagtttctctctacatttctttgtttgtaaatgttcataatttttaaggaaaaaaaaggcccagttttaaatcccatcaccgatacctgctaattatatgggctgagtttcttttatctataaaatgggaatgctaagtgtacatactttcatgaggttgttgcaaacttgg

SEQ ID NO: 244956 - DNA, 626 bp, Homo sapiens
ataccgccactgatctgacaggaggctgagctcaggtggtaatgcaagtgataggaagtggttgtaaatacagatgaagcttcactctctggcttctcacctcctgctgtctggcctggtttctaacaggccacaaaggtaccagtctgtggcccaggggttggggacccctggtatagtctgttgctcctaggttacataggcagttgtaacacaatggtaagtatatgtatatctaacaaacctaaacatagaaaagatatggtaaaaataggacattatgcagtgcatgactgtatattggcaggtgttgcctcagaccaggtaacaattactgtttacagagtgccatttctatatgagagtcaaatgcttctttgtcacttccactcaaaatatacttttaagtagtggccacaagttgaaaggcctaagggtacatcttcctgtgaaataagaggaaggtagaagtatacagataaaattccaaatggagaagatagaatttgatggagtacatgtagtcctcaatcttctcaaagactgaagcaagagtaatcagccaattgagaaaagtgacgaagagcctgaaaatgaggagtggaagaagtatgtatacagttgga

SEQ ID NO: 244957 - DNA, 593 bp, Homo sapiens
agaaagaggtttaatgggcttacagtctcacatggctggggaggcctcagaatcatggccaaaggcaaggagaagcaagtcacatcttacatggatggcagggggcaaagagagagcttgtgctgggaaacctttgtttttaaaaccatcagatctcatgagactcattcaccatcatgagaacagcatgggaaagctccacccccataattcaatcacctcccaccaggttcctcccacaacatgtgggaattgcaggagttacaattcaagatgagatttgggtggggacacagccaaaccatatcacctgcaactaagaagaatgttgaagttgatgaagtaatactggagaactgttaagccattggcaagtctagatcttgcagagttaaatcatgtaagaaatacaagaataacatagagagaattggcaaacataatgacaagacaggaaattcaaatagaatgatgtaaatacttggcaaaatcaatgaaaactgtgaatttttttaaaaagggcaatcttgtaatcttgctttgaaagtcatatgggaagtaaagaatgttgtataaagtggggaatgttttat

SEQ ID NO: 244958 - DNA, 508 bp, Homo sapiens
agtgggtcctgggctgcaggagaatccgctgccccaggagcagagactgggaagaagcccacagtaagggcaaagggtggactgcggagactgctccgtcctccctccccacccctacgccaggtttcacttctccctgagagtcctggggcaacaccccctgttctttccctcgcacccccatttttaaaatgttacgtgggagctttcggggacgggctgcgggcatccgtttccctagcccagtgggaggtggaaccgaagcccaggagtccaggcctctggccctgcgcctccctggctaaagagcgccctgtggggaggaagcagggccccaggcggaaccgggaaaacacaccggggctttaaacagaccgggccactcccatcgaatttggaaagcggttaaaagaggtcgtgccgcattctgcgccgcgtccctcttccttcagtcccgccgagtgtccccgaccagaggtgacctcctagaaggggaggtccccaaact

SEQ ID NO: 244959 - DNA, 624 bp, Homo sapiens
agttgtggagcgacagcgacagagccttggagagggaggctctgctcaggatttgtccccagtgccttatttagttcacttggtgaggtcatgttttcctggatggtgttgatgctagtagatgttcttcagtgtctgggcattaaaatcttgggcatgcagcaccatatgagaggtttaaaaaataaaatttaaagagagaaaagcggtgggattgctgaatcagacagagccaattgatgatcagtaatggtggccaataatcagctggaaacaaagtacttagcagggcttgaaaacaccaaaactctgagaccactgaccttcaaaaacttcaacagccctgagtgaaaagtccaaacacatttatctaccattcaaagaccctttattgtctgtcctctgcgcatctcagtagtctctttttaccacactgtctatatactgcatgagccatttatatgaaactatctgacactccaaggcatcttatactatatattcaatcatgtatccctagtaattagcacagtcctggcatatagtttgctactaaacttttgcagaatgaaggaattatcttgtatccaggttccaagttttaaggtgattcttcacaaaaaa

SEQ ID NO: 244960 - DNA, 382 bp, Homo sapiens
gccaaggcgggtggatcacctgaagtcaggagttcaagaccagcctggccaacatggtgaaaccctgtctctgctaaaaatacaaaaatcagccagacatggtggcatgctcctgtagtcccagctactcaggaggctgaggcaggagaatcacttgaacctgggagatggaggttgcagtgatccaagattgcgccaccgcactccagctctgggcgacagagtgagactctgtctcaaaaaactaaataaactaaaaataaaaattacagcaagaagaactgaaataaagaatagaaaaacagtagagaaatttggtgaaatcgaaagttggttctttgcaaagctcagcaaaattacaaaactttaggtagacttaaga

SEQ ID NO: 244961 - DNA, 415 bp, Homo sapiens
cttctggacatggactgctgggaagagggtaaaaatgggtatggagttggggagtggaataatgtgctcctcatgtctcttcacaccccaagagtcaaataaggtttaatattctgtgggctttagtccgggtatggtggctcacacctgtaatcccagccctttgggaggccgaggtaggtggatcacttgaggtctggagtatgagaccagcctcaacaatatggtgaaactccatctctactaaaaacacaaaattagctggacatggtggcgcacacccgtagtcccagctacttgggaggctgaggcaggagaatcacttgaaccccacaggcggaggttgcagtgagctgagattgtgccattgcaccccagcctggacaacaagaatgaaactctgtctcaaaaaaaa

SEQ ID NO: 244962 - DNA, 467 bp, Homo sapiens
atttttcttttttacaatttgttctttttaattgggtgacattaaagagtaccttctaagcagttaaatgtgccaggagtcatattgacacagggccacagacatgagtaagacaatgcattcacagtctcataaggcagatcacagacttatacttagcctctgggtacagaaaagttacttcccacatttttctcattgaaaatgtttcctctcagaatcttggtgtggttttacataaaggaggattcttcagatcttttttggagactgagtctttactctggcaaccaaaattgtatttcccctgcttctaaactttcctctaaactcctctctatttagccttctctctccttagtcctgagatcctgcagtagttgagcaactggaacgtcacgtttataaataaaccaaagtcaagggatgttgggctctccagaggtggacttcaggtggacaaagat

SEQ ID NO: 244963 - DNA, 411 bp, Homo sapiens
ttcaaatctcttaaatttggatttccaggttacctacagaaatgatgtcgaacttgagatgatttcacggactcaaggacaccttcattggtcttcccaaatttggagtgcactcttaaccctttctttgaccactttctcacacctaaagctgtttaataggagcagcactttcaactatcagaggtgaacatcctgatggagggcaacaaaagtcaggggtgtgtgttctccaaaaggggcatgacatcttatgcattttgaccattccaagattctttaggacttttgccagaggtacaaagaaggaaacagacaaacaggaaatttaaatctctcaaatggtattatttgtttgcctcttttataaaattatggagatcagagattgaagattatgcttgcaatgaa

SEQ ID NO: 244964 - DNA, 387 bp, Homo sapiens
gatgtgcagggttctgagctgggtcccaaggacatgaggacaacttggcaggtactttctaccatcaagggcacacgacattgctgaggacagaaatagtgcaaggtggggaggtggcaggttacaagataaagaagctatagtcaattgccagttagaaagagtactgggaaaatagcaataatagctaccatagaaactgtgcaagtactaggtgaagaggcctgtgaaactaacttactgcaaggcttgaataaatagagacattcgcggccaggtgcagtggctcatgcctgtaatctcagcaccttgagaggatgaggcgggggtatcacaaggtcaagaggtcgagaccattctggccaacatggtgaaaccttgtctcta

SEQ ID NO: 244965 - DNA, 291 bp, Homo sapiens
ttcttctggaatgttcccagccaatgactgtgcaggccccttcctgtgggacatgggtttcctccaacagataactttggctgggggactctgcaacagcctggcccaaactttcttggaactgtacggcaatctgagacttgctccttaatctgccttccttcctctccttctgtcacaggtgacagacctacattatggtctgaaagctttccttgctacgcctacttccttctgtttatccttcaaagtcctttcccgcaataaatctcttgcatgtacaatcccatt

SEQ ID NO: 244966 - DNA, 431 bp, Homo sapiens
ctcatttgggttctgtggggaggtggctttgagttcctcggggcccagtctgcagtggctattgggagaaaaggccccaccttcctgggcagagaagtggagcttccacttaaagaggcagaaggaggctgtcagaagagggaagggtgagtgtgtgtctgtgtgcatgcacacacacacgcgtgcaggttatagtaatcactgtttcacatcttatttttaagaagtcagaaggttgtggtaagaagtgagaatgaggagtcccctttaaggtggtctaaggttgtgcccaagacagttggcttgttccttgggaaatgtctttcagggcctgaggagctggataaaatggagggaatgacctaatccatttggtccaattgatttttttttttttttgcaacagagtggctccgtctcaaaaaaaaaaa

SEQ ID NO: 244967 - DNA, 962 bp, Homo sapiens
tagacctgttctcaaagttgatctctactgaactggaatggaaagacccttggattttgttaatcctcctgccttgaagcttaattatacttaacgcttctaaaattgatatgggtcttcttttgatgattcctagtcttctttaggtcatctttctttctttttttttttctttttgagacaggatattgctctgtcacccaggctggagcgcagtggtgagatcacagctcactgcagcctcaaactcccaggctcaagtgattctcccacctcagcctcccaagtagatgggaccacaagtgtgtgctaccatgtctggctaatttttttttattatttgtagagccgaggccttgcagtgttgtccaggctggcctcaaactccagggctcaagtgagcctcccactgtctcccaaagtactgggattatagcatgagccaccacatccagccttgggccatctacttaatctatggcttaatagttattgtccctaggaattctttctgatctaacctagaaattctcttacagcaatttgagcaaaataatatgggtaatagcagaggccatccttaatcagtaagtttaaaaagaaaactattctttagggctctttttctgcttatagcagtaataccagaaattcaaaaatgtaaactagctagaagaaaaatgtagtaagctttcagagttagcttctattatgtcaggtacagtgctgagcattttacatgctttccatcattgaattatctccatgaccttattagagcaggtactgtggttattcccattttgcagacgagaaaactgagattataaactctgtaatgtatgtaaggtcacagagccagagttaaaaacccaggccttctgacaccagtgctcaagttcttaaacctatgctgtatttctgcaaagaaaacaaaataaaataaaataattcttaatcca

SEQ ID NO: 244968 - DNA, 873 bp, Homo sapiens
gaaacagccttacactgggcacatggaggagacgtccaccctgcagccaggactggggttcacgtcactgccagagctacactcgccttctgcttccacggtcctgttaattctagatcagagagcaagaaaaaagtacagaacatatcctctacggttatttcctgctttctaattaaaaaaataataaccatggcaagagagaaagaaagagaaagtactcagaggctgacactgacatttcacttcctcgctctcctaagtttaattacaacagcacgtgcagccacgtcagccaaatgacttcatttctgatgtgaaaacgcttaggccatgatgtcgttcattttctgtaattgctgccttttctcattctgttaatagtcccggcaaccagatttcagtggggcatgacgtgaatgtgtatatggtgattcaaatgcaaaatttgtttatggggcttttaatcgaacgcgtgtgtgcctgaacattcttgctcaagttgatgaatcatggggtggaataaaggctgagtttagtttttcactttagcaaaggggcaatggggtgcctactatgtgcgagacattgggaggggcttctgaattattctggatatcgtcattttgcagtgtgcataattttgccaaccgttgctttcgtagcccctgctaagtgttgactttttaaaatataagtttattgtaaaagtgacatgaaaattacaacagatattccagaccaaaataatacaacaatcccagcatctgattgagtcagtgtttgctgtttcccctgcactttcctagttcttaagcatttgcgtatgtaaacattcatatttgcaataaaaaagtgagcttttatattcta

SEQ ID NO: 244969 - DNA, 424 bp, Homo sapiens
tgtcccatttcatcgccgaatgttgggagactggggtctgtcctcggaaagaaacagcctttctgtttataggtttggatcgtctatccctttcagggaactggtgtgttggggacggcttctctgccctgcctgacatggtccagtcatcccgtcagccttctggacggcaacaccaaagctgggaccaaaaaaaagttccagcttaagtgctaatgccaagtgttagatcttgtttgcttgtttgttttaaatcagagactaattaatgtcaagcaaatctgttaaaagatttgatcacgggaagcctggtcggtttccagtgaccaggtcaattccatatctgaaattagtcttgttagagttgctgccaaaaacagtttaacctttaatctgtaatatgttgtttcaaagaggaatctgg

SEQ ID NO: 244970 - DNA, 484 bp, Homo sapiens
tctagatagaagccaactaaatttctagttaccctttcttttaaataaattaaagtttccttgatgctattggtattccacttctaagtcatttgtttggtaactttaccaagagtcaaaattaaggatatgtatgaatactgatattatgagaagaaacaaatttcttgtaatttttctactgacaaaatagcataatgtaataatatttgaggacaatattttaaatataggtctactagtgagaagaaaggaattctttttttggtcataacactttgcttatttgggcgtcaaaattggtgttcccttcatcagattgattgcattgcagatatttaactataaaaccttcttagttcatgggctatacagaaagaggaagaaggctagatttggcctgtgggccatagtttcctgactctgatctgcaagattatttctgcatttaatttcattctttatatttgttattaaaaaaaaa

SEQ ID NO: 244971 - DNA, 394 bp, Homo sapiens
tcagaaaatgggctggccagcccccattccagtggacacattctttcgttaaaaatgttaatgacattgttgtaaacaacaggtcctaaaaaaaaaaaaaagtgggaacaacagggccaggtgtgtttggtggctcatacctgtaatcccagcattttgggaggccaaggtggggggattacttgaagccaaaagttcaaaaccagcttgggcaacatagtgagaccccatccctataaaaatgtaaaaaatatattagctgggtgtggtggcatgtgcttatagtcccagctacttgggaggatggtttgagctcaggagatagaggctgcagggagctgtgaccacaccactgcactccagcctgggtgacaaagtgagaacctgtctcaaa

SEQ ID NO: 244972 - DNA, 285 bp, Homo sapiens
cagtgcatgattgttctgctggcagtactgggggctgggctggccaccccaaatgttaccctgggcatctgcttaacagcccaaacagagggaataatagaccctcaaagatggctccgtccctgaggcctagagggctgtgtgagagctgacctcaaggccaaattcttgccccctctctctgttggtccatgagccccaggatcctcttcctggctctacactgaagcctggacttggaagctgccatcctaaggcctgcatttaatcaggagaacctgagga

SEQ ID NO: 244973 - DNA, 103 bp, Homo sapiens
agtcacttcatgttgcttcatccactgcccacattccagcaccacaaccaagcaggaacaagatgacattagctcaagtagtgaaacaaggaaaattgctatg

SEQ ID NO: 244974 - DNA, 607 bp, Homo sapiens
  misc_feature (10)..(10): n is a, c, g, or t
aaataaaaantgtacacattcatggcatacaacattatgtttcaaaatatattgtggaatgactcaatcaagctaattaacacatccatcacctcccgtacttaccatttgtgtgtgtgtgtggcagtaatattttaaaacctattctcttagcaattttcaagtatacattgtcattcattataatcaccctgttatacaacagatctcctgaacttattcttccaaggactttttttttttttttttttttgagatggggtctcactctgtcacccaggctggagtacagagtgagactccgtctcaaaaaaaaaaaaaagatacatgttgtggaatgtgatgcacactctgacatgcagcggcagagtggaacagtgacattctaaagagtgactcctacatgaaatacctaaaaagaagccccaggaagttagctgagtcctacagaacatgactctggtttccttagcacttgaatccagctcttggcagggccaatattgacagcagagtcaccaaacacttccttcagttatcggtcaacagagactttttggctaaatgaagaacactgctgttcctttgtgttcctaccatgtaactt

SEQ ID NO: 244975 - DNA, 634 bp, Homo sapiens
  misc_feature (25)..(25): n is a, c, g, or t
ccgacaagtttcaagaagccagaanaaaagtagatatcccaggcaagcaaacgaacggccaacaggggaacatttgaggggcactagatgccctagaagcagcccctgagtccgctcaagacaggatttctgggtttccattatgtcatgttcctcttagagatacatgttctttccaaagccccaccactggactcagcgtcactctgagactaccagtttgcatttccagttacctgcctgacatcgcccttgatgtcttgctgacccttaacgctccacatgtctaaaatgtgagccagcctttccctggcaactctttctcctcatgccccatacctgtccatgacatcatctagggctgtcgacatgattttgtggggcacaatacaaaatgtattgtaggtctccctgatcaaaaattattaagacacaggctccagatgtaggcatcaatgctgtttctgtgttcttcatcactgtccaacccattctttgccagaattcctgcagtctatcctttgaaatgtctcacatctgtcccttcattcccatttccatggctgaccctcaaatctcactcggctttcggtcggggctttgtaattggtgttcctcctatttcttgcctctg

SEQ ID NO: 244976 - DNA, 291 bp, Homo sapiens
gttaattattctgtgtatgtgagtatgtgatatttgtaagattgagaataaagactaaagttagggacaaaacactttacattaatcatgcagtgcagctcctatgtaaccgtgtttgtcaaacacaccctgaatggttttgtcaagtattatgttgctgtatccatcacttattagactccgatgatcactttctattttatccatttaagtattccctcaacatcatccagagtcgtgttcttgatgcttaagtgctcagacataaaactattaaaatattattgataa

SEQ ID NO: 244977 - DNA, 393 bp, Homo sapiens
tgacttttagtcaacaaagaaactaaaagttagaaatgagcactagatgagagaacaatgccactgtaaaatactcttttttaaaaaaatacacgcaaagcttcatatgttaataccccaagctccaagatggccaatttatttttgaaacaagaaacacctgtttattatcaaccataacaataatatgtttaattttgagagaatctttttggcagttgttaataagccatactgtaagatttaaaatagttttaatatattctaatggacttcttataaggcatgagaaaatatatttagatgttttctttgctttcacgtaagttcagcattaaacatatgccttccgttaactttagtcattatttcaccagattgtacttaatgaaa

SEQ ID NO: 244978 - DNA, 166 bp, Homo sapiens
tctttctttaactcccaccttccctttaaaaaaaacctaacagcaatagcatggtatgattcaaaaactcattttgccactaactgacattgtatcttggttaagtcacttaatatcactggttctcaggtttttttgtaaaataaattaatttatttctagtaat

SEQ ID NO: 244979 - DNA, 455 bp, Homo sapiens
atttatttacatactattacaagtacacaaattatttcttagaaagtgtgtgtgtgtggtgtatgtgtgtacaatatagatatcaatacctcaaccctggagtcagatatatttattcagtaaatctcaaatgataaactttagcaaattcagtggtctgtttaggaaagctattgaaactatcagttttattaaataaagtttaatttagtctgtgttgacattttaaggacaatttttttgaaataaggaagactgagaaaaataagtttgaagaaaaattaagagttcaattttggatatgctaagtctgagatgcctgtcaatcatgtaagtggaggtatgagttgaaagttgagtattttggggggagttcagtacacaggtcagagcagaagatataaatttttaagtcatcatcacttatattgcaaggctagatgagatacgtaggg

SEQ ID NO: 244980 - DNA, 392 bp, Homo sapiens
cagaaatatctattttttatgtataaagaaacatgtttgagacaaaaatagttgtatataaaaggatatttcataatctcagaatagttacaaagctcactgcttgaatttggtgttaaaaattctaatggaaacatgtaaagccacatactactgaaagcacaatgcccaggaaagttgtcactcttcacttaagggagtggttgccaggggctgagaaagggaggatggggagtgactgctaataggtatgtggtttctttgggcgatgatgagaatgttctggaattggaatagtggtgatagttgtataactgtttgaatgtactaggaaccactgaattgtatactttgaaagggtgaattttatggttgtgaattatctcactaaa

SEQ ID NO: 244981 - DNA, 683 bp, Homo sapiens
tttttttgggtttttcttgagacgaagtctcgttttgttgcccaggctggagtgcagtggcatgatctgtgctcactgcaaccgccacctcccagggttcaagtgattctcctgcctcagcctcccaagcagctgggattacagacgcctgccaccacgcccggctaactttgttgtatttttagtagagatggggtttcaccatattggccagggtggtctcgaactcctgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaaccagaatcacagaatcatcttaatac

SEQ ID NO: 244982 - DNA, 2565 bp, Homo sapiens
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244983 - DNA, 2719 bp, Homo sapiens
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaatactgtgataatgtttattaattcaaataacttatgtgagagctgctataaccatttccccagttcaacattgcattgaaaatttatggacctttaaaaaaaaaagcccaacagtgatttttttttaataattaaagaatgattttactttgta

SEQ ID NO: 244984 - DNA, 3102 bp, Homo sapiens
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaatactgtgataatgtttattaattcaaataacttatgtgagagctgctataaccatttccccagttcaacattgcattgaaaatttatggacctttaaaaaaaaaagcccaacagtgatttttttttaataattaaagaatgattttactttgtatttgaagggtgatttgtttcatctcttcttttttcagggtagtcacttgttcctaaaagaggaacatagcagtggctgtaatgggaatggctctgcagtgggctagtcacaccaaaataaagaaagggcagctgtgggagccatcagaagctgtggaggctggactggtaatggggaatgctgccccactgaagtcttgttttagagatcagtgtgatgtgctcacttaactataaagtgtcagtccccattccaactaagtggctcctggctgggaagtagagtaggtttctctaaggaaaatgacacctgctcaccacccgccccactataccacattgttgttaggctatcatataatgataaggtagccctctgaggcc

SEQ ID NO: 244985 - DNA, 2925 bp, Homo sapiens
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaaaaaaaaaaaatcaaacacaaaagcatacacaaccgggcgaacacaagataaacgcaactaacacacacattgttggggccgccagtgcgcctagaaaaatttttacaaaccacctctggtggggccgcgggccccacagtagtgaagcaaaggttggtgaaacgggtttcccacaaagagaagccccccgtggaacacgcacacagggcgggtgggtttcttcccaaataaaaaaagcgcgggcggggacacgcgcgttgcttttgtgcgacaaccccagaagggggaggctcgaagagcgaatagcggggggctataaaacgcgggggttctccagggggctgtataaaatcctgggtg

SEQ ID NO: 244986 - DNA, 2110 bp, Homo sapiens
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaaaaaacccgggctctttttcgggggcgacaaaagagagtttaagaggcacgggtcatttttctcgcccgttttgacaaggggtaaaacgcggccccaaagggggataatcgaacgatcgtaacgaaaa

SEQ ID NO: 244987 - DNA, 2553 bp, Homo sapiens
  misc_feature (10)..(10): n is a, c, g, or t
  misc_feature (24)..(25): n is a, c, g, or t
gctagtacgnggctggtttgaatnngccgaggttggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244988 - DNA, 2163 bp, Homo sapiens
ccacattttacccatgaggaacctggagagctaggtgctgtgagtgctgaggagtgaggttgactttccgaagcacaagcttcactctgattaaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244989 - DNA, 2430 bp, Homo sapiens
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244990 - DNA, 2049 bp, Homo sapiens
gctgaccagcaccatggcggttggcaagaacaagcgccttacgaaaggcggcaaaaagggagccaagaagaaagtggttgatccattttctaagaaagatggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatgcgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244991 - DNA, 1358 bp, Homo sapiens
tagggctaggagcgaggccggggttgaatcggcaccgaggggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244992 - DNA, 1094 bp, Homo sapiens
  misc_feature (942)..(942): n is a, c, g, or t
acagaaggcggggccagcgccgctgccgggtgctggaggcgccattggagccggcttggctggcgagcccggctgaggagcctcttgggccgcacttaccgccgcgtccgctcccggtccctggcccctcagcggcatggcgtgcggggcgacgctgaagcggcccatggagttcgaggcggcgctgctgagccccggctccccgaagcggcggcgctgcgcccctctgcccggccccactccgggcctcaggcccccggacgccgagccgccgccgccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctggccactggaaatntcacaaatccgacacagtacaaatgcctatggctacaagagtccaccattgaaaggcggaaggggtatgggatggttagatatgatgcaatttttactggttgctgatgcgaatagaaactgtgcaagtgctcacgataagactcgctgatc

SEQ ID NO: 244993 - DNA, 1420 bp, Homo sapiens
aagcaaagaaccaaagccaggagacctgggtgctggttcaggctgtgaggccctgggtaagtcacctctctgggtctcaactttctgatctgtaaaatgtggagaacagctgtgagccaccacgcccagcccctttttgttttctaacagctaatttcgttttccagcagatttcatgtttctggacattgtatttatttggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244994 - DNA, 599 bp, Homo sapiens
agctcggtaccccgccatttacaactatctaaaatgcctccgtttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgtttaccttgccttcttaa

SEQ ID NO: 244995 - DNA, 736 bp, Homo sapiens
ttatgtcgggggagggggagattgagacctacatgccaaagggagtatctaaagtctagtcagaagatctttgtctcttcccacttctgaagaaagtttgaagaaatgagacaataaagtgaaagctcaagtttgtttcttttttattagagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggtaagcccactttgatctgcaaaattcgcattaagagtttgtaaatggtacttataatgatgaatctagaattggcctcctctaatgtaatagaattgctaacggggatgtattaatatttacagatatttttaaaactatacagtcatgaaattggaagaaacctcacattgatttgatgtgcttccatccacccaatacaagaatatcttcctgtataactgcaatgtgtaatattgtagccagggtgcaataaatagccacatgtgggctatttaattttaaactaattaaaattagataaaattttggccggctgaggtggctcatgcctgtaatcctagcactttgggaggctgaggcaggcggatctcctgaggtcaagagttcaagaccggcctggccaacatggcaaaacctcatctctactaaaaatacaaaaaaa

SEQ ID NO: 244996 - DNA, 872 bp, Homo sapiens
tctgtgatagggtcttgctctgtcacccaggctggagtgcaatggtgcgggtgcgatctcggctcactgcaactccagcctggtgacagagcgagactatgtctcaaaaaaaaaaaaaagttcaacatatcaaagtgacgaaaggagtctactatcattaagtgttgaaatctgcacccttaatcccagggttgaatccatgctaaaccactaaagcagtttaactttaggcaagttatttaaattctgtactccaatattctcacctctaaaacatgaataacagtatctactcctactcaaggttttgatgatgattaagttaacacaaactcacaactttaacagtgttggacatagtcaagtgtttagaatacttccataaattaatgtcctgctacttttttctgccaaatcagaaagccattatatgacccaacaaggtatcagaaataattagtaatttcctggagcctcatcagttctcaacctatcttactcagactgattttgctcattaatacacccaataaaaactcatttgaaaaaccagggcaagttattgttaggcttgggatgattattttcttcaagagattgagacagtggcctactctaataggtctccaaacttactgccctacttgccctcttagttctcatcactaatattccctacacaacagaagataaaccagacctcttcttcaaaatccttcaatagattctacttgtgcccaagacaggatcttaaacaagaccctctaaggtcccgtgctatgaaatgtttggtccttgcctacctctctaactccatccctcatctatgtattcttggtaattattttccagtattatttcttacttggagg

SEQ ID NO: 244997 - DNA, 1737 bp, Homo sapiens
  misc_feature (702)..(702): n is a, c, g, or t
  misc_feature (1544)..(1544): n is a, c, g, or t
  misc_feature (1558)..(1558): n is a, c, g, or t
  misc_feature (1580)..(1581): n is a, c, g, or t
tctgtgatagggtcttgctctgtcacccaggctggagtgcaatggtgcgggtgcgatctcggctcactgcaacctctgcttcctgggctcaagcgattctcatgcctgtctctcaagtagctgggactacagacacttgccaccactcctggctaatttttgtatatttttgaagagacagggtttcaccatgttgcccaggccggtctcaaacccctgagctcaagcgatgcgcctccctcagcctcccaaagtgctgggattacaggcctgagctaccacacctggccaacatgattttctaataggccaaaggtgagaagagtaaaagtcaaggatggctagccaaaatctttggcccaagagacacaaaaattgtttcattaactgaaaaaggcaacagtacacaagagactggtttgaggcatgaacatcaggagcacagttttgcacttttaagttgacatattggatattcaacagagttgtcatgcaggtaaactgaattggtatgacattcgaaagaaaagtataggctgttgatcttaagtgtcgaaatcagcttataggtggtatattacatcatgaatgaatctgaatgaaattggacccagagtgtggacagaaaaaaaagtggaaggcttaaccatggggcactccacagaaagaagtttaacatgtaacagaaacatgtacaaaaancctgaaagcaaagtaaaaaaaaaataaaaacgtttcaaggaagagatctggttaaatggaaccacagggtcaagtgagatgagttaaccacaaataatttttttctaactgaagttcacttcggttttataagtcttagaaaaaaaaaaagatagctcacttttgtttttttactttaagagatagggtctcactcttgtcacccaggctggagtacagtggcgcaatcataactcacactgacctcaaactcctgaactcaattaactctaccgcctcagcctcccagggagctacactacagctgtgtgccaccgtgcccagctttttgtagacaggctcttgctatgttgccagactttcctggccttaagctatcctccaacttcagcctcccaaagtgctgggattataggcataaactgctgcaactggcctaaagctcacttttaaaatgtgcttgcttccctattaacaatgccatcacaaccatggtaacattttaccaagatacatctacctaaacattaactaccttgcacatatacacatctttaagccatttaaggtgttgggaaatcaagggcaaaaatataaacatatttagttttaaaattttaataataaaagtccaaagttgttctttggaactttaaccaaactaaaatctgtttttctagaatgctcagccggacacagtggctcactgcaacgtctgcctcccaggttcaagcaattctcctgcctcagcctcccaagtagctgggactatataggcgcatgccgacacgcctggctgattttcttgtatttcaatagagatggggtttaatcgtgttgcncaggctggtctcanactcctgagctcaccaagcagnngtgatcacctgaggttttatataaaatcctcagtgtgattttatataaattctcagatattactttgtttggggagtaaatcagagaattttatataaaccacactaagccagcctgcctcctcaagaagtttaggtaaccaaattaccgttgggc

SEQ ID NO: 244998 - DNA, 657 bp, Homo sapiens
  misc_feature (30)..(30): n is a, c, g, or t
ttaacatgtaacagaaacatgtacaaaaancctgaaagcaaagtaaaaaaaaaataaaaacgtttcaaggaagagatctggttaaatggaaccacagggtcaagtgagatgaggattgaaaaaggacccctgggcttagttaatgcatccgtctccgtggttcttttttaaccacaaataatttttttctaactgaagttcacttcggttttataagtcttagaaaaaaaaaaagatagctcacttttgtttttttactttaagagatagggtctcactcttgtcacccaggctggagtacagtggcgcaatcataactcacactgacctcaaactcctgaactcaattaactctaccgcctcagcctcccagggagctacactacagctgtgtgccaccgtgcccagctttttgtagacaggctcttgctatgttgccagactttcctggccttaagctatcctccaacttcagcctcccaaagtgctgggattataggcataaactgctgcaactggcctaaagctcacttttaaaatgtgcttgcttccctattaacaatgccatcacaaccatggtaacattttaccaagatacatctacctaaacattaactaccttgcacatatacacatctttaagccatttaaggtgtt

SEQ ID NO: 244999 - DNA, 765 bp, Homo sapiens
ccagggagggtcctgcctcactgctcgggggctcaccagccaggcctcagcatctctgccccactcaccggccctcatggtaatggaccacatgggtcagaggtgacagcaggtggcttacacatttccagagatctgatctcgtaacctcagggaccataaaataaaaaacatttcttactgtgtgcagtatcagggccacgtttaaagtcatgtgcaaagtttaggccaaaggcactcaaagtgatcagccagattctctcgtatgtttgttcagtgcagacacacagacgatggtgcgcgctattgagagaaaacagctgaaagtaaagtaataattttgagttttgctactttttggttatgtggcttgagctcatgcctttcccaagatctcgggggctagaagactgtccccagaaccatgaaccccagtgaaacaaatacatatatgcccgtggctgtgtcctcaacctggacctgaaaggcaagtggccatgggggtggctttctggaaaaggggaggggcttgggcaagcttagcccacagctgcagagaaaaccctcagggcgggctctgccagcgggtccagcacgccctcaaaatgcagcgccctcgtccagccggcagcccctgcctgtgtttgcgaagaatcaaggtgcttttgtgcttctgttcctttctcttcagctttacaacggccattctacatggaaaagcccccaaacggtgcctctataaacagtaaacccttgccaggctgg

SEQ ID NO: 245000 - DNA, 436 bp, Homo sapiens
gagaagagaatttccttcttggagtggtgaacaggaaggcttggaagggcagatggctaacctcgtgctgcatgtctccctggtgcagaaagtagatatgattatggatagagctgttctgagacaagataacatgttatttgcaatgtgagcccagcaacggctccccaaaagtgggaggagggatggagttgggttgtaagaaaattgagggttcctgggaaagtattccaagaatacaaattttatacttagaagacttcttgtaagaaagtgagtctaagaaagcagtcaggttcattcctctgaaaaacatgaaatgtgttacaaaaagccttatgatatggagtctgtctgacccccaccccactgctcttgcgaatgcttccagagattggggctcactggcgccccccggtggtattcaagccttctc

SEQ ID NO: 245001 - DNA, 295 bp, Homo sapiens
ttaatgaagtactcaacaggaaggtgtaaactgtgatcctcttccttgagtgagatggaaaaaaattaatttgccgcatcagtgtccatatctcagttcttctcacctgaagaacgttgggaagaccttaattggaatcacaagaattgggtgtaaactttggctccacattcactatctgtgggacattcattatctgtgggcttcatctgtaaatgggtgggctgtctttgggtaggtcacccagttgaaacaatggactccaagggttttattacctcctaagtgttgaata

SEQ ID NO: 245002 - DNA, 361 bp, Homo sapiens
tttgttccatagacacttgattgagtacttaagttgaacatctaggtctatgaatgacgttggtcaaatgttttattgttctctgtttcggttttagcaggagagatttgctgtttcataaaagaaattgggagagtatatcattttatgcctgtaacttattatagcattggaataagctgttctttggaggtttgagagactttaccagtacaatcattccccccctcccccaaatataaaaagataaaataaaaagccggtcagtgtctgttgcacaaaattacaaccgctctctgcttgtatttgcctagttctccagaatgtagggaaaaataaaaattcaatgaattagacacct

SEQ ID NO: 245003 - DNA, 338 bp, Homo sapiens
gaagctccattaactctgcacaaaacctcggcccgcctcggccgggcccagtgaaaggcgctcccgggcgggggccctcggggaggctgcccgtgtcctcgccccaacccagcccgagcgaggagaggggccatccccgggcccgcgccaggcccccagccggatgccggcttccaatggggaaactgaggcacggggcttggtcatgcaaaaggggccggagcggctgggactgagacccgttccttcgccgcggtccgcatgggtccggtggccagcaccgtgctggctgttttaatttggttgccgatatataaaaatcagatttgacattaaaa

SEQ ID NO: 245004 - DNA, 155 bp, Homo sapiens
gaaggctggaggcttggtccacgaacaagaaaagcaggacgaatgggggcggcgggttgagggtgaaggcacaagcaggcaggcaaaattactgaactccaacagcagcaagagccaaggcaaactgtggcataaacacacaaaacacatcttac

SEQ ID NO: 245005 - DNA, 427 bp, Homo sapiens
agggcagggagagcctcaggtggtgatgccagtctgtcctggccagcctaacagggggcttctggacaaaaattgctccatgaaagcaaaggggagatgctagccaaagggcacaaacttgcaattacaagacgagttctggagacctgctgtgagcacggtaactagagttaataatcatgcattacatacttaaaatttgagagtaactcttgcgtgttcttattacaaaaagggaactctgtgaggtgatgagtctcttaattagcttgattgtgatcgtcatttcacggtgtatatatatgtcagatcatcatgttgtacaccttatattaatacaatttttctctgtctcaaaagaaagagggatggtttctaaaaaaagttttaaagtgaataggcttattttggtgttaagtgaaaaagc

SEQ ID NO: 245006 - DNA, 499 bp, Homo sapiens
cctttgctttaaaaaacagccctagaagtacacatcgttggccccgaaggagccccagcagccatgtcggaccgcgaggtgaccttggagggcgggaggacggacgaggggcctggcggagctagactgagagggcgccgccggcgtcctgaaggccctgctccccgaatgtgtgggagtgtgtctgacggtgcgagggtggctgtggcggggcctgagcagcgtgtccgtgtcccgatgccgcccgcctgttactgagttaggcaggagtgcccgagtctggcgaacttcagcagttctcgttccagagctccacacgaggttggccaaagctttgcgggacttacatacccttcttcctccgcccagtcctgcttccttccccttcctttcacgggtgttgataccatgtcaacatcctcgtaccccaaactcagtcgcagcgtctgcttctggagaaaccattctgcagcattaaagctggtgagaagatgggatt

SEQ ID NO: 245007 - DNA, 228 bp, Homo sapiens
ctatcagaatgtagtttgggttccctcaaggtgagccctgagacaaggacttgggagcagatagtttatttgggatgtgatttgagtaactaaaagtgaaggagtgggaaaagtgaggcaggaagggagaaagtcagtagagtatattgagaaatggactgccactgtgggccactgggaaccttggtaataaccatgtggaatgtgcctcatagttgtaccaccaaa

SEQ ID NO: 245008 - DNA, 404 bp, Homo sapiens
gggtctctaggtagctgattagagcagtgcctctcaagtcgcctgggggcttcctagaatcacaggcaagcagtcccacacctgggcactctgatgcgacaaataagtaaggcatggtccacagccacaaggagcttatagtccaggatataaataactcatgagaaatgaaaaatgcaatcaaaaagaggcataaagtgcatgaaaattaagagaggggcaaaattaattctgatgcagagtggggctggagcaggggagagagggaattagggaaagtgtcagtgaaggaggtggtatatgaaataagtctcatggtatgggtaggatttggatgtgcaatggtgggtagggtgtgcaggacagttgggaggaagtgcaacactcatctgctctctggccac

SEQ ID NO: 245009 - DNA, 466 bp, Homo sapiens
ggaagcacatctcccaattccaggagtcaggaggccaagacctggggctgcagcagcagcacaagcccaccaaccttagcaacctaggctctgccggggatgggacggacacttctgttccctggagccaacattcaccaacattcatccacttgagagtcatccgggacttggataatctgcaaggtccaggtgtcctgccctagctgctgactgggtgggagcccgggaatctgcatgttcccatcccccgcaggggactccaatgaggcggcctgaggcccagtcatcaggaaacaccactctcactgggctgacacacacattaagcagcaggtgggggaaaagagcttctagcatatcaggcagcactttcgccaccacattctggatcaaaatagacaccatctctctcccgacatttatcaggtccctccctgccccatgcattaaaggatggttcaaa

SEQ ID NO: 245010 - DNA, 1024 bp, Homo sapiens
tatcaacagtattgattgagttgattttatatttccaccagttagtataattgctaaagatgaaaccccttccccagagcagttgaatttatagtggaatttgatatgatgtttactattagtgaaagtgatgacatataaatatatatgtttaaatattttagagatgagaatgtgtcttttattttgtgatgtagctgactttctctgaagaatagtggtttccttttaattcaaaaattgccatttattccagagcagttatgtattgcatgcattaaaagaatcatctttaattctaacaagaaaactacatgaaggaattctaatctagaaatttaatgcatatttgggtctgtctggctctaaaactcaagttatttttacatcatactgctgtcaggtgacttcttccacattctaaattgcaaatagtcataggatgttagagacggaaggaacgaagtattggtcatgtagtaaaactttttggaagggccaaaagaggtttatggacttgccaacaaccaacagatagtggccagactagaatttttgtcttctaattactgatatttgctgtttccaagctcctttccgttaccatttaggagcagttaattaaacacctactctcttgggacattggttatattattcaactctctctctttctcatatatgtgtgtgtgtgtatacacacatatatagagttttaaaaagtgtgtgtgtgtgtatatatatataggttttttgtccctcttcaggcagtgcatagtgaagtggcatatatatagtagcactcaataaatatcgattagtttgctgctactattttgttattgtgttcttcagtattgctattttgctcttttagccctctgacaactgtaagcaactttctatattaaaattcttttgttgaaatacctacattgatatctagtttcctgattataccttaatacatacaaaataaatcagaaactgaatgaaaaaatatgtatagggaaaacataataag

SEQ ID NO: 245011 - DNA, 498 bp, Homo sapiens
gacgtaagaagatctctccagataagaggcaacatgtttcaagaaattttaatctctgggcatgtgactatgttccatcttgtcttgatggcttttcaaataaccaaatatcatacgtatataaagaagccatggtggtctcaagcttcagacgctttccacgatgctataaagagatatggaacgcttttacatttcttcctgagagaagctatacagaggttttgaaaaagaagcccaaagtaaggttcactgttgacaaaaaggttgtttcttcactggagtcctaatcctcccagaagatttttgatgaattttgtaatactggtatttcatcagacatcctaaaagtatatgttttctgatccagcaccactatttaatttttaaagtacttttatgatttttataaggtcaaaaaacattcaaatccttgtgaaatgaatttgtgatgacatacgcatgtgtaaataaacttttcagatggccacatttaaa

SEQ ID NO: 245012 - DNA, 632 bp, Homo sapiens
ttcaaattgtaagttgtgactcagtagatcatgaaactaatagaggagaataacatcagtattcatgatgaataattaaatagaaaatactggagcacatcatacatgtaagagtaggtacccttttatgacaccgtatgtggatggatgggcgtgcatgtatttatataacgtatatatttaaatacatggtttgggggatggatgtctacatcaaatttatttgttactatgggttttggcaaaaaagtttgaaagctgctaggatagtgcatagccaggagggaaataagaagaagctatgagagaactagataatccttctcctacacagactcgtgttttgtgtgagtgggacactcctcagcctgcgtccactctcaggtagcttcctctttgaaccgcttgtcattgtgaggcagtgaccatctgcgccagccctgtccttggctctaacgtgatgttcatttgctcacctttcttggacttcctttgcttcctcaggctttagcttcttgccctgctgcctgtatctatggccttctctctggctgtggtttagggaaaatcactccatctttctgtgccttcagtgtgtttgtccactgtgagtgaagcataatcaatacttg

SEQ ID NO: 245013 - DNA, 488 bp, Homo sapiens
ggtctactttaggtcattctgtggaggtagtagctatctagtcatgatggttaattttatgtgtaaaccacttctgggccatgggatgcacaattatttggtcaaacattgtgagtgtgtctgtgagggtatttttggagaacattaacatttaaatgcataaaccaattacagtggagtaccctccttaacatgtgtgggtctcatccaattagttgaaggcctgattagaacatgaaggctgattctctcacaagtaagagggaactcctcttgcctgcccgccttgagctgacaattgtctttttctaccattgaactaaaatggaaacattgattcttctttggtctcgggcctgctggctttcagactggaaagacatgatcaactctcctggatctccagcttgccaactgcagatcttgggaattctcaccctccataaccatgtaagccaattccttataataaatctctatttctcact

SEQ ID NO: 245014 - DNA, 547 bp, Homo sapiens
  misc_feature (319)..(319): n is a, c, g, or t
  misc_feature (321)..(321): n is a, c, g, or t
  misc_feature (357)..(358): n is a, c, g, or t
tttttaaagagaaagaatcttactctgtcacccaggctagagagcagtgaaattatagctcagtgcatccctgaactcttgggctcaagggatcctcccaagggaggcacagtactgccttactgggtgacacagtaagactccatctcaagggaaaaaaaaaagattgtaagttaaatctcctagaaagccaaacacttgtcagatagtgaaaaaagaagagaacagattgtaaatttatagcatcagttcagtagtttcaacattttaataaggaggctaggggacacaatgggtcacgcctgtaatcccagcaccnantttttttttttttttttttttaaagagaaagaatcnnactctgtcacccaggctagagagcagtgaaattatagctcagtgcatccctgaactcttgggctcaagggatcctcccaagggaggcacagtactgccttactgggtgacacagtaagactccatctcaagggaaaaaaaaaagattgtaagttaaatctcctagaaagccaaacacttgtcagatagt

SEQ ID NO: 245015 - DNA, 465 bp, Homo sapiens
tgatatgggccgttcctggcaggaacgtatcttacacctttatttttctgtcctccaaggaggatagattgagcccaggatgtggaggctacaggtgagctgagatcgcaccactgcactccagcctgggcaacagtgaggccctcactcttaaacaattaaaaattaaaaattaaaaaaagaaagaggctaagactaggcgcagtggctcacgcctataatcccagcactttgggagactgcagtaggcggatgacttaagtccaagagtttgagaccaacccggccaacacggcagaatctatccgtacaaaaaatacaaaaattagccaggcgcggtgatggtgcctgtggtcccagcttctgaggtaggaggatcgcctgagccctggaaggtacagctgcagggagccgagactgcaccactgcactgcaggctgggtagcagagtgagaccgtctcatg

SEQ ID NO: 245016 - DNA, 538 bp, Homo sapiens
ttaagacagacaggtcttcatttcaaagatttcactggtatttacaactaagcatataaatacccaaagcgagactccccagtcctgagttttcctgcttcacttcacagaacacactttgttaattaccaaagctgccgtccacaaattagaacttctgctggactgggaaggcagaaatgagaataaatacctcttcaaatctgcagatctgcggaactgcgcaaatatcctgtgaatcggacccacttggaagagtgtgtgggtcagcggtgcattcaggactgtgataaaatttaattagaagctgctattgggacaccgttattgatgcgctggtacacgtagggggaaaaccgcagcctgtgtgctgccggtgcccttggtgggagctgtcttcacggggctgctcacatagtgctgaaatcaaactcactggtcatactgcccactgtcattttgggttgaggaccagaatgtgcatttctgggcttccccaaatctggaccctgtctgttcccaccactccctatctccc

SEQ ID NO: 245017 - DNA, 426 bp, Homo sapiens
ccatatgctataggttaattcctttgtcaggaatcctgaatgctttatcaggaatactgagtgctgatttggagagatacaagggtacaaatgatctgggtaataagcagctgcacaaatgtttatttatagcctaacatgttaattctgaaagcctctttaccagttcatttatttataactccaaagagacaatacacaaacagccattcatatcaactgctggcagtactcaattgatatgcttttgtttgggcatctggtagattgtttccatgagaacttctaagtagaaagttcatccctaaaggagcttctgtatagcattaatgtacccaagcttttcatgtataccttgtctcttcaaaaatatgggtttgtataggaaaacattctttccagttttttcatctgtttgccggaagc

SEQ ID NO: 245018 - DNA, 421 bp, Homo sapiens
ataattctaactgctattagatcgctgatcggaaaaccacacttgcctcccctttcccccaccccccagcatcatccaccccaccccgccccctaggaagggaagagggaggaagacctcaaaacgcgacacaatgacaattaactttccttgaaccttccctggaaggactgcatttttgcaatgcactttagttcccttcggttcaattcttgagtagaggacctcccaaatgcccatgaggagtgagtgggaatttctcaggatgggacggtagcagctttcctgattttcttttaggatggttctctgtaggtgggataaggcgctgaatggattttcaaatgatcaagtgcgtcgtcagttgaaaagcttcaggtagatttataaaacatgtgcaaataaaacctaaaaccgagaa

SEQ ID NO: 245019 - DNA, 580 bp, Homo sapiens
ctcactctctctcaaagacaaggaacaggaaggaagcctttgaggaaagggaagctttgctctttactgttggccctttgtattgtcttggggagacactccctagactgcacacccaccacaaatgaccataaatatttctgtatctcaagctggagcctcaggaaaaccagaaagcgcaaaacgacgaactgcataggcatctgttgcgagtgttgaaaagatctgtcccggattttggaagggccacattcaataaatccacatgtagtttgttgaacagattaacaagcctttaaacatacttacattctgttctagggtttaataaaacaagtcctcagaattgatgcctttggcgcccacctattttcccagctaaagagagaatgtgtaaagatttatagctgagcttgcagttgtaattggacctttgtaaggtttttaaatgaaatactgtttttggttttgttttgcctttttgctctctacttctattcatacagttaattaaagtttagtattcactatgcaaattgtaacagggaatggttacattatgacattgagaaagatcctt

SEQ ID NO: 245020 - DNA, 332 bp, Homo sapiens
agaagagctactcttgagattttgagaatgtgggaaagccccgggtggatatcaaagcacattcctatgcttggtttttctgtgcatgctgctgaagattcaggaggtggaagacagagggaggagggaagaagcactggaaatcttcgttgcttttctattctattgttagatggcttagtaaaaagccacatttctataaagttttccataatgtccgcattttctgtaaaagtagaccaaaggcagagtggtcaaaggagacctttcctttttgtatttattaaaataatgtattcttgttataataaagagagaaagaaaaatgtaag

SEQ ID NO: 245021 - DNA, 594 bp, Homo sapiens
  misc_feature (574)..(574): n is a, c, g, or t
tgagtgttagttttaaatagactattgacaaattacagatttttttcacgtattgaaattatattccagatgattttgagatttactggtataatattctcctcatgaggtaggatggaagggaagaaatagagaaaaaatgttctgctctgaaataaatgtggtgtttcctgacagcgtttgtcaagagatggggttccaccatgtagccccggctggtcttgagctcatgagctcaagcgattcacctgcctcagcctcccaaagtgctgggattacaagtgtgagccaccattcctgcctctatacctctaaaggtgttgaataatttgaatgggaatttgaaggtccatggcttccaaaccagcaggagttaaggcttaattgcttggaaatacattttcatggctgataccagtaacagaaaaatgtctgtatgtcaagaggctctgtactaatcagttaaccataacatgtgccaccccataccttgggccaatgtaactgttaacagcttgaagctattaaaaatgtacccggatgcggccgaaatcccttcttttctctaacgcgnccgaccccccccccccgccc

SEQ ID NO: 245022 - DNA, 642 bp, Homo sapiens
  misc_feature (622)..(622): n is a, c, g, or t
tgagtgttagttttaaatagactattgacaaattacagatttttttcacgtattgaaattatattccagatgattttgagatttactggtataatattctcctcatgaggtaggatggaagggaagaaatagagaaaaaatgttctgctctgaaataaatgtggtgtttcctgacagcgtttgtcaagaaggaaaggtcgaaaataaagcactgatggaaatacatgataaataagagatggggttccaccatgtagccccggctggtcttgagctcatgagctcaagcgattcacctgcctcagcctcccaaagtgctgggattacaagtgtgagccaccattcctgcctctatacctctaaaggtgttgaataatttgaatgggaatttgaaggtccatggcttccaaaccagcaggagttaaggcttaattgcttggaaatacattttcatggctgataccagtaacagaaaaatgtctgtatgtcaagaggctctgtactaatcagttaaccataacatgtgccaccccataccttgggccaatgtaactgttaacagcttgaagctattaaaaatgtacccggatgcggccgaaatcccttcttttctctaacgcgnccgaccccccccccccgccc

SEQ ID NO: 245023 - DNA, 450 bp, Homo sapiens
  misc_feature (430)..(430): n is a, c, g, or t
tctggaaaatatgagaaatatgggcaattactctctgaagaaagagatggggttccaccatgtagccccggctggtcttgagctcatgagctcaagcgattcacctgcctcagcctcccaaagtgctgggattacaagtgtgagccaccattcctgcctctatacctctaaaggtgttgaataatttgaatgggaatttgaaggtccatggcttccaaaccagcaggagttaaggcttaattgcttggaaatacattttcatggctgataccagtaacagaaaaatgtctgtatgtcaagaggctctgtactaatcagttaaccataacatgtgccaccccataccttgggccaatgtaactgttaacagcttgaagctattaaaaatgtacccggatgcggccgaaatcccttcttttctctaacgcgnccgaccccccccccccgccc

SEQ ID NO: 245024 - DNA, 294 bp, Homo sapiens
attttaaaaacttatcaatagatttctttgtggcttttactaatgaagttgtattttttttctacccatgttaggtgttgaataatttgaatgggaatttgaaggtccatggcttccaaaccagcaggagttaaggcttaattgcttggaaatacattttcatggctgataccagtaacagaaaaatgtctgtatgtcaagaggctctgtactaatcagttaaccataacatgtgccaccccataccttgggccaatgtaactgttaacagcttgaagctattaaaaatgtacc

SEQ ID NO: 245025 - DNA, 454 bp, Homo sapiens
ccgtcccacggctagctgaatcgtgagatcctggctcagggacgctcagctggtcagcagtcctattgggacctgtgacaacttagggcttctggctaccgaaactatcttcatttccacttaaaaagtatacgatttagctagaaacgaacgagttgtgaccgcagctttccacttttggtttatttgaattggtgtctcttcctggcgtctactgatacttggtcagggaatataaaattaatttacttatccaacaaccgaaaaaggatataattatttttaaaaagtaatctgcttcaaggtcaagaacatgattttctaattaactgctgtttttggtttcatagtcacactttcttcatgggcccgaataattgaatagaccgtgtgtaatgaaatttacatttgaaatgtgaataaaataatttttgcagtcttggaaattttgagg

SEQ ID NO: 245026 - DNA, 708 bp, Homo sapiens
caaaaagggaacggcacctagacaccgaaaagtaactgaagcaaagggagtttaaagaacgcgcccagccgcctgggtcttgaacccagtgttaatgagagcaaaaacctctgcatcctccactgagctgtccttgagcatgtctcataatcatgcttcattttaaaaacagaaataagtgagtaagctatgaaagaagacaacctttaaatttttcaaaagttcttggtggtctgtgattagaaatttcatctatatgaaataactgttttggagggcttactgttaaattcaggcattttagggccagtggaaactggttaagcattcacatcagtcttaacattaatctgataatctactgggagtttaaagactctaagcactaaacacagattttcctcactgtctataaaatgaaagaggaaagaagcattgtactaaattttttataaagctaattgtattcccttttttttttttgaggtagttcattgcattttgaacaaggataactgtcagaaaagatcctctttgaataaaacaggtatctcccccatggctgcttctgggtctgccctctgcaaccacatggaataggtctgattccggttcttcaggacaacttttcaagaattaaaaaatcacctccaaatgaatgcatttttacaaaatgaaaataggtagagatgctattttaaaaaaaaa

SEQ ID NO: 245027 - DNA, 378 bp, Homo sapiens
tgcgcctgtagtcccaactactcaggaggctggggtgggaggaatgcttgagtgccagagttcaaggctgcagtgagttacagtcatgccactgcactccagcctgggtaacagagcacgacactgtctctaaaaaaaaaaaaaaaaattccaaggcattaaaaaagttaacttttaatatacattttcttaaataaaatatgacagttaaaatttataaaattataaaagtaatataatcccattactgaaaatttggagaataaagatcaacagaggaaaaaatatctataatcttaccaccgtaaaataaccttattgctttggtaaaacatttccttcctgtgtttattcccatctctatcataaaaattcata

SEQ ID NO: 245028 - DNA, 555 bp, Homo sapiens
ttcttcccagaactctgtcccttgaattctcactgtcttggtctcctgggattctcagctccacctcctcaagtaagggaatgtgtcagattctgactgggttctctctctttgcattgtttaatctctgtgtattttggaattttccagctatctttctgttattggtttctaataattccattgtgatctgagagcagatattatatgctttctattttaaattcattaagatctgttttatggttcagaatgtggtctggtttggtaaatactccgtgtgaacttgaaaagaatgtgcattctgcccttgttgggtaaagtcatctatggatgtcagttatattcaggtatttgatggtatcgttgagttcaactgtgtccttactgatttttctgcctgttggatctgtccatttctgttaaaaggatgttgaaatctatatatgagatctataaggatcttcatatgtttttggagaatttacccctttatcattatgtaatacccctccctgttcctaattgttatctgttagatcaattcagaataaa

SEQ ID NO: 245029 - DNA, 438 bp, Homo sapiens
tataattaaattgggttgaaatagaacaccactccatgtcaaatgctgggtacatagccacaaattgtaacatacttttaacgatggcaggacgttgtttttgctggcagggctatgggcttccacaatggattatctttaaaataataataataatcactgtatgagggaaagagactagggaatcttgctttgcagtgtgcattttaatttttaaaaaaatttcatgaaatccttaagctaagtattcagtggaactatgttaattaaatggctacgacccacatggggaatagcaattttctctatttttaaatctcttcatttaaccatatttcagcactgatgacccacttgccatatacttttcatataacctagagaacttgtcttgccctccctagggccccagccttgcctatagagcacactctccaa

SEQ ID NO: 245030 - DNA, 439 bp, Homo sapiens
agactcttattatgtggatgttgctacatctagttttgtactctgtatttttttccttttctcattctcactgccttccggggaaacttctcaacccagtcttcttacagttgatttttaaatcatctacctgctattacaccaatccactatgttctttcttttgagtattttattttcatatataatatttccacttggttgttttaaaaaatttttctttattttattttcctcatcttctaaagaatatctatcatgcttaatttaaaatcttgacctttctgttccaacaacattgtttccaatgataaatatttttcagtttgttgacttaaagaaataacttacacttcccagatatcttgtttgttatttgagtctgtgaggcaatgtttccctgggactaccagctattctgtttggcagtgtgttggga

SEQ ID NO: 245031 - DNA, 714 bp, Homo sapiens
gcccagcctgggtgtgttttttttaatttgtctttatgaccccttccagtcgtagaactgtgtgtggagttactttttcaatgggaatagtaaggggaagagttttacactgcacatggaaacatttatgtaacactttataacaaaaaatgccatatacatgtgattgtgacatggtggaaggagcatgactttagggttcaaacgtggatttggatcttggatgattcattcagcagatgtgaactgagtatctgctgtttggtgagcactgggtgaacatagccagataaagcggatctaccctcacctcatggggagagttggagggagtgggaggaagagaccgctttgagaactctcctcaccgcctctgtgaccctgcaagttccttaactctctgtgcctcaggtttctcatcaaagaagtagtcacacctaccatgctgggttgtgaaaagtaaaatagatcacctttattaaagcaccggcagaagatctgagggaggtctttgtaaacagaagtcccctcctgcgactgttggtgtagacattgcgagccccattttatggagaagaaaactgagagagaaattttgagcaacttgctgaaaagagcttaagtaacttgcctgaagtcacgcagctagtaagtgaaagagctgagaatcaaatccaggtcttttgattcaaaatcccgcactctctttttttg

SEQ ID NO: 245032 - DNA, 454 bp, Homo sapiens
aagaatcataaatggatgctaaaagtaggtaaaagtttgaggagtaacaaaacacatagcctcagaatatctccccataaaatatttattaattacaaaagaaaaaaaacaacacttttgtaataagacataccaacatcatatgtctcctgatacgatgcacagaaaacagagcatcacttctggtagatttctgcccaaaatgcatacgtcgaatctaatcatgatgaaaccataagagaagctcaaactctgggacattctacaaaataaccaaccagttctcaaaactgaaaggttataaaagacaaagactaaggtaccagccaaacacataagacataacaactgaatgtggaaacgttttcttttcctacaaagacatgattggaacaattgacagaacctgagtaaggtgtacatattagctagtaaaataatgtgttgctgttag

SEQ ID NO: 245033 - DNA, 447 bp, Homo sapiens
agcttctactcagcagggggaagaaaaatggaccatgttataacaaataacatggcggtgaactctgtggatggtggagttgttctgtgtgctccagttcctaccgagattgtgcctaactcatcatgaatctcagcagcagcagcatggacaccatcaccagcagaagcgtttgcaagtatccaattatgggttagagactctgcaaggaaattacattcacccagcacctggccagaacctaagacttgtttcagcacttcttgcaattagcagagggcagttgcctccgtggtgtgtagccagttggggtgatgagcaattctccccacaaaagcctcatgagacatctggtgactgagttcgcaatggcactgcctcagtgtgtgtgcccataaaaaggcaagctgacagtacccgtctaggacagggttcaccaggcttgtc

SEQ ID NO: 245034 - DNA, 407 bp, Homo sapiens
ccatgcacttaaaaaggagcaaaaaaattacttttatttttattaacttctaactgaaatgcagcatttcctttagttatgaacatagacacacataggcacagtggtattagcaggacctgtgatattgtcaccagtagaaatcacagatattttcatgtcatgcttcagtggaagcagttactttgaataactgcctttgttcatcactgccatgaagttacatttgttgttaaatgtgctgatagatcttttatttcatgtcacagttgggtagagctgttttgttataggtgaaatggacgtgtggaaggctgagtgttgtggaatacactggaattctgtcttatttatttagatcttttatttcttttattctttaataaagaagcacttatcagatatca

SEQ ID NO: 245035 - DNA, 387 bp, Homo sapiens
cttttcaaaagttggcaattaaatctgaatttacagatacagataacagtttatcagaaatcatatttttcctgaagaaaatttaaaattaggagttgtgggcctggtgcggtggcttacgcctgtaatcccagcactttgggaggctgaggtgagcagatcacttgaggtcaggagttcgagaccagcatagccaacatagtgaaaccctcatctctactaaaagtacaaaaattagccaggtgtggtggcgtgtgcctgtagtcccagctactcgggaggctgaggcaggagaatcgtttgaacccgggaggcggaggctgcagtgagccgagattgcgccactgcactccagcctgggtgacagagtgacactccgtctcacaa

SEQ ID NO: 245036 - DNA, 414 bp, Homo sapiens
cattacatgacaaaagggacttttcaggtgtgaataatgttagagaccttgaaatggagatatcttggattttcttggtggacccaatgtaactacatgaatctttacaaatacaatacagaagaagggtgggtcagagagatgctatgtaagaaggatttgatctgttgttccaacctttaaaaatgaagtataggaaccacaggccaagcaaagcagtagcccctagaaagtggaaacagccttcagtttatagtaagaaaatgggaacctcaatcctataatctcaaagaactgaattcttctaataatccaaataagcaggaaatgaaatctcctctagagtctctgtattagtctgttctcatgctgctaataaagacatacccaagactcagtaatttataaaggaaa

SEQ ID NO: 245037 - DNA, 210 bp, Homo sapiens
gccagaatatctcattttagttaagcaaaagtataaagttactggtgagtttatttgaagatttggaagaagaagaagaagatagaaaatgaaaattagaggaggttttccttacttcaggttgctgacacaaacatttccttggttctctggaggcttttccagtggggttggcccattaaataaatatatgtttctttttgcttttag

SEQ ID NO: 245038 - DNA, 340 bp, Homo sapiens
tggggggtcagttttgtagacaaggtgcagtcgtgtggctggctgaccttagttattcagtctctagcttcttcagagaccaagccgatactgtgtggtctaggaccccaggaaaaaaaaaaagtacctttgtcagacaagatattccaagaacttagaggttatctcctaggaaccagtcaaaggccaaccgtttctttagaatatccagagtttggccacccaggcctgctgagcaggaagagggcgagagataccccagttccttcttccaatttcacctgtctgataaacccaatttttctttcatggggagtagtaagaaagggtagagagagag

SEQ ID NO: 245039 - DNA, 547 bp, Homo sapiens
ttgagacagagccttgctctgtcaccgagactggagtgcagacacatcacccagactggagtgcagacgcacaaccttggctcactacaacctctgactccagattcaagcaattctcctgcctcagcctcgcaagtagctgagagtacaggaatgctcaaacacatttggctaatttgtatttttactagagacggggtttcaccctgttggccaggctggtctcaaactcctgacctcaaatgatccgcctgccttagcctcccaaagtgctaggattacaggtgtgagccacagtgcccagccaaggccctctcttctactttatctacaatataacacgatcagggtccaatttggcaggaactgcatgaaaatgttgcaaaatacacaaaaagcctgtagacaactgcaagaacagactatgattaagacatacagtagaccaactaagtcacggagaaaaagagctgaagagaaaatgtcctccagatatcagggtactcaaaagcacccaggtatcctagggaattgagaaagccccatg

SEQ ID NO: 245040 - DNA, 442 bp, Homo sapiens
tgtttgttttccttcaactccatcaggcctttattcaaagtcttttaactctgttttactttatttcattcccctgcaatagctaaggtctaacaccagattaattggaatattagctagcattcacaaaggcctagatctgtaactctgaaattggtcaaattccattaaaaatttttgttacaataagctgtttgtaagatctgactagtggcttatttttaatagaattttgcattaaaattttatcaatacaatttgcaacaaatttgtctaaatatgtgaaaagatttcattgcctttttgtgggcttagattattttttaatgttgattttgaaatatatttggaattgttatctaaattctaaaagctacaagtgaaaataataatgaaagtaagtagttaatattagtggcaagatcattgccagtatcatttc

SEQ ID NO: 245041 - DNA, 549 bp, Homo sapiens
actacataaatcttggcttactatacataaataaaagttatacctcaccaactgtcccttgtctcagaggtataaaaccaaggccttaaactggacagagagtctagtgcttccattattctggtaatttaggaaacatatttgagtgtatttatatttgttaaactctcaaagttgttcgctaccaacaataggtgctctttcaactcacaatggaaagggagcaaacgtctgcgtagattagtggacttggagaatatatttgtaaaattggcatcacctccaaagttcctaggaggagataagaatctaaatggcccatggcataaataataagtttggaaaattattatatcatcaaactctgcatgtatttccttctccacagtttccaataataccacttccttgcctggatctatgctcctgtgtgacatgatgaacaagctgcagtacttgtgttacttctatcctggacataggaacaggtgataggttaattataccttcaagaagaattcttttcttgctgtcaaaacagtagtgaaa

SEQ ID NO: 245042 - DNA, 138 bp, Homo sapiens
ttatgttctaatttactctttgcttgttttgatttgcttgtttgacaatacatgtccttgtaaactatttccttttaactttttctcaatttatggtgcttattttccccattaaagacttaccaattttttttttaa

SEQ ID NO: 245043 - DNA, 340 bp, Homo sapiens
cggggtgggggcctctgtctgggtgtcacctgagtcttgctgacccaaggaccaatctattcgggggcctgaggtgttctgtctccctcttccagtacatcctgcacatgctgccggggtgaacctccagaaatgcacaactgatcgcagtaaccctctgctccagcttcagcctgagctgctttattctttattttttagagttagggtcttgctctgtcgcccaggctggagtgcagcggaacaagcatggctcactgcagcctcaaattactcgccctaagtgatcctcctgctgcagcctcctgagttgcagggattagagtcatgcaccaccacg

SEQ ID NO: 245044 - DNA, 592 bp, Homo sapiens
catggtggtgcatgcctgtagtcccagctatgtggaaggatcacttgaggctgggaggttgagcctgcagtgagtcatgatcatgccactgcacttcaccctgggctacagagcaagaccctgtctcaaaaataaaataacgtgttagatcttgctaactgacttaaagggactttcttgatatattgttaagggagaagagtaatatacagagagatgtctataatatactattttggtaaaataatgttgaaaaacttaaacttctccctatacctatataggaaatagaaatgtatgtgtatttgtatatgagtatagaaaaaggcctagaagaagacatagaaggttgttaattgaagtagaagtagaggcaagatgaaaaaatatttttaaaatgtgtccacagtaaaataactacatgtaatattattccttttaacaaaaatatgtatctttgtatgaattttaaaaagaatgaaaaaaatgatcatcaacattttaatggttattttagagtgatgatatttcaagttattccttatatttttcattgtcatttgaactttttacaatgattagggtaggaaaa

SEQ ID NO: 245045 - DNA, 461 bp, Homo sapiens
gagatggcttcctaagttctaagaacagaagtggtctatgactgtgatacatccttctttggaaataactaatgagttatgagaactgaattatgaaggaagaaatatgacttaacagaaaagaaagttgttttaatgagtcattaggctatttagatttacccaacatgaagaaattaaaggacatttccaaaaggctggggataccttctgaagttctctgctgcttatggtcattgttatggtgatttaacttctgatttctctgacacgggcctttttgcccctctttttgtttgggatttgtctgccgtttattgaagactcatttgactttttgtatactgtaccctgtttatccctcactataactctataaggaaggcaatctgatccacgttttattgatgaagaaaatgagtcaagggaaagttaataaaattggagttactattgaatag

SEQ ID NO: 245046 - DNA, 465 bp, Homo sapiens
aaatgtcgaggcttcagtgagctgtgatcacctcactgcactccagcctgggtgacagagtgagaccctgtctcagataaaaggagggcagcataaaatagcctatgctcattatgctatgctaagtgcaactcttagacaagaggaattgctgactgctgtgggctctgtgacttggctgaattggggtgggaggattggggttagagtaatgtttctcatagtgtgtgtttcacgaatacatgaatcaaaatcacctgaaggactaatttataaatgcagcttcccagacccactggattagaacctttgggagtgccatgaagtgacattttaaaaataagctaggcaggttgcagtgactcacacctgtaatcccagcactttgggaggccgaggcgggcggatcacgaggtcaggaggtcaagaccatcctggctagcatggtgaaaccccatctctact

SEQ ID NO: 245047 - DNA, 474 bp, Homo sapiens
atattgtaggtcttgagctctgtttctgagcctttgctgttaggttgtctgtattttctttcattttggaactgttttcttcttttaattatgtaaagctaaaactcagccaggtgcagtggctcacacctgtaatcccagcactttgggaggcttaggcagctggatcacctgaggtcaggagttcaagaccagcctgggttggcccggtgcagtggctcatgactataatcctagcactttgggaggccaaggtgggtggatcacttgaggtcaggagttcaagaccagcctggccaacatggtgaaaccccatctctactaaaaatacaaaaattagccgggcatggtggcacatgcctatagtcccagctactcgggaggctgagggagaattgcttgaacccaggaggtagaggtcatagtgagccgagattggaccactgtactccagcctgggcggcagagagaaaa

SEQ ID NO: 245048 - DNA, 446 bp, Homo sapiens
tgagtcaacgtctcgatctgtcgcccacgctggagggcagtggtgcgatcttggctcactgtaacctccaccctcaccacgggttcaagcgattctcttgccccagcctcctgagtagctggggttacaggcgcccagcaccgcgcctggataatttttttatttttagtagagacggcgtttcaccatgttggtcaggctggtctcaaactcctgacctcgtgatctgcccacctcagcctctgaaagtgctgggattacaggcatgaacgacggtgcccagccgacattaagatatcttaaggagagtcatttctccaatttgtcatacagaagctctagtttttagtaaatgaatttttaaataagagcatacctcttttactttgttcatcattttaaaaaaagttctaagaactccttctgaagcctaatatctggtcact

SEQ ID NO: 245049 - DNA, 364 bp, Homo sapiens
caccacagttccccaaaagtccttgcttcagccacatgggcctttgtgggccttcaaatgtgtcaggtgcattccctccccagggcttttgcagatgctgctccctctcatccttcaggcttcagcgtgaacgcctctcctgagcagcgcctcctcaggccactgctgttggaatggcctccctcttcccatcttccttcatcccagcacgtccttcatagccctggtcacattgtgcaatggtatctgtgtgtcgtctgtggctgtccctctactagtctgtaaatgtgacggatgtagggacctctgggtctgtcctgactctatatctccagtgcccaataaagctttaggaaacttggta

SEQ ID NO: 245050 - DNA, 473 bp, Homo sapiens
acctcctatgacaggaagcaacttcccctttgctgtgtctcatcctcacgtgggtgctcagaaatatatgtattgtccacagggtgcttctccatccatcagaaaccataaatttccatgtgcatcctcctattcagagcatgagtgatgggcgccttccttcgtggccagggacagcatcaacctctttgtcaacatcattcctcatgtcctccaaaacttgaatgctctaaaacaaccccaggactacatgcatgctctgagtacttatttagggatgtgcatatgtatataacttgacacacatgccacacatatatatacataaacatatatcttatatcaccacatccacattgcggaagccactggctggggaggcagcactagtaatggggaatgctaaagacggtgctcagttttctctcttggcttcactccccacacacagggccccagtgactgcagatgga

SEQ ID NO: 245051 - DNA, 336 bp, Homo sapiens
aataaacatggcagtaacatctatagtttgacgggtatctttaaaaacttatggtaagacattttacagtatcaaataatttctaaacctaaagaactgcatccagtaagtactcaacatgtatttactgtggaagaaaagagggagggaaaacgactatttctcagttcaagtaaggaaatatcagtttttccttaagatttgaaaataaaacataagtaaagccggcatcagtggaaaaaaagggagagaaatcttcaaaaatggtatctgggactttcaaacgagtaaaattgaccatttaaaaacttagtcttcaaaagtccaaaagtctca

SEQ ID NO: 245052 - DNA, 429 bp, Homo sapiens
aattactctactacagacctttgcattttatattattttactttatattttatatttttactatcttaaagattaatgaaatgtatagttataactctgctttaatggcatattacctatttttccatcctcagcatccagcagtgtattacacacaatgaactttcaataaatactccttgaattaattgttggtcatatccataattaaattaatgttagatcttagagcaaatgcacaacatttgggattaagtttgcctttatgatttccaagaacacactgaggagaaacgtagctctccctaggtgtagatagtccttccaaggaacatgaaagaagggcattttaatatctgagagtgcgtcagaacatataaaaactttaagaaaatgaagcacttcttttccagattagcatagctactt

SEQ ID NO: 245053 - DNA, 196 bp, Homo sapiens
gtgagcagcagtgctgctattaacatttcatgatgtgtactccacacgttagcaccctggtataagatatctaagagcaggccgggcgcgttggctcacgcctgtaatcccagcactttgggaggccgaggcgggtggatcacgaggtcaggagatcgagaccatcctggctaacacggtgaaaccctgtctctac

SEQ ID NO: 245054 - DNA, 475 bp, Homo sapiens
gctatttcttgatgatatgctaaacaaggggtggattattcatgcctctcctttttagaccatatagggtaacttcctgacattgccatggcatttgtgaattatcatggtgctggtggaagtgtagcagtgaggacgaccagaggtcattcctgtggccatcttggttttggtgggttttggccggctcctttactgtagcctgtcttatcagcaaggtctttatgaccttattttgtgccgatctcctatctcatcctgtgacttagaatgccttaactgtctgggaatgcagcccagtaggttttagcctcattttacccaactcctattcaagatggagttgctttggctcacatgcctctgacaaaagtaaagctctcagggggctcaggctgatgggttcccttttacttctttgaatccccagtcgggcttggaaccatggcctgtaagcgcatccgacacttggcta

SEQ ID NO: 245055 - DNA, 383 bp, Homo sapiens
cctttctaaaatgtagctactaggaaattaaaaaaatacatatgtggctcacattatctttttgttaaacaatctgcttcaggcttttcattttacagaatgaataacaagttttacatctctatagacaaagtacaattcgacacttattagacttgatctctgtagtaagaatgtgtttcttacatgaattattgtattttatatagataaaagataaactttcgtgttttattagccgggcgtagctgcgggcgcctgtagtcccagctacttgggaggctgaggcaggagaatggcgtgaacccgggaggtggagcttgcagtgagccgagatcccgccactgcactccagcctgggcgacagagcggatccgtctcaa

SEQ ID NO: 245056 - DNA, 477 bp, Homo sapiens
tgaattttcatggccgtgggacggacaagaactttatcttcagctgaactaagaaaaagtcctgcaacatttttggcgcgcaatgtgggggcaccagaagcgggcaccgttgagctgttgcaactgttctgctggagccttatgtatgtggttgaaaccacctgtactactggaatgaaagcacctttacagaagaggcaatgcaagttgtattcatcacatgtgtagaatgaattaagatttatgccagttgcaaagaagaatattggctcactatttttcctctgggcatcagcatatgatcccctgttgaagacagacaagtacatctttctggtggctcctagacctggcattgggaacagaagattatcagtatgatccgtacgcttaaggaaagatctcatattattgaaatgaatattttatttgataaattgaactacagaataaagtacttttaacaaaccaaaaaaa

SEQ ID NO: 245057 - DNA, 759 bp, Homo sapiens
gccctcttcctccttgtttggccatgtaagatctgtctgcttctccttcaccttctgccataattgagccttatgtatgtggttgaaaccacctgtactactggaatgaaagcacctttacagaagaggcaatgcaagttgtattcatcacatgtgtagaatgaattaagatttatgccagttgcaaagaagaatattggctcactatttttcctctgggcatcatatggagtcttgctctgtcgccagggtgaatacagaggttgcagtgagctgagatcggctatgattccagcctgggggcgagatagcgccatggaactccagcctgggcgatgaataaaactctgtctcaagaaaaaaacaaaaaggtaagcttaatatttaattagatgataacctttcactgtgcaatctcaagaggaagatttctaaattagacatggtctttaccttacagaagaaaatggtctattcagtgtctttttaagcaagattgggaccaaaaacaggtggtaagggtgtgtaatattttaacttgtccatgaaaatagtgtaaatgcgcacccttggtaataaaggaagtgatctccctttgaattatgggaagtcctgtcatggatatggggtgctgtgtacatatatgtttattcctttatactgacaggataatatatggggctgtcctcaactttaagttcaggaaagttggctgacagatatgtttaggaaggtatgagttaaaggggctgtccttaa

SEQ ID NO: 245058 - DNA, 871 bp, Homo sapiens
tgaattttcatggccgtgggacggacaagaactttatcttcagctgaactaagaaaaagtcctgcaacatttttggcgcgcaatgtgggggcaccagaagcgggcaccgttgagctgttgcaactgttctgctggagccttatgtatgtggttgaaaccacctgtactactggaatgaaagcacctttacagaagaggcaatgcaagttgtattcatcacatgtgtagaatgaattaagatttatgccagttgcaaagaagaatattggctcactatttttcctctgggcatgtggaaatgtaaatcagtccatgttactcacctcggagaagcagaagtacgatttactattgttgcttgcttacttactcttatcaatttctatgagagaaagagacctcaagtaaacctccagcagccatctggacttccatgaaaacagaacaatcagtgggatgcagagcttggaggagacagtttccatagactgaagcacgtgctgaagcaaagttcacacttgcaggattagaagaggttgaccgaaagaaggaaggacatggacagctatgttgttgtggagtcctgttttatagtcataaccttgagtcaagtgagtttgtctggacagacagagcttgttgcctttacttatagggaaggcaccggacacagacagcctaaaggacatttgttctaacctttcagtatcctttttcttaattatttcacctgatccctgaagctggtatgtacgatttttcctttctttctaatcctttaaaaaattaaggctctaaatctcatttccacttaaattttaatggcgcattgggacttaaaataaaactctctttgaagtaaaaatcatga

SEQ ID NO: 245059 - DNA, 691 bp, Homo sapiens
aacaaacaaaaggagagtggttatttctgcaccaactatttcaaatgcaagttactccatcgctcggggtggttggatggtgcttgtcaccataggacccacagggctagttccaactgttattcggtaaggcttttttctttccaaaattcccagtgttcctttaaggcccatttagctgcgggttttgtttattctcccggcaatcagcatttaaaataagacaaacaagcattttttcctgggctgtgaatccccccggccagcctccacctgcacacctgaagccagcatgtccaatcaaatttctctgtaacccatatcccctttagagacttgcccccgtcgtataccaggctggaaatagagaacttaagcagggcaaatgtaattttaagaattgctaatgatgctagaaatctgcaatgcaattagcgtcattggatttggcgctcctccgaaggcacaaaactccttgtcatagcgcagtggcagcagcggcaagtgcctccgcatgtgccgggctgtccgggtatgctggcagccgctttgcactgagatgtgagcagttggttaggcttcctctctttctttctcacagatactgacttctttgtctcttttctgggttgcagagggatgggtattttccattgattattactttagcatttgaccctccagtggagtc

SEQ ID NO: 245060 - DNA, 500 bp, Homo sapiens
agcattcttcctctagaaaaagacctaagcccccctttacagcagttaggagatctcatccccttctgttttgccaagcaactgctgctgaggcatctatttgatttcgtatggtgatgatactttggccaatgtctctattttttcttttttactttgggcaatgtcattcaagctttccataaaatccttggaaaagcattggtaataggatagggatgttacaacccggctgactcccattcccagtcccgcggttatttgtagtcctaccaaaagggatgtgagttggatggttcatttgtgtctggcaattgcagttaaaggtataatgagggattggttcttgggagctatattaatttcacaggctaaataaacaagtgtaaaggttctagtccaattggctggtaaacataagtaagaactagttccacacaggtaaaaggctcctagtttttcaagacaagaattttctatggtaaacatgtgggttagct

SEQ ID NO: 245061 - DNA, 571 bp, Homo sapiens
tgcccaggctggagtgcagtggcgtgatcttggctcactgcaacctctgcctcctgggttcaagcaattctcctgcctcagcctcccaagagtagctgggatttacaggtacacaacaccacgcctggctaattgttgtatttttagtagagatgtggttttgccatgatggccaggctggtctccaactccctacctcaggtgatccacccacctcagcctcccaaggtgctgggattacaggcgtgagacacagtgcctagccagtgacttcttattttaaaattgtcccatgtggtgttaggcaactaccagaatactgctttagaagaacattcaatagtgagaaaatatgttcctcatatattagaagagaaaacaggcaggcagtatgaacgaatgatacctgttcaaaatctactgattcattcagaatacatacataatattaacaataggatatctggctaatggcaatactagtactttttttcttaatcttttcagtatttcaaaaatctggtacatttgaaaataaattactttcataatcaaaaactataataaaagc

SEQ ID NO: 245062 - DNA, 395 bp, Homo sapiens
aatatgaaggctggggaaaaagataaactgccaccccttgggaataatacctattggccaaggcccatagggatcggcaggttttcttacacatgttttccggttctacttggaacatgagagttatcaccaagtccttcatgaaaggtagctagtgttttatgagtcgatggtcaacatcttgtactgactgagtagaaggaagatggcatcattgtgtaaaaacattcactaaaatagctcagtgaccactgcaaaaaggaaaaaaagatggtagaaagaaactgggcatttgtatagaataacttgaaatgccatttgttttaaattctggcactttccctcaaatatcacaaaagaccacttaagatacatttgttgtggtgcaaagcatc

SEQ ID NO: 245063 - DNA, 580 bp, Homo sapiens
tggggttcaagactgatctttaaacaggcctcccagattgcttcctgaaaagactgtactgactcaggaaaagggccggaagcacatcctcttaaaagcacctttcagactgaccaagcaatgtgacagaacagaaagatacaggttctagtcccaggctggccccaaactgtcccttcaggtcactcagcctcctgcacatctcagatgaatctatgaagtaagcttcaacctggcttctaaagtataacaatgctgccgagagagcagtgctgacaacatctaaactatcagacaatcccaaaatgtcctctgggaatttttttggcagctaagacctttcaaggaaacccggaattctgataacacataaatacatcaacatactagaaagcgaaggaatatggtagtggtatgatgtagaatcttgcttctttcctctttttctttcttcccaatctggaaccaggtgaaatacaaagtacataaaggaatatttaaggatgaaaaatggggcaataaacaaacagataaaggctaacaatattattgggttttttcttagcagtgtttcaatggg

SEQ ID NO: 245064 - DNA, 1999 bp, Homo sapiens
agcggaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacggtaggaaggactttgggttaggaaggaatcatgaggatgagggaagaagaaagagtaattactgttttaaaagggttatgtgttaaagtaaatgaaattgttatttttcctagagtcaaccaaagatcagcatggtccctgttgttctaaagctaaacctctcaaggaaaaggactcagtgcataagatgactttggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcacgccagcctgggcgacagagcgagactccgtctc

SEQ ID NO: 245065 - DNA, 731 bp, Homo sapiens
agcggaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatatgctcagtccctggtatgatgagtttctagatgaagaggactactggtttctcctttttacgagtcaaccaaagatcagcatggtccctgttgttctaaagctaaacctctcaaggaaaaggactcagtgcataagatgactttgacacagaacaggttcatcagctccagacagcataaaagagaatttataggcaaagaagagaacattcttctttataagaggattcagcagtctctagagttaagccaggctttggctgacatgaaggaa

SEQ ID NO: 245066 - DNA, 887 bp, Homo sapiens
acactaacatcagatgcaacctaggcaagggttctcttatgttctgctctgggaagcatttgaagtatttcagttgtgagtaccactccagccaatgagagaaccagatggagagaaggccatgtgaggaatgggttgaagaattgcctggtgactagccagtggggttggagagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcagtaagaattataaagcatctttttggggggatgcaacaaaaaagtaaa

SEQ ID NO: 245067 - DNA, 533 bp, Homo sapiens
agcggaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcagtaagaattataaagcatctttttggggggatgcaacaaaaaagtaaa

SEQ ID NO: 245068 - DNA, 439 bp, Homo sapiens
cagggtgtttggtcttttgagatgtcataactaatatgtactcctcctgtgattaagccagttcaagtttgtttgtttatctattgtaagagattatgtgctgtttaataaatatccttctcttggtttctcgaaactgtccccttaaagaactgaacttggggtagggttgagataagagtttgggtggggtggtggtaagagtttgggcctcccaagggctggactagactaaattggaggatctctgggcttcattccacttctgtccaccccagtctcacattcacatgcgttctcagttggagctataacagctcttatttttctcctggagtccctggcctttcagtggctacttctcctttcatcttctcatttcttatatttttctcttttgttcttccgtcagtcatccttctgttttctgacaattcct

SEQ ID NO: 245069 - DNA, 517 bp, Homo sapiens
tactcatgatgccaaccaatgttggaaatggctccaggaaaactctggattttcctaactgtggtcagcccgtggtggaacctcgccacactcttgttctggataaattgaagcaactggagaaagactcatgacacaagtttggccatggaacatgtttggcgtgtgtggttaggggtcatctgatgcatcctaccaacgtgaccccaaggaaagtgctggaggaattgggctcagatcctagagatgagctcatgtcagactctggcctccagattccattttcctggctgactcccagggcaccatggagcaaatggccagtgggtgtgccatggcaggtgagacccgcccccccaacccggcattctgaagcccttcagctggagaggaggaagagatgtttcatttgttcacaatgtttcctgaagcactggaagcgtaaattcctgagttgatgggtgtgtggggtgcaaagaaaaaaaaagtgaagtgagaataaattttacttagatgc

SEQ ID NO: 245070 - DNA, 330 bp, Homo sapiens
ctgctgcaactgcaccacagttcaactcttcctttacccagttctgcttctctcactcccttataggtgttgttcctgagaacacactccaaaacatcccatctgcatataaatctccatctctgagtccattttacagggaaccccacctaagacaagatgcagcttagaaaattattattaggaaaagctgtcctattcacagttgccagagcctactttccaaatagaaaacactagttaccttggaagaagtctttggagaagaatcaccaggatggcttatctacattgtataaatatagagaaggaggcacccattacctggga

SEQ ID NO: 245071 - DNA, 208 bp, Homo sapiens
gtttcatccaagaccagcagccaaacgtttaagggtttgtatcaagacaaacataattatgagacagaaagggcctattagttctactatgtaattttaaatctcaaactatcaaaacacacacacacacacacacacacacacacacactaaaaaacccctcttcatcttctcatttgagaaggctgtaattattccagggtcccta

SEQ ID NO: 245072 - DNA, 231 bp, Homo sapiens
ctggttcaagtgattctcgtgcctcagcctcctgagtagctgggattacaggtgtccactaccatggccagctaattatttatttatttatttatttttgtagatggattctcgctctgttgcccaggctggagtgcaatagagcgagactctgtctctgtcaatataaatatatattaataaaaataagatatgcaggcacaaaagactacttttttttttttttataca

SEQ ID NO: 245073 - DNA, 347 bp, Homo sapiens
tgagtgtgggctgtgtcctggggaatacttgggaacggccatggtctgggggcaggaggccttcggagtgtccctcccccgccactccctggaggaccccgggagacacaggcgagttcgcccctgcccctgccaagccagtgggattccccagcaccccagtgagcagaacctgtttggaaagaggcttctggaaggcctgcacgattacttgtataggttcccgaagtgataaataaatgcatgggtaaaggggaatccacttagattccctaaaagcctttgaaacaaggtggtaggcgagtctgttctgatgtgttagatccccatgcagtagtgttgtggtt

SEQ ID NO: 245074 - DNA, 402 bp, Homo sapiens
ctaatattacttagatttataggcccctataaattggcatggcatatttggcttggtttaaaaagtgttttgagggaaaaaatgtaagtatgatccgtataagtatatgtaaactaatggaagaaaacagtacactcatagtcaccttcctatttcctagaaagttcctgtgaagagttttaaaagattaactgcttaagcattatactaaaaataatctgaaatatatgagggcgaggaaaccaccaaaaaatccatagattaactcaacaaaattatattttgcagagaactcttatttatttatttttaaaagtagtcaccgaattggttttattttttcaaaagtatttgaatggtaatatttaattttctgcaggtctcagataacttccatgacac

SEQ ID NO: 245075 - DNA, 443 bp, Homo sapiens
gcagccctcacaggcctagggtttctcagaagcacactctgatgatcctcacagtaccccagcccaggccccacagctgctccccagggcagcaggagctcggcagcattacagccgactacagcccccccacagcccagacgcactcacgcaggctaacaaagggtgccccaaagtcctgggagagaagcaaagcggagacaaggggacagagcgcccgccttccctcccaggtgagaacacggaggctcagagcctctccaggcagcaggaggcatggacccagggcctcctccatagctccacaccagcctcaggagcagagcggccccagctggcctctgagggtgctcaaggctttgccaagcaacaggccagggtgtctgcctctccctccaaccctctgagcaccaattaaatcaactctaattaaaaacaacaaa

SEQ ID NO: 245076 - DNA, 2771 bp, Homo sapiens
agcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatccta

SEQ ID NO: 245077 - DNA, 3035 bp, Homo sapiens
agcggaagcccacaaaacttccacgtttgggccctcaccagagacactggtctagaaacacaataaaatgtctgcctgggtagtcatgatcattctattatgaggtagacaggaaacagagcagggccaggagatggaaggggcctcccttgccctcaggagtccctgaccagggaagatccctccatgctctctgagggtggcggggctccaaagatcctggccaggagtgctttgttggagtgggccttgtcctaggcagttgccaggtgagcccattcacaccctactggctgtgctgctttccgggccctcagttcctgctcagtaggacgttgggcaaatgtccaggagccatctgggtgagcaagatccccatcaacagcaagaaagcattgtccccattccacactttgaagatagaagatggtctcacacttggcctgagtgacctccactctcaggtgctgcctgtgtgcacacctggcgctcaaaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatccta

SEQ ID NO: 245078 - DNA, 2585 bp, Homo sapiens
ctctgtgagatggcacccctggacactggtcaaaatctcatcccaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatccta

SEQ ID NO: 245079 - DNA, 3027 bp, Homo sapiens
acactcttggctatgcgcttgtcacggaactccacccatccctctgtgtagtccttgctgtggtactgcttttttccctcccacggctgctgctgccttctttttgcatctcacaaaccagtcctcagcctgaaagaacgcatctgacctcaccataggcactgagaaggttgcggacatgtaggggctggaagtgtggtgggatatggcccaggtacacaatacctggcactacccgcttcttgctgccacaggctgctgctttggattcctcctgctcctcctccacatctagtgtctggtctgtcccttccagcgcctttgctctgttgcggccttctccgattcctctgcctccgtgttgactgacacgagcagcacgacctaatttcattacttctaatgactgcatagattcatttgcatggttaaatcacaatttaacctattttatattgatgtatatctaaattctctttttcacaatagaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatccta

SEQ ID NO: 245080 - DNA, 3177 bp, Homo sapiens
agcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaaaaaaaaaaaaaaaaaaaaaaaaaaaaaaaaaaaaaaaaaagaaaaaaaaaaaaaaaaaaacaacacaaaagaagcaaaaaaaaaaaagcaacagcacagagacatagaaaaggggcgccccagagggcggaaaaaaaagagaagaaagaaaaaaacgaccgccaagcaaaaaatccaggctactaagcgcgcacccatcgtgaacgagcacaccaccaacacaccgaagcgcagtcgccacccatccctagggacaccactatccagacaaggacagtataccacccacaaggagaacatatcaaagtcacaaccaacacaagtgggaccacacacctgactaacaccgcactaaccgtctccgaccgcaccaacaacagtcatacaaggtcaaagaccaccact

SEQ ID NO: 245081 - DNA, 3267 bp, Homo sapiens
agcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccatgtagtcattaactttgctgcatttctttgggatttcagagggaaatggtgggaatggggaggctgtttgataatctaaaataaattcatgaccatttgagtagaaatgttttttcaggtgtaatggctgtacataaactcagtagagtgccagcagcatttgagatgcaaccatatttttgagagcttttaagacagaatgctgaatattaggggagcattttatgtactgattgtggaattaacaatgtgggcttattcagtgtctgtcattagaatataagctgaaggaagaaagatcttggtgtgatagttttttggttaaaagataaaacaccacactggtgataatgcttttcttagtttgggagattttaaaacaatatggactctagtctaattgcatatatctaattacaaatgttcattggatttaggtgacaaaacacctagtttcatcattctgccacctttttacaaaacaagtcagagc

SEQ ID NO: 245082 - DNA, 2920 bp, Homo sapiens
agcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcagcaacgtggaaggaaccagaggctgttattctaagtgaagtaactctggaatggaaaaccaagtaccaggtcgtctcgcttacaagtaggagctaagctgtgggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttagataatgatactgagacacccagcgaagataggtaatttgcaacacaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatccta

SEQ ID NO: 245083 - DNA, 2714 bp, Homo sapiens
agcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttatcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatccta

SEQ ID NO: 245084 - DNA, 1774 bp, Homo sapiens
agcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgcttcgggaattgggacgagacttgaacttcacattgttggccgcatttaatatcttttgagacaatatatcagggggacaatacacacaattgcgggggtgtgtgccacgataataaacacgggaatcggggccccccgatatatgggggacacacacggtaatatacataggag

SEQ ID NO: 245085 - DNA, 878 bp, Homo sapiens
tgatggagcacggaaacttgttcagaccacatatgagtgcctgatgcaagccattgatgcaggtcagcctcagtgttgagcacctattggcagtcctgtgtgttgatgggccaagaatgactgggcgctgcagttctgtgcattccttgtaccttccaggttgcccctgttctacctgagttagctttggttgttagcagtaatgggtaaaaggatgatctgggaatctcttggtggtgatagaccagatgattggttagcatcctttgtttcttctgtgatttatcttccttttctttgcctgataaatgaagaggactgtgcagatggttttttagtgcaacttttattctatttttaaaattctttccagtacataaatattatgttctcctcataaaaaattaaaagtgaagattatgagtgaaaaatgtgtgatcctcctttacacttgcctcccctcttatctctctcttctctctagagatatcccattaccgtttaggttttttctctctcctgtgcattaatgcacacacgtatgtgtatgtgttaaattaagttaaatggaatcataatatttttaatgtgtaactgggctgttttttcaactatcatagagatcttttcaagttagcatatatacctacagacatagatttacctcattcttttaatggctatgtattatattctatagtattacaatttgtgtaactattctgttggattttggtgctttccagatttcttactattgtagtaatgggtaggggtgtatttctggaggatttttctcaggctgtctgtctttgtacatatgaacaacttatcgaggcttttttgtttaatcagtatcttatggggataagagaagg

SEQ ID NO: 245086 - DNA, 149 bp, Homo sapiens
gctctaagagacgaaccattcaggcttcctggcccctcccccagacccctctcctgggctctgcagggctctgggctgactaacccacacccacacttagcacaggcactggcctgcttgcttctgtctctgtcttctgctgcagactg

SEQ ID NO: 245087 - DNA, 683 bp, Homo sapiens
ataacaggataatacagtatgcttaggaaaataaggcttttgttgggaattgaatcctagtgtgcagaagtattagctgactctcattataaacaaattttaccagttatttcctaacagactcttgtttaatgaataaacgctttgcttattaattacacaaaatttggtcaaagcattagaaaagattaaatagttttgttacggtgtgttaaaaacttggcttttaaccttgacatttaatggattggaccacacgggccaagttccttctcctttgcaaaggtatggagctggaaatgaacttagagatcagactcaagggaccacagcttgcacttaatagtttacctttatctgtgctttagctgtgcttttggatgtattaagaactttttaactgccttaatagactgttatcccttttactctttgatatgtgacatttaaatataccttgaatttgaactggttgtcgttatgtgttgggaacaaaattacttttgatgggaatacatttttgaattaaaaatgcaagttaatagataaataatatctgattattatagattttgaaatatttatatttaagccttacaaatgacttttcagtacaaacaaattctctgattagactttctgatcaccgtagcaaatatgaattggacaataatgtgaatgta

SEQ ID NO: 245088 - DNA, 578 bp, Homo sapiens
cagggttggagtgcagtggcgcgatcttggctcactgcaaccgccttttcccaggttcaagtggttctcctgcctcagcctcctgagtacctgaaattacaggcgcccgccaccacgccagtctcaataccttcacagaggtgaagaagcagcaaccaaatgaattagacagcaacatgattcctagagaatggcaagaccaattcttcaactacttcttcagcatttctgaaacatatggaagatggcccattgtgctctcttaattctttgataatctggacattgacttttccattatatgacctgggcttgtgggcatcatgtcataatgcacctgttcagacatctccctgtaccaatatggatcacttgaagagactcctttgcccccatcaaaaaggatacagttgtgtatctcttccatttttgtttacagtgcctaaaattatttgagcagtttttcacctcttctctgataaacaccttattagtccttaaaaagaaaagaaaaaaggaaaataaaacttttattgagatcctagaagaagaaaaaaaaattggccttgttggcctca

SEQ ID NO: 245089 - DNA, 391 bp, Homo sapiens
atttgcaaaacaacagcacttaggctattggaatttgatgtgctgtgtgtgtggtttttagatggaggcttgtttgtttgttgaagaaatcttcagccaacaataaggctgtgggatcatccatctgcaagtatcttttatccctgaagcactgagacagactggaggctacacacagaaactgtctctactccctctgccagccccaggtcccctctggagggggcctaccccaagcagcagggacagcagcagcagtccacaccaaggggtgggaggggcatgcctcctagccagtctccaaggacgcagttcattatgatgcatcctcgttgccatggagaccccaggcccacagagcctggctaatagtccctgaattcactcaggc

SEQ ID NO: 245090 - DNA, 500 bp, Homo sapiens
ctaacccccgttgtggctgactgtaagttctgtgaaatcagggaacacttgatgatagctagtagttgcccactgtgtatccactgaagcacctaccctggcattctacacatattcataaatgtttttgaacaaatgaatgaaacaactaagggtaaaactatctgctatttatccagaggcagaaccagagtcatgggcccatgagtggacacaagtaatgggacacggaatattgatcaacctgttctagatgtaacctcagtgtctgaatactagacagaggtggaactgagacaggccataggtgagataactatttcacaagtaagctatatcccatagccttctttaaaagggtgagacaatgataaggtgtgatagttaattttatccatcaattggctgggccatgatgtccagacgtttggcttaacattatactggatgttcccgtgagggtgtttttttggatgagattaacattctaatcagtggac

SEQ ID NO: 245091 - DNA, 595 bp, Homo sapiens
cttcctctactttttgagagctgatccaaactcataatatgaatagatggacattgaccaaagagaccagcagcagaacaaaagcataaacaaacatgagagtaggctaattttaccaacctgaggtcaaaaagttctcatgagatctggtcgtttgaaagcatgtaccacttccctcttcgctcactctctccctcccgctccaccatgtgaagattgtgcctgcttctccttcaccttctgccatgattgtaaatttcctgaggcctccccagccatgcctcctgtacagagactgtggaactgtgagtcaattaaacctcttttctttatgaactactgagtgtcaggtagttctttatagcagtgtgagaacagactaatatagtactcgttcaaaatatgtaagtaaactataggacaacagaaaaagggtgacaatttgtaagaaaagtgggcaaaggcttgaatggaaaatctgcaaaagagattacaggccaataaccacaggagaagatgttcaactgcattattcaccaggaaaaagaaaattatcttttgcaccatcttatacccattaggatggctattataa

SEQ ID NO: 245092 - DNA, 274 bp, Homo sapiens
tgaagtaagaaaaaaggacagaggtatcataaaagatacaaattcagaggtattgaaatacttatgcatcaaaacaactatggcaaaattttactgattcagtattatgcctatgaaaattattcagttcagtgatttggagaagagggtaaagaaatgtttacacatcagaatctgtggaggggagaatgtgtgtctggaaagaaaatggtattttgtctcattggtttgatttgtttttagttataatatttcatctattttgaattttata

SEQ ID NO: 245093 - DNA, 341 bp, Homo sapiens
ttggccaataaggtcaataaaacttgagcaactagcacatctgatgtcgccaaatatacaatgcaacagataaggatgctgctgaaaaaacaggttctcttttttttcttttcgagacagagtctggctgtcacctaggctggagtgcagtggcgtggtcttggctctctgcaacctctgcctctggggttcaagtggttctcctgcctcagcctcccgcatagctgggactacaggcacgcgtcaccacacccagctaaattttttgtatttttagtagagatcatgctattattgcactccagcctgggcaacaagagcgaaactccgtctcaaaaaac

SEQ ID NO: 245094 - DNA, 406 bp, Homo sapiens
ccatatctaatagcaaaaattgaaaacaaagtgcccaggaggagttgaaggataagtaaaccttaaaatatgcacatattctctcaaggaacgtggatagtattgtgactgattcttctccatgtgtgatccacatagatgataagatcatcatgagaagaacttaattttatacttgagctttgctttgactgaaagatgagaaattttgtgattattggtatcatctctatgatgtcatattacctagattcacatattcttaactccattaaaatagaaattatatttgtgggcggggaacttattttcatccatctctgtttccttccaattgagcaattccttattttatgttaacctgattttagtggttcattgccataattcttagaaattatatctc

SEQ ID NO: 245095 - DNA, 474 bp, Homo sapiens
gcaatgcacactgaaatagaagtctattattcaaccactaaactgccccttcctatgcctatggaatttgctaattagcaataagacattgttaatcaattatagcgttgttttctgctgaaccctgaggaaactgcataatcctaaggcagggttctaggcagccactaccaagcattcaaggttggcactagaaatgatacctatttgccttcctggcatataacatttctaatttctccctctccactggcttcttctttacttcctccaacacacataagcctttatattcaataacaaacagttgtggaatgcctactgcatgccagtgctgtttaaggcaataggaaatacagaggtaacaagaactagcataatgtaacttacacttattgagggagacagacaataaacaatcattaaacagataaataaggtttttccagacactgatcagtgtcttttgtaaga

SEQ ID NO: 245096 - DNA, 300 bp, Homo sapiens
tcatcgttgttgctaaggttggttggtggaccgagacccagctgctcaaattgtttctccttgtttggaaatatcagggccgagtaattctgctttaagacttggatgagaaggctctttgcaagcaggaagcacccatgcccatacctcgaaggcccccttctgctttgaaggttctttggtgtatatcacaccccctccttcaaagagaattcccccagtgagccagttggcagggatgtatacaaaaggaaggacattatatttcctgttttagtatgaagggaaattaaaaattta

SEQ ID NO: 245097 - DNA, 339 bp, Homo sapiens
gctgacatctgtgaatacagctgtaaggatactctgggcagcacctatacgatgagcagcaaatgaatcagctcagagccacactgggaaaaaaatacaagaacaatatttagttacaaaataatttaaatggtatgtttccttttaacgaaagcttcagcaccaaagtttgaagacctgccaaagaggaagatgttctgattagcatgtaacatagagagcatgaaagcaccttttcaaaatcccagatcgttgagcctagggcagcactcctgcagcttgaaaaggaaagagctgctggttggatttaacaataaaaaaggaaaactttaaaaagac

SEQ ID NO: 245098 - DNA, 711 bp, Homo sapiens
gatgaatccaaaaaagggagacaagtggaagacttaagtttgtgggaaaagacattttttgtcaaaaattttagacatattgaatgggaataaaagttgttttacataacatctccacagcatgaattatcttggggaaaatttttcataaatattgttaaaatcctttcaaccaccttctcccagaaaccaccattagtttctgttataatgtacagaaaaccagccgggtggggtggctcactcctgtaatcccagcactttgggaggccgaagccggtggattgcttgagttcaggagttcgagaccagcctgggaaacatggcaagaccccatctctatccttgttctaaaaagatacatataaataaacaagaaacaaagtgtacagaaaatgaggaagcatgttttatgacaaccagtccatgacaatttcaaattaaaaaaaaaaaatccttttggtgtgatagagtattccccaggttttgatgagatttttaaaataagaattatcccatattaaacttgattctcatgcacacatgatcaacttaaagaggtggtgttgtgcatgttgtatatgactatgttctaaaacattgcatttttatatgcattagttgttttggggagcaggaaataagcatatatataatattaaaataatttagcaggttttgcatggtgtgtcttgaattgagactaagtaa

SEQ ID NO: 245099 - DNA, 934 bp, Homo sapiens
tatcaggtggttttagaagaaaatggtgagaaaaatcaagtacaactaggaaagcttgaagctacaataaaatcattatctgcagaacttctgaaggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtatgcaaattacaagaacaattagaagctacagttaaaaaacttgaagaaagcaaacaacttctaaaaaataatgaaaagttaatcacgtggttaaataaagaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaaggttcagttccaatttgcagtttacaaaacaaatgcatcactaggagactgttcagtcacggagcaactataagtatgccttgtcaatgataaggacccatgctgaacatgtacggcgtgaatccaaatacctgacgcaaccgggacaacatagcattccctttacgcggatcagcagaacctaatttactcaattcagaccatcagagagatggccattaggacgcattacataccttctgccaaaaccacagagcaccacctctggtcttcagcctatttcccctgggcaggtaccaaacacgtaatca

SEQ ID NO: 245100 - DNA, 363 bp, Homo sapiens
gactcatctccacagtgttttttgtttgtttgttttggtaaaggtccagatagtaaatattttaggtcctgtggcccaagaggcaaaatggaagatatttagttatttgtataatgaccacttgaaaatgtgaaagccgttcatagctcaaggctgtacaaaacaagggggtgggctggatttggcccacctaccgtagagaagtagtttccaaactgttttgattataaacccctccagtaaaattttgatcacatgccacagatttttaattttttaattgtaatttctgtttataagctatcatactaatatgttatgaatttatataaatgaaattttaattgatgagataaaaatata

SEQ ID NO: 245101 - DNA, 962 bp, Homo sapiens
tttttgaagttgcaaagtcatttattagtgtacgccctatgtaaatgaagaggctatttcccgtcatagctgatgtgtttccgtttgatttcgttctaagaagttcttaggttacctgcctccatgccctattctcctgcctcagaagcacagccctcattttgctacaccccaatctgtatcagactatctcaaagagcattccagtttttaagaaaagttttcagagaaaaattcttttaaataaactctataataaaaatctcttgcatttaacattggcagagtgaagaaggggtatctctaaacccgtcattctgagaaattattgtataaacatattagtaagacagaaaaaaggaagactggagcagaattcaatggaatggaaatcaaaatagcaggaataggaaaaaagataaataaagacaagaataaaagaagatgacaggcaaaaggaagacatgtgaagtagccatggaaatgagatacaaacacagccagcatccgtcctcatacggctacttactatggccctgcaggaggcagaaagagagaagacaaataggacttcatctttgctttatctttaaactcctattcctaaatctagccttattaccccttgttttaagaggaaaacattttactaaaggccttctttccattgttcgaatcttcaagacattttacagaaatgaagcaatgctgctaaccttttgggtgacagtaggaaaggaaacaagaatacaagggagagcttatttcccagtccagggaactttgcttcagttctggctgagtgtccagtttcggatgtaacatttttttctgaatgtagacttcatcatgctggtagctcagaacaatacactgtaagcagtagtggcagctcctgagctccggctctcaggactctgctgcaggtgctttaacaggcatttcccttcctccttccctcc

SEQ ID NO: 245102 - DNA, 422 bp, Homo sapiens
tatttaagtagtaaagaactaatttcaaaccagtgttctaggtagatgggtttttacacaagttgttttcattttagatttgagagacaacataggtatcaagagaattattttattaagatattagaatgcaatgatgtgcttataaatattagggcttcagatgtctggttaagtctacttaaatttttagtacggtggctttccaaatttttctgtcaggaattcttttctaagactattttcttcttattttagtttatacaataaaataccttggatcttaaatagctacctgcaccttccttttttacactcagtgtatcctctctgctctctactttttggccttcctttttcccaccataagctgcagttctgagtgtgaagagcctcagcagaagccatagccacccccatta

SEQ ID NO: 245103 - DNA, 493 bp, Homo sapiens
gtcttatggcaggtagcagagttttcgaggtttaacttagagaaaatttttttctcctactaatttagaaaagttcaaattattccattttagcagaacactgtccactgataatgagttcagaacactctgaggcagaaggaaatgcacagcacgtttctggcacttcttttttcctggagaataaagcccctcattgttcctagatgtgttagacatggctccttccccaatctatggatagatataagcaggtcttatttgctttcacgtgacatagatgctttgtagtttatttttttatttttttagagtcaaagtcttactctgtcacccaggctggagtgagtggtgcaatcatagctcactgcagcctagaattcctgaggcagaaggatcccttgagcccaaggagtttgaggctgcagtaagccatgattgtaccactgtactctaacctgggtgatagatagaggaggccctgtctcaaaag

SEQ ID NO: 245104 - DNA, 594 bp, Homo sapiens
aaaattagcaatattaaaatagctattacaattatgcatcagataacaacaacaaaagctcattaaaaataggtaagttctaatatatttttaaaaattcactgtatagatggaagagtcggtaaacttgaagataaaccaaaagaaatttttgaatctgaaaaacaaaaaagagaagttgaagaaaattattccatagtgagttataagataaaatcaaaaggtctgccatatgtgttaactgaagtcccagaaataaagaagagagatacggcagagaaaaagaaacaatggccaaaattttcccaaatttggtggaagatataaatttaaagactccagaattttggcaaaccccaaaaaagataaaacaaagaaaaccatatttaggcacataataaataaacagctgaaaaccaaagctaaacagaaaatcttgacagcagccatagaaacacaacacagaatgaaaatgagtagcttgttatttgaaacaatgaagcccaaaagacgatggaaaggaatctttaatatgatgaaagaggtagagaatgtcaatccagaattctatatctgagtaatcttgaaagtagg

SEQ ID NO: 245105 - DNA, 364 bp, Homo sapiens
gcagataaaattctcaatgaagagtcatactttggtatcttggctactagatcaacctcttattgtggtgaggctgactttgtttccttgacactgaacaactctaggtaacctgatatgcacctggttttatttattcattcgttgaaaaattatcaagctcctgttatgtgccagggacaattccaggctctggagctatcacaatgaacaacagagagttcttgccctcaaggaacaaatagtacaataggacaaaaaaataaatgggagatttctctatagtgtgataagaatgaagacagaggctggtggtggctgatgcctgtaatcctagcactttgggaggtcgaagtgggaggac

SEQ ID NO: 245106 - DNA, 325 bp, Homo sapiens
tttttttcctttggtcaacaaacatggttggccaaagtgagtgaagcaacctcactgtcatatcctctctttggtcactgagaccaacatggtaaatcctaaagttatactgagcacagcccctagagtcacatagttttgacatcccatcaacatttcactggttgcatgagaacgtttgcagtctcccagcactcttgaggttcacagtccaggtcagatgaaattcactgagtcattaaaaggggaagtaagaataggttaccaatttttagatttaattttttgatgattcttgttttattagccccatatataaaatata

SEQ ID NO: 245107 - DNA, 439 bp, Homo sapiens
ccaaggtggaggatcttgtgttagacttcactgaattttcacttaccacctgggtacctgtctagaaccaagtggtgctcgatgtaaacctccttccctttgagagtgctgcatgctactgtactggagtttttgtttagtttttacatatatttgaaatacaaactcttttgtggaattgatgacttttcttaccatttgggtaaattctggaatctcctaaaatattattggtagtatgcactgtccatgagaggaagatgaggagaaaaagagtacagctctcgtctcctcgttgagacaccacacgacctggttttagcaacagaaaaatagcaagtggtttggctgacgcaggctaagatcccatgaagccgcagaaacgggggaagcttatagtaaagtcatctaataaagtaaatctaagtttattcagcaa

SEQ ID NO: 245108 - DNA, 610 bp, Homo sapiens
gaggagttaagaagggaaagcaatcagtcatttttccaaaggccagtctgcagggctgggactgagcacaggctgaaatcaaggttggactacctctcagcccttctcaagccctccaggcctagcagtctccatctgatcctgtattggaaatgggcatggaagatgccacaacttctcaagctttccctaggaaaaggggtgggtgaacttctggcctgaagaatctgaggatggaaggtcaactttgctcttctcctgggttctggaaccagaccttcctaacctgctctgctcacctggagccccagcccactgtcacccatgccctcatctccagactcttcttccagcaactaggcttgcaaagcagggatggtggcttggagcaccagcttccgtgtcaagcagggcaggctgcactcccagcgccctggtgcctctggctctcgaggcttgttcctcatctctagctccctcacagagttgtcctgaggctcacaatgggaacacatcaataaattacctattgcattaaaatgagttgttattattggcacaattgttattgacgcttaagcctgaaggcaaataaatgatttttagctgc

SEQ ID NO: 245109 - DNA, 255 bp, Homo sapiens
gctcaagcagtcttctgcatcagcctcccaggtaggtgagactacatggatacaccaccatccttctaaatttttaaattttttgtagagacagggtcttgccatgttgcccaggctggtctcaaactcctgcgtttaagcgatcctcctgcctcagcctcccaaaatgccaggattacaggcttcagccaccatgcccaacctcggtgagttttttaaagaaagcaacaccaacagagaataacatgctttaaa

SEQ ID NO: 245110 - DNA, 688 bp, Homo sapiens
cccatgaggtattattatcctcatttagaggatatggagaaattaaggctctgtttcaaagcaagtctgtaaattctttaacattcttcccatcaagaagagagatctatctcctgccctggaacatgggcagcgcttttgactgtctccgtgcatataatatggtggaagtgacactgcttgacttgtgaagctggatcacaatgggttattgacttccaccagcctgtctccggggacaggtgacttcatgtaagaagtccagctaccctgacagagagtccacattggagggagcacactgtaatagacagaggtgcctgaggagccccggctgttccagccgccagctatttaggtcttcccaagtcaggcaccagagagtatgaatggaaaggccttcaagagaactctagccccagccattgtctgattgtcactgcatgaggaccaaaaatgcttgctgttgttttatagcaccaagctctgagtggtttgttgtgctgcaggctccaagagaagtaactttctgagagcactcaggaatttcttagtggaactggggctagaatcaattcactgcatttaatgcagtattaaccagacaactgtgttgggccctggggaccagagaagaattaacacacagcccaagccttcccctggtctgagcttcctcttcccacct

SEQ ID NO: 245111 - DNA, 589 bp, Homo sapiens
accatttagactgtttaagaaggctgtgtaccagctttaatattgtattttatgatattagtgatccctgaattttatttgaaaaaatattattttactgagtgatttagtaggcttgatcattttccttgcagctttcatattttgtgacacactgatttaagaatcaagtctatatctgaatgtgaaaaatctgcaatgaggatagcaaacaattatattgttttaatagaaaaattatttgataatttccatgtattgatgatttcagtagaatctattctgcatttaaccaacaatcagtagttcccaagctattccgtagttttagctttaacacatagtacatgcttaataaacattagctgaatgaatgaatgaatgaatgaatgaatgactaaagactttcaggacctggaagggaggatgtaaagaacccagggccaagtgtcatgcaagcactggagcatctagatcccctccggacaccagcttcctttcccacaacccaaatgttcttttccttttatgaattttctttaatcgtgacaaaatatatataatataaaatgtatcattttaactgtta

SEQ ID NO: 245112 - DNA, 338 bp, Homo sapiens
tgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattccttgtttaatttttt

SEQ ID NO: 245113 - DNA, 560 bp, Homo sapiens
cacactgaaatggactttagcatgcagagcatttatcaaggagtgtcaatgtcagtggagagcgggaggagaaactggaagtgagcagagagagaaggtgagctgcaaagcatgcctagtgatagcctcagccaaccccagaaggaaggcagaagtggaatgacccttcagggtcatcccaagttgacctgaggcagacaggccttcagatatcccactggatgctggccaccctaggatggggcatggcattggggaaatctctctgtggctgaagcaattcctataggggctgacagctggagactgtctgccactggccctcccagcagctgcagcagccaggtctccattgcaggagtatcggccacacactcagtttgcagatagtgtgagtgggagctacctaaaataaaacagtcacaccttaaatattacctctttgaggaggtaatatttaagctgataaccatatggtgagaaggtggtagacttccagatagatagatagatagatagaaagaaagaaagaaagaaagaaagaaagaaagaaagaaaga

SEQ ID NO: 245114 - DNA, 620 bp, Homo sapiens
ttttgaagattgctgcctactatgtgaaagttaatataaactggagggatcgagcccagccattgagagtccaattaggagctactacaatgatgacggtcgctacaaaataaaaagaactcaaaagagggagcaacaaattcagctgaagtatggggaaacaaaaaagcctcagagaagtcatgttgcagctcaatactgaaagataagaagcagtctagacaagtaaagcaaggaaatttgtacagaagaccatatgaatagcatgtttggaaaacttcaagtagttcttcatgatgagtcttgaatgaggtgaattatagctagaaaggcagattgagaaaaaaacagtaaagaatattttacaagaagagaaagtaaacacctcctggacactaaggaatacttttaagcaaggtgcttacatgaccagggttacattttagaaagattcttccaaaatcagttagcctaaaaacaaatataagaagtctagccacctaaacaagcatcgtgcttcccaataaatacactgtctcaaagtcctaatctagtaacttaccttgacaaccaaatacagtacaaccaagtactcttaagtttcagagaccaagcaacta

SEQ ID NO: 245115 - DNA, 528 bp, Homo sapiens
catttagacagttctggggaaaggtacatatttaatgaattgaagcttcaaaagacactaccaatttgccagctctttgaatgagccattttcaaagaagatcccctgccccagtgaagtcttcggatgtctgtactcctgctaacaccttaagtgtaccctgtgagagacctcaaaagagaaccacacggccaaactgctcccaaatttctgacccatagaagctataagaaggccagctccgatggctcatgactctaatctgagcacttttggaagctgaggcaggggcatggcttgaggctaagaattagagaccagcctggtcaacatagaaagaccccatctttgcagaagagaaaaagaaaaaaattagccaggcatggtgatgtgcacccatagttttagccactcaggaggctgaggcagaggatcgcttgagcccaagattttgagagtgcagtgagctttgatggggccacagcaccacagcctgggtgacgagagtcagaccctgtctcagaacaa

SEQ ID NO: 245116 - DNA, 494 bp, Homo sapiens
acaaaaagccactggtatcagcttttaaacaacaataatttttaaagcctaatgtatatttttatggaaacgtcagtgagacttttcattcttttggcgatacgtggatagaaaccatcagattcctctttcagataattcctgccttttccctgctaggcttgtttattttttgaaaagtagccccgagagttgaatcccatgagagagtcattttctcctatgttaacacgaccttccgatactttttcaaaaagcaaactgcaggccaaacatgaagttaccgaatggcttgcacgtagtccatatgtgcttgagtgaaatctcagtgtgcagtgagcgtcttgtcagcctcatgcaagattgtcgctctgcatttccctgaaattccacaccctccttcaacggctgaactgtttcctagaacaggcttcaggctgtcttcataactgacagtgatggatcttctccctctaactgtccgtcccctgtgg

SEQ ID NO: 245117 - DNA, 278 bp, Homo sapiens
ttggagcaccaatgccatttcctggttcccgtgggtatcttctgactaatgccacctctgtgatcgcagaggccaggtcggcttcactcctcactacagcccaggcccataccaggacagctctggttgtcagagccacagacataattttacatttcctaatcgctgcataaaacacagcaaaaataaatgggtgaaattaattgtaatatggttcgttgaccccggtacatccaacgtgttatcaattcattattaaagacaaatcagtgagatat

SEQ ID NO: 245118 - DNA, 619 bp, Homo sapiens
tggagacagagtcttgctctgtcacccaggctggatctcagctcactgcaacctctgcctcctgggtttaagcgatcctcccacctcagcctccccagtagctgggactacaggcacccaccaccgctcctagctgtaaggttttttttgtatttttagtagagaggggttttaccatgttgaccaggctggtctcgaactcctgacctcaggtgatccacctgcctcggcctcccaaagtggtgggattacaggcgtgagccaccacgcccaggcttccttccaagttcttaaggtgcatgccgagcaaattaatgttctaccttcttttccaatatgactatcaaaagatacacgagttcaattgaaaaaaatatatatatatataaatttccctttgtatatcttcttttattgcaacatacagattttgatatgtagtttttctagaattatttagttctaagcgttttaagattttggttgtaatttctccttgcacctgtgagttgtttagaagtttgttattaagtttccaaacatagaagtttgtataatgttacttttggtgtgtatttttccccttgtgaagaacttacaaggagtggaaatttgattt

SEQ ID NO: 245119 - DNA, 393 bp, Homo sapiens
cctgggggataagattttttagggggctcaaaaaaaaaaagatcagcctattgtctcacttcctatatgccttcattgatatgacatcatactgaaaggaaagcactgtttctttttaatgttttttatattcatgagagttcttatgtttttttttcccttgctggaattatactaagatacagttctgtatcctgtttttattaacgcgttgtgcaatggtgtgatctcagctcactgcaacctccgtgtcccgggttcaagtgattctcctgcctcagctacttggaggctgaggcaagaggatcacttgagcccgggagcttgaggctgcagtgagctgaaatcacaccactatgctgcagcctgggtaactgtacaactctgtctcca

SEQ ID NO: 245120 - DNA, 7386 bp, Homo sapiens
tgagccgggatctggcactcccaggactcccggccggggtagctcttcactcctcagcgcgacgtcgtgtcgagttcccaaaaagctccgcaggggctgtagggaggtgatctcatccattaacagctgtgtgttgccagttcccaaatctttatctatctcagacttctctcctgcattccagattcttatattcagctgccttttggatatctctcccaggatgttctcaaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctacattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgttttatgcagctattcaacaaactttgtgtgttcgtatacttgctacatgcagagcactttaccaggtttctaagcaaaaatttctaaaaatgattaattgttctgacagaattaggcgtagttctttatcaacatttatggattccatgccacaagtagtatgcgcttaagtgcagagcatgccaagagaaagagtaggatttggccctgtaggagcaaagattcaattgtgggaaactacttgtttctgaaaattgcatgctaggatatttacatcatgttcctgttgaaaacaattcctgattaaaatacaagaataatcttaaaacatcaaagagattttccagacaataaggaatgccaagtccaaaagtaaagagaataagagaagcaagcatgtacccttactctgacaaccttatgagtgagggggacagaaattaaagttcagggcccatataaggtgatgaacctaacaggagaccctccacacaataggctgagactcccaaatactttcacct

SEQ ID NO: 245121 - DNA, 694 bp, Homo sapiens
cccaggctggagtgcagtggcgcgatcttggctcactggacctccacctcctgagttccagcaattctgcctcagcctcctgagtggccaggattataggcgcctgccaccacacctggctaatttttgtatttttagtagagacgaggtttcaccatgttggccaggctagtctcaaactcttgacctcaggtgatctgcccttttcggcctccccaagtgctgggattacaggcatgagccaccgtgcccagccgcattaaattattttaatgtaatattttatctcttttttttgtctttttaattagttttctagtttaagttgtgtgggtataacatttattgagtacttatatgcatatccacattctgcatttaacaaatgtgtaacataaaaatgagcagtttaaaacaaataattgttgtatttcttgatcagtgacaggtgcaagttttgtggtattcaatggagctctaaaaacatcttcaggatttcttgctaagtccagcatagttgaaggtatgaatttcatttttaatggtgttttaatgtagagttatttttcctaacctttgaaaaatatatttgatatttacacagaacatatgtaagttataaagcacgtaccacaacttacatgaaatcatcaccgcacaagaagtagaagactatctctctcttctgcgtctc

SEQ ID NO: 245122 - DNA, 735 bp, Homo sapiens
aaaaattatctctcactttcccctaagaactgattgagtgatatttatacataatgtttgtttgtaaaatgagagttgaaggtaataaattcaataatttggggttttttttgttgatagtaaccagttttcctttcttatgtatagcatatcctgctcctctaacaagcatcagaggccgaaaacctctttttggagaaataggacacactattatgaacttacttgttgtgagtaattgaactattttattaggtatttttatactgttactttaaaactgtatttagcaaagtttatacatttatattttcctactttaatttgccatattggtataatgaccattcatttacaataaatcctaattattttaacattagtgctcagtttttgacgaattgctttttagaacgtactatctcctcatgtacgtgtacctgattctaagtgcgtttgattcattctcctgcagttcttggatatttaggtaatgtaagaactctatacagacctcttaaagttgttgaaacttttgtaaatgtattagtaaagtcagtcagtcttgtgattttgagcaaattatggcttagttttctcatttataataggaagtgttggattagatgatatctaaagttcccttccacctatactttttgtaattttgtgtttccctgttaccatagaaaaatgtttcagtggactcacttttatttatccatgcctagtttg

SEQ ID NO: 245123 - DNA, 672 bp, Homo sapiens
gttgaaatttacatttggtagaaacatatgctgtttgtcaagagttcatgagctagactttacaaatagccgtaattaccatgggtatgtttcctagctagcacgcactgtcaatctgtattaatgaaaattctcaacaggctagtaaatattgagttcataaatggttcttatttaatactgactttgtacagtctaaaaagaaaaaggctttattgaaatagtctttatgggtagttttttccaggtggttactcttgtggaatatagctaacgcactgcttcctaaccactcccctccccttcttcctgccttgtccctcctccctgcctacccaagggtttttggctatcataagaaggggagagacttggattgaactaagcttgctcactgtgtgatatggtatgggatcttgaagttcttcttgcctcattttttccaatcttaatattaagtcattaatacctgcctgagcatgcagtaaaactaaaaccttatgcttcttaattccttatgctcctgaatttgaagaatcaaaatggtactgtttcttgggaaatttgactttaagagaatttctgaacgcattttggtttttatttattcttattaaaaagatatgtttggctatagtgatctcatttcatagttgaacagagaatatgaac

SEQ ID NO: 245124 - DNA, 7258 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctacattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgttttatgcagctattcaacaaactttgtgtgttcgtatacttgctacatgcagagcactttaccaggtttctaagcaaaaatttctaaaaatgattaattgttctgacagaattaggcgtagttctttatcaacatttatggattccatgccacaagtagtatgcgcttaagtgcagagcatgccaagagaaagagtaggatttggccctgtaggagcaaagattcaattgtgggaaactacttgtttctgaaaattgcatgctaggatatttacatcatgttcctgttgaaaacaattcctgattaaaatacaagaataatcttaaaacatcaaagagattttccagacaataaggaatgccaagtccaaaagtaaagagaataagagaagcaagcatgtacccttactctgacaaccttatgagtgagggggacagaaattaaagttcagggcccatataaggtgatgaacctaacaggagaccctccacacaataggctgagactcccaaatactttcacct

SEQ ID NO: 245125 - DNA, 7385 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaagtgcctgctattggaaaaagctgaccaaagccagtaacaagagagtctgggaattgcactttccagacttccagcctggcatccaagagcccactgtagagggtgagcttgggtttgagaggcaataggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctacattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgttttatgcagctattcaacaaactttgtgtgttcgtatacttgctacatgcagagcactttaccaggtttctaagcaaaaatttctaaaaatgattaattgttctgacagaattaggcgtagttctttatcaacatttatggattccatgccacaagtagtatgcgcttaagtgcagagcatgccaagagaaagagtaggatttggccctgtaggagcaaagattcaattgtgggaaactacttgtttctgaaaattgcatgctaggatatttacatcatgttcctgttgaaaacaattcctgattaaaatacaagaataatcttaaaacatcaaagagattttccagacaataaggaatgccaagtccaaaagtaaagagaataagagaagcaagcatgtacccttactctgacaaccttatgagtgagggggacagaaattaaagttcagggcccatataaggtgatgaacctaacaggagaccctccacacaataggctgagactcccaaatactttcacct

SEQ ID NO: 245126 - DNA, 6879 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctacattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgttttatgcagctattcaacaaactttgtgtgttcgtatacttgctacatgcagagcactttaccaggtttctaagcaaaaatttctaaaaatgattaattgttctgacagaattaggcgtagttctttatcaacatttatggattccatgccacaagtagtatgcgcttaagtgcagagcatgccaagagaaagagtaggatttggccctgtaggagcaaagattcaattgtgggaaactacttgtttctgaaaattgcatgctaggatatttacatcatgttcctgttgaaaacaattcctgattaaaatacaagaataatcttaaaacatcaaagagattttccagacaataaggaatgccaagtccaaaagtaaagagaataagagaagcaagcatgtacccttactctgacaaccttatgagtgagggggacagaaattaaagttcagggcccatataaggtgatgaacctaacaggagaccctccacacaataggctgagactcccaaatactttcacct

SEQ ID NO: 245127 - DNA, 6292 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttata

SEQ ID NO: 245128 - DNA, 3214 bp, Homo sapiens
gtttgcttttctccagccaggatatattttactcatagttcttactggaaaaggggttttgtttttatctcactattaaaagtcctcttttcaaggaagcactcactatttgttattggagtaagcactgtaaatttttttagccaattgtattaaaatgtaatttgcaccaatgttagagtctaatattaaatattattgcaacaacaaatttgaaatatttcaagtagatttttttaataccatggggtttttaatttaagtaatgtcggcagttattcaaagcctcatccctctaatttgtttatgtgttcatttagaggaaacgtaaagtatgacatagtggcaattttatctttatgatatatgaggaggaacaattataatttatgtagtagacagataaaagatacaggagaatgtagaatttttttataaatatatcaaatattttatttaacatgcttgaactgtattttaaaatatttcacttattttatattcacattccgagttaaacaagattgctcattttcttatcaagaattttttgtttttctaggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctacattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgttttatgcagctattcaacaaactttgtgtgttcgtatacttgctacatgcagagcactttaccaggtttctaagcaaaaatttctaaaaatgattaattgttctgacagaattaggcgtagttctttatcaacatttatggattccatgccacaagtagtatgcgcttaagtgcagagcatgccaagagaaagagtaggatttggccctgtaggagcaaagattcaattgtgggaaactacttgtttctgaaaattgcatgctaggatatttacatcatgttcctgttgaaaacaattcctgattaaaatacaagaataatcttaaaacatcaaagagattttccagacaataaggaatgccaagtccaaaagtaaagagaataagagaagcaagcatgtacccttactctgacaaccttatgagtgagggggacagaaattaaagttcagggcccatataaggtgatgaacctaacaggagaccctccacacaataggctgagactcccaaatactttcacct

SEQ ID NO: 245129 - DNA, 3160 bp, Homo sapiens
gtttgcttttctccagccaggatatattttactcatagttcttactggaaaaggggttttgtttttatctcactattaaaagtcctcttttcaaggaagcactcactatttgttattggagtaagcactgtaaatttttttagccaattgtattaaaatgtaatttgcaccaatgttagagtctaatattaaatattattgcaacaacaaatttgaaatatttcaagtagatttttttaataccatggggtttttaatttaagtaatgtcggcagttattcaaagcctcatccctctaatttgtttatgtgttcatttagaggaaacgtaaagtatgacatagtggcaattttatctttatgatatatgaggaggaacaattataatttatgtagtagacagataaaagatacaggagaatgtagaatttttttataaatatatcaaatattttatttaacatgcttgaactgtattttttcttatcaagaattttttgtttttctaggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccggtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctacattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgttttatgcagctattcaacaaactttgtgtgttcgtatacttgctacatgcagagcactttaccaggtttctaagcaaaaatttctaaaaatgattaattgttctgacagaattaggcgtagttctttatcaacatttatggattccatgccacaagtagtatgcgcttaagtgcagagcatgccaagagaaagagtaggatttggccctgtaggagcaaagattcaattgtgggaaactacttgtttctgaaaattgcatgctaggatatttacatcatgttcctgttgaaaacaattcctgattaaaatacaagaataatcttaaaacatcaaagagattttccagacaataaggaatgccaagtccaaaagtaaagagaataagagaagcaagcatgtacccttactctgacaaccttatgagtgagggggacagaaattaaagttcagggcccatataaggtgatgaacctaacaggagaccctccacacaataggctgagactcccaaatactttcacct

SEQ ID NO: 245130 - DNA, 4485 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaaggtaagttttagagtaataagttaaattgcatattttcaaatatactgaatgtaaagactttcagggaatcattaaaatcaattttaatggattaatggaactacttttgttttgctatgcttttaaagttctaagacaaccctcttctactaccaggttggtctagataactgtggtatgtcttcaagtttctagatgttcataagttcttttattacctaaaacttttcttcttaaatttcagaacaaaacagaaaactttcacagtgcaggttgagtatgccatatctgaaatgtattggatcagttttttggattttggactttttcagattttggaatattcacagagtacataccagttgagcatcccaaattcaaaatctgaaatgctccagtgagcatttcttttgagcatcacgttggcatttgaaaaagttatagaccgggcatggtggctcacgcctgtactcccagcactttgggaggccaaggcgggcagatcacatgaggtcaggagttcgagaccagcctggccaacatggtgaaaccctgtctctactaaaaatacaaaaattagctgggtgaggtggcaggcgcctgtaattgcagctactcaggaggctgaggcaggagaatcacctgaacccaggaggcagatttgcagtgagctaagatcatgcctctgcattccagccagggtgacagagcaagactacgtctcaaaaaaaaa

SEQ ID NO: 245131 - DNA, 4340 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaggctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgtgagtaattgaactattttattaggtatttttatactgttactttaaaactgtatttagcaaagtttatacatttatattttcctactttaatttgccatattggtataatgaccattcatttacaataaatcctaattattttaacattagtgctcagtttttgacgaattgctttttagaacgtactatctcctcatgtacgtgtacctgattctaagtgcgtttgattcattctcctgcagttcttggatatttaggtaatgtaagaactctatacagacctcttaaagttgttgaaacttttgtaaatgtattagtaaagtcagtcagtcttgtgattttgagcaaattatggcttagttttctcatttataataggaagtgttggattagatgatatctaaagttcccttccacctatactttttgtaattttgtgtttccctgttaccatagaaaaatgtttcagtggactcacttttatttatccatgcctagtttg

SEQ ID NO: 245132 - DNA, 3400 bp, Homo sapiens
tgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgataccagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaacagttgataaacaaaatacaatagaaaatggcctttctttaggagaaaaaagcactattccagttcaacaagggttacctaccagtaagtctgagattacaaatcaattatcagtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaagtgcctgctattggaaaaagctgaccaaagccagtaacaagagagtctgggaattgcactttccagacttccagcctggcatccaagagcccactgtagagggtgagcttgggtttgagaggcaataggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcaggtagggaagcagttatttaaattta

SEQ ID NO: 245133 - DNA, 291 bp, Homo sapiens
tagtttatatatgcaaatattatgttgttagagttggttttcatgtcatttttacatatacaggggcagtttccccaactaaattgtatattccttaaagcagcactcttaaattttatttctgtgtcaatttcttgactgtgtttcctggcatggaatacatggcataaaatttgttatgtaattaaatgaaatattattatactttctattttttaggcatacaagaattaaattctgaataagtctgcaggtaggatggacagttattttaaagcagctgtcagtgac

SEQ ID NO: 245134 - DNA, 569 bp, Homo sapiens
atggtactgtttcttgggaaatttgactttaagagaatttctgaacgcattttggtttttatttattcttattaaaaagatatgtttggctatagtgatctcatttcatagttgaacagagaatatgaactgatttgttattttttttattacatattttacagacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcaggtagggaagcagttatttaaatttaa

SEQ ID NO: 245135 - DNA, 880 bp, Homo sapiens
agagagagccagagtcgctacagccagcctggcagtgcaagcccggagctgacacagggccacagccacgatgcagccactaatgcggacccttgggctgagcctgctttccatgctgtgagcccaggggacccagatggttcctgtccccgctgagaaggtggaaggactgtggcacgccctgcgctgggagcaggacagggagctacttaaagaggagacggctcaccctctgccaccattctggatccagcgtttccagggtaactttatgttaaaaatgaatgtaagtttcagtcagcaggtccctttttaactggatcatgtgctgaagaacgccacacacggagggcttgctcaggctctgggctcagcccaggaccttcctgccccaagcacctcaccacaatctctcacaggcacttctgtaagatgggacagtccagttgcaggaaaatgagctcagggctcccaccgattctacactatgggatcccactgggaactgcacagtatttaagacactgctggtgaaaacagacaactctaccacgtacagaatctattcctgcgtggtcggctgtaactgaggtgagtgccacaaggcctctgcgtgtgttcagagtgtccacaccagactccggccggactcatgggccctgggactccgcagccctcgaccttggcagcctccttgcctgcgggtgcttgaatgccacgcagcatccgacgcatcccacaaccttgagtctgctatgagtcaagtgtggtcgctgtagataaggaggaaaaaagatcatgaaaaagaacaacaacaacaaaaaatcactcatggccgggcgcggtggctcatgcctgtaatcccagcactttgggaggc

SEQ ID NO: 245136 - DNA, 627 bp, Homo sapiens
cccatttcctatagagggacagaaattattagcatttcagactcatagactcaacttaaaaagggcgcaaccacccagctcacaagagcacatcctccgcccctcccagcgggggagcaggaggtctgcatctgtccgtggagacggaccactactacatcatgaacacccgggatgagaggagggacccggccgtgcacacaatgaacctgacaggcgcgtgtccacgctgatgtcacggggcctgtggacgggggcctgtggacgggggcgctgccccttggagtcctccctaactcagccatgcccagattcctgcgtggtcggctgtaactgaggtgagtgccacaaggcctctgcgtgtgttcagagtgtccacaccagactccggccggactcatgggccctgggactccgcagccctcgaccttggcagcctccttgcctgcgggtgcttgaatgccacgcagcatccgacgcatcccacaaccttgagtctgctatgagtcaagtgtggtcgctgtagataaggaggaaaaaagatcatgaaaaagaacaacaacaacaaaaaatcactcatggccgggcgcggtggctcatgcctgtaatcccagcactttgggaggc

SEQ ID NO: 245137 - DNA, 803 bp, Homo sapiens
agagagagccagagtcgctacagccagcctggcagtgcaagcccggagctgacacagggccacagccacgatgcagccactaatgcggacccttgggctgagcctgctttccatgctgtgagcccaggggacccagatggttcctgtccccgctgagaaggtggaaggactgtggcacgccctgcgctgggagcaggacagggagctacttaaagaggagacggctcaccctctgccaccattctggatccagcgtttccagggtaactttatgttaaaaatgaatgtaaggtgagtgcctggtggggacacgtggggtgagcgagggagcttctcaggctctcgctgccatccaggccctgggctgatggaaaggaggtcactggccactcttcttcaccaggctgcagccactttggagtccacctttccggcttctaacagtttcagtcagcaggtccctttttaactggatcatgtgctgaagaacgccacacacggagggcttgctcaggctctgggctcagcccaggaccttcctgccccaagcacctcaccacaatctctcacaggcacttctgtaaggtgagaagtccagcagccatgggtttattgtttttcctgtaaaacaataaagtctggtaggagattacgcatgtatgctgtgaaagacctctttgcctaacataaggatggtaattttagtgcctttggtgttacaaacctttattacctgtggcagctaattaataggagatgttctaagagtcaaagtttcattctgtgggatttccatctaccac

SEQ ID NO: 245138 - DNA, 750 bp, Homo sapiens
agagagagccagagtcgctacagccagcctggcagtgcaagcccggagctgacacagggccacagccacgatgcagccactaatgcggacccttgggctgagcctgctttccatgctgtgagcccaggggacccagatggttcctgtccccgctgagaaggtggaaggactgtggcacgccctgcgctgggagcaggacagggagctacttaaagaggagacggctcaccctctgccaccattctggatccagcgtttccagggtaactttatgttaaaaatgaatgtaaggtgagtgcctggtggggacacgtggggtgagcgagggagcttctcaggctctcgctgccatccaggccctgggctgatggaaaggaggtcactggccactcttcttcaccaggctgcagccataactggatcatgtgctgaagaacgccacacacggagggcttgctcaggctctgggctcagcccaggaccttcctgccccaagcacctcaccacaatctctcacaggcacttctgtaaggtgagaagtccagcagccatgggtttattgtttttcctgtaaaacaataaagtctggtaggagattacgcatgtatgctgtgaaagacctctttgcctaacataaggatggtaattttagtgcctttggtgttacaaacctttattacctgtggcagctaattaataggagatgttctaagagtcaaagtttcattctgtgggatttccatctaccac

SEQ ID NO: 245139 - DNA, 583 bp, Homo sapiens
gctcccaaagtgctgggattacaagtatgagccatcacgcctagctttaatatgattattatattgatttatcatcttatgttaaaccaacctagtatttgatacaataaactcagctttggtcatcaaatattctagtttttatatcttgctgggttggtttgctaatatttatttaggatctttgttcacaagtaaacctggcctgtaagattattctcttacactctcaggtttggatatggaggtttttctaaccttataaagtgatttagaaattgctcttttttggccgggcctggtggctcacgcctgtaatcccagcactttgggaggccgaggcgggtggatcacgaggtcaggagatcgggaccatcctggctaacatggtgaaaccccgtctctattaaaaaatacaaaaaattagccgagcgtggtggcgggcgcctgtggtcccagctactggggaggatgaggcaggagaatggcgtgaacctgggaggcggagcttgcagtgagctgagatcgcgccactgcactccagcttgggtgacagagcgagactccgtcttaaaaaaaaaaa

SEQ ID NO: 245140 - DNA, 438 bp, Homo sapiens
aaagccatgtaaattaatggaaacttcctggcaaaatagcttgacttgtagcaacttcacaaccataacaatccagaggtgaggtttgcccgcaccctattcatttcaatcccgaaggcaattttccccttggccagagagaagctcaagaacaaaaaaccaaacaccgcatgttctcactcataggtgggaattgaacaatgagaacacatggacacaggaaggggaacatcacactctggggactgttgtggggtggggggaggggggagggatagcattaggagatatacctaatgttaaatgacaagttaatgggtgcagcacaccagcatggcacatgtatacatatgtaactaacctgcacattatgcacatgtaccctaaaacttaaagtataataataataaaataaaaaaagaaaattaaaaaataaaa

SEQ ID NO: 245141 - DNA, 1234 bp, Homo sapiens
cggccgcctcgccaaacaggtttacccgacgcggccggggcggcgggcggaggcggcggcgggagcggcgcggccccagaacccagataatccgtttaaagcactgagaaaatctaagaagtttttagtaaactgtagctggtatcagggatcagatcagcggacacgcccattccagcagtcaggggcctgctcggaccgtcgtgcacctccgagcgtttctgtccggtccctctgggtccgtctggttttcggaggctttcctggaaaagccagcctgtggctacctcctttctcccctaagtgatggaggattagaaggcagaggttgacccacaatctaaagtgcctggtcgccttttcccagatttcccggagcattccttcaccccgtggcatcggctgtctgcatatgggtgcaaggccctgttccgggcggagaataaacaggagttctgactgacaggagctccgcagccagcagggtggtcactagttctctgcagtctcggaggacagccctgaagaagggcaggagaaccagcacttcctccgaaaactcaaaaggacatcagtcttcaccaagttgccgatacaaaacgtgctcctgaaatgtgtagtaatgagcaccaggaaacctgggtaggagtgtgcatggcattcttcatcaccgcttggactgcatggcactgaatacccacggagagcaggatggagaaacagtgtgctcatattcacaggatggaatctagccattcacaaaaattccaaaacaggcaaaattaaactgcattctttagggaagcatcattaagtagtaaataattgacagaagggcaagaaggtgcttactctaagtgtcagaatggtggatacagctgggggtgagagggctgtgaccacagcagggcccctgggggatttgggggtgccaggcctgttccttcctgcaatggtgccctttggcagccatcccttaaactgcacttttactttatatgcttttctgtacctttactgtagtatttcaaggaaatttttaaataatcatgaatgttaccactttcctatttatgaaccatgcaacctcatcaatcttcccagttcgcagatgcccaccctctctctctgcccctgtctccttcacatatccccaaaactcgttttggcccgaaatccctgaggcccaactgccctgctgtcagcgactgcacgcctcagcaaaggcccagaa

SEQ ID NO: 245142 - DNA, 473 bp, Homo sapiens
cagatctggtttcaggagtcacacagcctctttgatgtcagaaatctctaattctctcgactaatctccctcccctttccctagcctcccgagtgcctatagcaaagatctcttttttaatgagttaattaaaaataattatattttgaacatcaccagagacgcactagaggctggaaaaccagcattaagataagcgatttctggccgcgcggggtggctcacgcctgtaatcccagcactttgggaggccaaggcaggcggatcacgaggtcaggagatcgagaccatcctagctaacacgctgaaaccccgtctctactaaaaatacaaaaaaattagccaggcgtggtggcaggcacctgtagtcccagctactcgggaggctgaggcaggagaatggcgtgaacccaggaggtggagcttgcagtgagcactccagcctgggcgacagggcgagactctgtctcaaa

SEQ ID NO: 245143 - DNA, 469 bp, Homo sapiens
  misc_feature (13)..(13): n is a, c, g, or t
  misc_feature (54)..(54): n is a, c, g, or t
ccaaggctggtcntcgaccttcctgaccttcaggtgatcccaccccacccttgnccttccccaaagtgctgggactacaggcacatgcaaaccacggtctggcttaattttcttgagttttagtagagactgggtctcgttatgttgtccaggctggtcccgagctcctgagttcaatcgatcttcctgccttggtctcccaaagtgctggcctacaggcgtgagccaccatccccagcccaatttttgtatattttgtagagacacagcctgggcaacttagtgagaccctctctctacaaaaaaagtttgaaaattaggtgtgattggacacatcagtgtcgtagtcccagcatctcaggagactgaggtggaaggattgcttgagctcagaaggtcgaggctacagtgagccatggtcacaccactgcactgcagcctgagtgactgagggagaccctgtcttatt

SEQ ID NO: 245144 - DNA, 441 bp, Homo sapiens
tggtaactatctcctactgttgtgacgattaaaggagatggtgcatgcagagtacttggcacatatgaagtgctcaataaagagtaactcctgcagcctggtgtggtggcccacacctgtaaccacaacatgttgggaggctcaacatgttggcaggaggattgcttgaggccaagggtttgagaccagcctgggcaacataaagagacccccgtctctataaaaaataataaaaactagctgagcatggtgatacatgcctgtagttccagctactcaggaggctgaggtgggaggatcaacttgagctcgggagttggaggctgcagtgagctacgatcacgccactgccctccagcctgggcaacagagcaaggccctttctctggaataaaaaaaaaagagaggctgggcgcagtggctcacacctgtaatcccagc

SEQ ID NO: 245145 - DNA, 431 bp, Homo sapiens
cctatgggtggtgtataactgattgagaggccgcacttggcaacgatgtgctttcattgggaggaggtctgtcttcatgagctttctgatgccatcctgtgccttggcctgtttcacatctttttcaggggcttgtgcagtgatctagaaggtggtggacctgaagagacctgattctgggaggccacagaataccttgggtggcccttgggatctaagaataagaacatggatgctcttgggctccacataaagcattctagttgggcgagggggaagaaggccagggcaggtctgagagtggggaagactctggaccacccacccatgccagtgtcaaccagagccgccttttctgaatgtatctgtttttacatgttgtttctaaattagattatagttgatgcctataggaagcatcctactaatta

SEQ ID NO: 245146 - DNA, 368 bp, Homo sapiens
tcactatgtgtttggaccttatagcctagcttccactcctacctacccaacatcaaatgaggacttaattctgtttctctcttaaattctctcttccttcttcctttggctcccatgacagtgggatatattgaaggaaagaatattgtccttggactgagagatttctgaactcaaaacctggctccaatatggagtaaggagaatttacttaaacattctgagtcatcatttctttcataaaatatgggatagagacacatacctcctaaaaactgtacatcgagacttgtatgagataacatgtgtaaagttagctaagagcttgtgtttctaacctccactaaactttcatgaattcatatttc

SEQ ID NO: 245147 - DNA, 396 bp, Homo sapiens
gctaggcatctgcatcaactcctaagatcctcaaggagacacgggactattggaaggtcatttgccaaggtcataaaaagcagaattgagatttgaacctaggctttttgcttttagagatcctagaaatgtctaggacatccctcattttccttttgttggagtcccctccaaaggccttttgaaactctcccccaaatctttccacctgcagccccactcagtttccttccttccacctcaccctgtggatagaaaactggctggcaggtgttgccccttgtaccccattcctttcctcagaaaaaagccaagaccccatatctcctgatccctacagtgacttcctaagagcttgacaaatggaaggtgaccttcttcaaatgcagacacata

SEQ ID NO: 245148 - DNA, 504 bp, Homo sapiens
ttaaaatcataattccccaaaacacaacccaaatgtccatcaacagtagactaaattgtggtataatgcatacactgataaactatacagttatgaaaatgagctacaacaaaatatgaataagtcttacacacataaggttgactgaaatgaatcagagacaaaataatacatcttagatgataccatttatataaagctcaaagttaggtaaagcaaaactacagtgctcagggatacatactttggtagcaaacaaaaaataaagtaagtcattaatgtaaaaatcaggttactgcttacctttggaggagaaagaggattgtgactagaaagggaaagaggagagcttctggggatgctggcaatgtcctatttcttgagctggggtggtatgtggatgttcatttataataattccttaaactgaatatgtttctgtgttttgtatgtgttttgttgttatgtatgtgttgtattttgcaataaaaaagatatttaaga

SEQ ID NO: 245149 - DNA, 282 bp, Homo sapiens
cctctgacccaggctgttgtgtggctcagaaggaaattccaaggccatgactacaacttcccggcacaagtcattgttggtgctcccgggtactgggtcacctcaagagacacatccttctctccacttcagtttccttcacagaaaagtgaagactcaaagtccaatctaggtacccaaacattgcaagaccacaaaatctcaatcatcataaagcacatcacagccaggaggagatgaatgaatgtcacgcagttacagcaacctcaagaaatttacggg

SEQ ID NO: 245150 - DNA, 274 bp, Homo sapiens
cggcacgaggttttttttttatgttcacagagatttgttggtgccaactaaatgagcccaacagccagtgacaacagaactgcactaaaaaaagtccctcatcagctcttgagagcaggttccttaaaggtgaacaatattccacatacaaggactttttcagcaccatgcattagaaatggaagtgaatgtttattattttttgtataagttggttgatacggcttttcagcttccctcagtatcattatccaaattttacaaaaaaaaaaaa

SEQ ID NO: 245151 - DNA, 496 bp, Homo sapiens
ctaagggtgggtctgcttctcccagtccactgactcaaatgttaatctcctttggcaacaccctcacagacacacccaggaacaatactttgcgtccttcaatccaatcaaattgacacccaatattaaccatcatactgatgatattatatgataatattctgtaaactataagatgctgttgaaaatgcaaaaaaaaaaaggcattgagcagtgactcacatttgtcatcccagcgctttgggagggcaaggtgagaggatcacttaaggccaggagttcaagaccatcctggccaacatggtgaaaccccgtctctattaaaaatacaaaaattagctgggtgtggtggcacgtgcctatagtcccagctactcaggaaactgaggcaggagactcgcttgaacccaggaggtggaggttgcagtgagccaagatcatgccactgcactctagcctcggtaacaaagtgagacgccccctgtccaacaactca

SEQ ID NO: 245152 - DNA, 477 bp, Homo sapiens
ctggaaaagcccagatgtgcccgtgggcgttgggctggccttccaggggtgtcccctgcgtaacaaaggacggagccctcggaccctccggtccgctcgtcgtgtgacttaaccagcaagtcacaaaaggaactttagtggggatcctacttacacatacagcagaaaggcattgcccccgtcagcctgccatgcagtttcgaatcttgattgaaggtaatttaaaagctgagtgatgtacgttcaccatggggctatggagtaaatactattaaagaaaatgacccgagtagatgcaacggtggctagcctcccaaaaggagcttttccagcttattttaaaaaccaccttattaatatgattgaagtattttggtttagggatgtgttacttaaaagagctaggcatgcatgttatttgataggatactggctactgccgtgtaaaataaaaagagctcattttatcatttgttc

SEQ ID NO: 245153 - DNA, 372 bp, Homo sapiens
gcagatctttagcaagcagctcttttccaagacgccattttatccaatctgaattgcagccaagagcttagggacgccgggctaccactcacacgctggaatgttatgtcacaaacggactggcgagaagcagccactatttgttccgtgtttgttccgtttctcctgctctacgaggggctgacgggtgaggaaatacctgcagacggtgccgcccaaccctcctaggagacgccacctcgcgtgcacagctgcctctacgcctgcatcgaggctcgcctggcctctcgctacaacatgtcggctgggtacagcgagagccgcctcctgtagagctgccagggagctgccaggaagctcccggggccagtc

SEQ ID NO: 245154 - DNA, 1316 bp, Homo sapiens
tgagatactcaaaatatccacagtggttgaatccatgaatgagaacccatggatatgaaggtcctactatgtattgtaacattttctcagatacagtagataatttagaatgagataaaacagatcaaatggtttaggttaaaattttttaggaagagaaactaacacaattatatttattattgtggttagcaatataaaaatgtgataaacagatgtaagtaatttcttcataaatttttgttgcagtacaccatagattataactgctatctttttttggtaggattactcaaactcctaacagcaagtcgcttcaacagtactatctcagttaaatggacacgataggaaactatttcaatgccatatcattactacaagtatttaaatatgatttacactatgtataatacttttaataaaccatttcccaaatatggtatataaaagtaacatgtttatataagtatatattaaagaataaaattacattctaaattagttttttgaggtcaaaaacaacagcaaaataccaaaaacaccagtagcctaagtaaaagtttgcaattttaaaatgcaaaaatttatcactctgaaatccctgtatatttcttattatgatagagatcctagatatttgacttggagaatactgttaattcagttcaagcaatatgtggcaaacaggtactacagaataaaatataacgatagaaatatttctatctccacataggtaaacttcggtcctcgaactaagcaaggtatggaacactgaagtgccttcaatggtcaggaaagtaacctaagtaaatgaatagcctacatagcaacagaatgtagcgtagacagtggaaaacggagaagtgtcttcttccaacttcatttcaacccaagtattttaaaacactgtgcacattaaacatactaatttggcagcctgaatttggccctgaatataattccattaacctctagactaggtcatccctgaaattctcgctgatctgtattttcattaaaaatgtggccgagcgcggtggctcacgcctgtaatcccagcaatttgggaggctgaggctggcggatcatgaggtcaggagatcgagaccatcctggctaacacggtgaaacctcgtctctactaaaaatacaaaaaaaaattagccgggcgcgatggcgggcacctgtagtcccagctactcgggaggctgaggcaggagaatggcgtgaacccgggaggcggagcttgcagtgagccgagatggcgccattgcactccagcctgggcaaaaagagccagactccgtctc

SEQ ID NO: 245155 - DNA, 453 bp, Homo sapiens
ctcctgagtagctgggattacaggtgtgtgccaccactcccagctaatttttatatttttagtagagatggggggtttcactatgttggccaggctggtcttgaactcctgacctcaagtgatccacctgcctcggccttccaaagtgctgggattacaggtgtgggccaccgtgcctggcccagtttggcagttgccaaaaaacaaaacgtatacttgacaatatgattcagacattccactcctagatgtttagccaagaggaaagaaagcacatgtccatataatgaattgtacatgaatattcataacaacccaacttgatttgtaaaatcgaaaactgaaacaacccaaatgtccatcggtggtcgagtggacgagcaaattgtggtctatacatggaatggaatgtgactcatgaataaaaggaaccggctattgatacacacaaca

SEQ ID NO: 245156 - DNA, 606 bp, Homo sapiens
ttttgcaacctctgaggctccttaaacatttttgaattgctgtagcctaggcttgttttgtaaaaagtgcttgttgctgaaaatgatgatttgtttggataaaccccctcctcattttttgggtggtgggggagctttttattgcatagtcacaatgggaggcattgttcacacagaccagcatcgtcatacttctattcttgtcactgacagtattatttgcaactgctttttttccagcctcttctaatttccacactaccacttattgtatttcattaaagctgggttagaaatgcaaggcatataattagattgagaactatgctatcgatttggttttccattatgatgttatcacatgcacaaaaaagtcatttggtacaattgttatgattaaaactacaaaagagatctattacatcagacttagttttcagtgcctgatgcagtgtaaaataagagtgagaggggttgatctgtttatattagagctgcatatgccatgtaaccataaatgtctgtaggctaataatttcaaaggaacctttagtagatgagaggttttttagaaattcatattaaataaaagtcaatcaatacttc

SEQ ID NO: 245157 - DNA, 383 bp, Homo sapiens
ggtgcttcgggagccgcggcttaaggtgtagacatggcgaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaagaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccatcccaagcttgggaagcgtgctcgtgcccgtattgccaaggggctcag

SEQ ID NO: 245158 - DNA, 575 bp, Homo sapiens
agcttcggtttccttgtttaccctgccactagtcaaatgttagctacaaaaatatcacatgtaggcaggacctatcagagtctccatatctcagttatattgccactacaaatcacatatctgaaagacaatcataagaggcattgctaggaaccaggggacagaatataatcagatatattcatgcttgtttgccctgggcaacttttccccatttctaaaacgacatcacagtttttcatttctcaggttcacacagccaatattacaacagggttaaatatcagaaagcaaagtgaaatctcagttagctgtatgttctacatatggcaatatgctttattacatgggacgattaggtaaaatgacctttactctgtgacattgcaagaattaaaattaaaaatcaaggtccatcttatcctttcttagctgaaaaagcctaagctgatgatgagaggttctgttctttggtatgattgtaagcactttagatcagctataaagtgtatttgattggcaaatattttctcatacgtgtcctattttgcagattagagagaaatgtattattt

SEQ ID NO: 245159 - DNA, 528 bp, Homo sapiens
cttacacccagctgcatgttaactcccagcccctatcaggctgattggttctctcgactgacatagggaatggagagaaaatttagcactttctggcttcatcagcacatgatgacataattctggaacatgcctgaaatcctctgggcctgcctcaagaagagatggaagctattgtgactggacccggctaatcttcagctataccatttggggagaagaaacgaaagaaaggagcttcattccaaacggttgcatctctgcataaagaaaacctgaataaattgatgactaatctgaaatcaacagcacctcattttgtgagatgcataaatcccaatgtgaacaaaataccaggtatactggacccttacttggttctacagcagttgcgctgtaatggtgtcttggaagggactaggatatgccgtgaaggttttccaaaccgactgcagtatgctgattttaaacaaaggtactgcattctgaatccaaggacctttccaaagagcaagtttgtgagcagca

SEQ ID NO: 245160 - DNA, 518 bp, Homo sapiens
atgaccgaggcactgctcccctgcggtgatgatggctggggtggcagggaagacaatccacttaaccttcatcaagctcctgtcattggccacatattacaggaacaggaaaccaagtactgcacattctcacttctaagcaggagctaaacattgagtacacatggacacaaagaaaggaacagttgacaccagggcctactcgagggtgagggagggaggagagaaaggatcggaaaactacctatcaggtactatgctcattacctgggtggtgaaatcatctgtacacccaacccctgtgacatggaatttacctgtgtaacaaacctgcacatatgcccctgaactcatagatgagacagcgaagactcaggatagctggtccttgaagattagtgtcttgggttgaatggtggcctccccccctaaagatgcgcccaacctctggaacctgtgaatgtagatttatctggaaaaagagtccttgcagatgcaattaaggatcttgagttgag

SEQ ID NO: 245161 - DNA, 434 bp, Homo sapiens
tgccaccacctgtgtgcagagcttgggacaggggaagtcagatgtggtcgggagcctagcactgcagagtgctggtgagtccagactctggcaaggccaccatgccaccaagagcgagcacagcctctccccagcagacctgggctcccacacgtccccaaaggagagcagcgaggcactggatgctgctgctgtgctctctgtggcagagtgtgtggagcggatggcccccacactgccgaaaagtgacttgaacgaagtgaaaaagctgctaaaaaccaacaagacgttggccaaaatgcttggtcacatctttgagatgaacgataatgatccacgcaaagaggaggaaatttggaaatacagtgaatatatggcagatttgactcaaagaggaaggatggaaaacatctcatgcttcatgagctcactgt

SEQ ID NO: 245162 - DNA, 592 bp, Homo sapiens
gctttgttgctcaggctggtgaaaggattaatatgcaaaaaaaaatttttaattacttaacactatttaagaatcttcttctaaataaacaacttctgatgatgcaaaacaatatgaaatgccttgatatcatcatggttaacatccacactggtcaaatatcagtatttcagtagccaaacaaaaaatttattttaaaaattgagatggaaatttaaaaaatttctagggaaaatcctttgtaagtttatatctaatttaacagtattcaaaagtgtttaaattctgaaaagttaaacctagatagctttttgttaagcacttcctttaaaaagctgaagactatcagctagctaattgtgaaagctgtactacttgaaagcaccactagatgacaaccttgtttcacaagtaaaatattatactcctgttgaagctaagaccctgaagagatactaaactagcttaaaggtttctgacatttgttttttgttggagagtagggataacaaagaaaataaaatagactactataattttgaatttgtgtttgatataaagatcactcagggtttaaaaaaaactcatttag

SEQ ID NO: 245163 - DNA, 305 bp, Homo sapiens
ttctgtttttctctcatgctttagcgagttcctttcacattcggttttcatgggacaatactgaaaaaaactttaagacccagaagtatgaaaattggctcagcttaatccataaaagtcaagttgctttggatcctgggcattgtcccttttggccagtgatcacaagcccaatttcccttccatgctaccatgtagtcttgttgccagttttccttatatatcctcaaggttctttgtaagcttattcctttaatcaccaggcatttcttccctcaaatctcaaataaatggatttctcttct

SEQ ID NO: 245164 - DNA, 471 bp, Homo sapiens
cttggaagcatgtggaaaggtttgttctttttgtggatattcctactacctaggcaaatcagatggaattgcattcattacatggctaagtcaggacagttgaggccaactttagggatttttccgaggtgccatctatctgcatcgattgatttcaagaggtgtttgctcaggtttccgtttgctttcaagataatgtctgaacattaagttaaagttaaggctttaccatttgaaatgcagttgtaataacatttttagctctctccaactagctttaatttcttaagaacaacttgaacttctatgaaatgtattttaaaaaccaccttgtttgttttctgagtgtttcaggacttatattagagtccctggcctttagtcttcattcaagccaaacaaccattatctttaattgaagctgcttctactggaagccaaaacaattggtggagtcagtgaagaaagaaa

SEQ ID NO: 245165 - DNA, 259 bp, Homo sapiens
gagacacctgattaactaggcttggcctgccttggccgggggatgaaggctccgggaagtcccaaggccggtccttcaggcccctgagaagtctctcccgaccccactggctcttccacttcaccctggggattgacctagtggagtggagggctgcccacctgcttcctctcacagcccttcaagatcacggatagcccttcctgccagcagatgtctgctaaaaagaaataaatatttaaaacatttttaaaaagga

SEQ ID NO: 245166 - DNA, 345 bp, Homo sapiens
catagatgagaatttggaaaatatagaaaaatttaagaaaaaccatgaagagatgacttcaagttagcatgtttcattcacttacaattattttatgtatatgtaaacatttttaatttttattttggataaaattgaggttatatatacagttttatattctgtgtttttccatttattgcagtttagttattttctcacatcaagtgccatgctgtatcttcaaaaatatgtttgtataatattatacagatgatgaagttatttaaacatttttgctattgtcatttaagtggttttgtaattttgcaattataaataacgctgttgtgttatttatgcata

SEQ ID NO: 245167 - DNA, 431 bp, Homo sapiens
tgggaggccaaggcaggcggatcgcaagatcaggagattgagaccatcctggctaacacggtgaaaccccatctctactaaaaatacaaaaaaattagctaggcatggtggcgggcacctgtagtcccagctgctcaggaggctgaggcaggagaatggcatgaacccaggaggtggagcttgcagtgagctgagatcgcgccactgcactccaacctgggccacagagcaaggctccatctcaaaaaaataaaaaagaagttatatagaagtagaaaaaatattttatggaaggaaaattgaggaaacagaaaagcaaaatattaaaaatcagttagttggggccagttgctcaagcaagtaaaatgtcaggtacaaggtatacctcttaactgatagagtcaccaaaactctattaacagcatcagtca

SEQ ID NO: 245168 - DNA, 414 bp, Homo sapiens
tgggaggccaaggcaggcggatcgcaagatcaggagattgagaccatcctggctaacacggtgaaaccccatctctactaaaaatacaaaaaaattagctaggcatggtggcgggcacctgtagtcccagctgctcaggaggctgaggcaggagaatggcatgaacccaggaggtggagcttgcagtgagctgagatcgcgccactgcactccaacctgggccacagagcaaggctccatctcaaaaaaataaaaaagaagttatatagaagtagaaaaaatattttatggaaggaaaattgaggaaacagaaaagcaaaatattaaaaatcagttagttggtgactctatcagttaagaggtataccttgtacctgacattttacttgcttgagcaactggccccaacgtcga

SEQ ID NO: 245169 - DNA, 721 bp, Homo sapiens
catctcccccattttgaaataaagatattgtcaggggaaggacactggaagaatgttgttaaaatccttggtcctcatctgttttgacccattttatgttttattatcatggaagactctttgcttctcaaagtatgggccaaatgtgaccgtgctttcattttaactccaagatacccggggtagcctagatgataatctaatgaagtctagccctggcacacgtcagcaagttgcacctagccaggaacctacacagagtgggtacttagtaaatatttattgaaaaagaatttgaatagcagtaatcatacttttccaaacactacatgttctttttcagtgtgttttgactctttcctcatgagaacaatgaaaacttgtctcatattcaatgactaaaataaattttagcagtttcaagttttatagaaaaattcatgagattgagaatgagcattagctgggtctaagtttccttacacagggcagctgaatcttgacattgtatttatcataaaagtgatatgtttatagaaaatttggagaaaataaatataaagaaagaaaattacctatgagtttatctattaagatataaacatgattaacatttagtttattttcctttttgtcctttttgcaagcatatatatacatatacgtgggataaatatctatattaattgaattataattttactatgcatgtaattcactt

SEQ ID NO: 245170 - DNA, 298 bp, Homo sapiens
cgccagtcggccggagcgcgagagccgggacccgggctgttggcggcgcacgccggggaggttgaggcggaggagcgcgcgttcgggcgccgcggacgctgtcctgtagcggtctcgccggcctcggcgtccggactgtggcaccgcgcggggactccccccgcgcccccgctgccaacgttaagcgagggccaaagcccgccgcccgccccccagcatgcgcacctcgtacaccgtgaccctgcccgaggacccccccgccgccccctttcccgccctcgccaaggagctgcggccg

SEQ ID NO: 245171 - DNA, 1624 bp, Homo sapiens
  misc_feature (914)..(914): n is a, c, g, or t
tggattaagaatcaggagaggtggggctgggcgcagtggcttacgcctgtaatcccagcactttgggaggccgaggcgggtggatcacgaggtcaggagttcgagaccatcctggccaacatggtgaaaccctgtctctactaaaattagaaaaaaaatagccgggcattgtggtgggcgcccgtagtcccagccgctcgggaggctgaggcaggggaatcactggaacccgggaggcggaggttgcagtgagctgagattgcgccactgcactccagcctggcgacagagcgagactctgtctcaaaaaaaaaaaaaaaaaaaaaaaaaaaatcaggagaggtggggtgtgttttatgactttaggcaaatcaacctaagagacagttttctcttctgcagagttttaggaaagtcacaaattaatgtacttgaagaaagtgtacaatagaatagtagtattaccaaatcctaaagttcttattgtggaaaatctctgaaatattacctgcctatgtagatgccaacccttcagcaatccagacaagcttattatcttttctggatgaattaagtgtccacagttttgtacctcttcaatgtgattactttgtaggctagactgcagactgttaattgactactttctggtaccctctagctattgtcttgagacagtaaaataattactgctctctagctacatccttagcattttcctgttctgaaatgaaatcattttcttatgttaaaaataaagttaattactgttcaactcccaaggtgatattcagctgccacctcttacaaccctctcttcttaatctgtgtaactattctacagcccaggaatagcctgagtttattaaagtcacccacacagatctggctcttttcaatcaagctgccctcanagtgccagctgatgatactcccaaggagactcacaagcccactgctgcctgcagttcagacagagtccatgctattttaactggactcttggcactattagcactgacacaatgactccttaaattacgaattacaacaggccattctattccgtctgtgcttctaatgctgtcaccatgtgattttcccccagaagagatatttcccaggtaggggtatgcttaacatgcagttacggaactgagagttaatgtcagaagaaagcttttgcagtgtagccacagaatagttacaggctacattgctcagcatgcacaaataaaagcttaaaagaacgtgttaaaggaaagatttccctgtctttttagcctcctacgaacattaagaagaaaaatgttgcgaggcacagtggcttacgcctgtaatcctagcactctgggaggctgaggtgtccaagaggatcacctgaggtcaggagtttgagaccagcctggccaacatggtgaaaccccatctctactaaaaatacaaaatttgcctagcgtggtggtgggcacctgtaatcccagctacttgggaggctgaggcaggagaattgcttgaatgcgggaagtacaggttgcagtgagcagagatcacgccacttcactccactccagcctgagtgaaatagcgaaactccatctcaaaagaaagaaaaaagaaaaga

SEQ ID NO: 245172 - DNA, 306 bp, Homo sapiens
acaatctgatttcaattttagtggtctgcacatctcctaaagtctgctattagctcagattaggaaactgaaggattgaagaatcgagatgaactgaattggaaaaatatatgtatatgtatttgtggagaacgccatgtgaagaagaaaataaaatgttctgaaattaggtagtagtgttggtggacaacattgtgaatgtactgaaagtcactaaactgtacattttaaaataaaatggtgaattttatgctacataaatcttaccttattaaaaaacataaaaacacttaggggcattcaacc

SEQ ID NO: 245173 - DNA, 358 bp, Homo sapiens
ttgcacaacacacggaagcattagtcacaatttatatagctgatttcatggagctgaattctatggtgtttatagccgttgagtgtcttctcccagaaattggaaagatgccccatttgctgtaacacacacgacctccaccccattcttttcctttgtaacccaaaccacaatgtgtaattgtgtgtttattttgtgtttaatgtttatctcttcgcccaggctctaaggctctatgagggcagggatcacatctgtttagttcacccagatttcattatatatccagcattctacactctgtaactgcttagtctcaactctgaccacacattaagtcatcaagggagttaacaga

SEQ ID NO: 245174 - DNA, 745 bp, Homo sapiens
aaacagagcaaagtaggtatggatttcagctttcttttaaattgactccaggaactttaccgatggactgagcaaccaacagggacagataaatttaagtcacaggctcttcttgatgtagaaacacagcgttttattttaaagaagaaaagaaaacaatatttactgattatcttattgatcttttctagggactttaaaaaatactgtaacggttaatattgagtgtcaacttgattggattgaaggatgcaaagtattgttcctgggtgtgtctgtgagggtgttgccaaaggagattaacattccagtcagtggactgggaaaggcagacccaccctcaatctgggtgggcaccatctaatcagctgccagtgtggccagaataaagcaggaaaatgtggaaggacttgacttgctgagtcttctggtcttcagctttctcccatgctggatgcttcctgccttagagcattggactccaggtcttcagcttttggactctcggacttacaccagtggtttgccaggggctctcaggcctttggacacagactgaaggctgcactgtcggcttccctacttttgaggttttgggcttccctactcctcagcttgcagatggcctattgtggaactttaccctgtgatcatgccctcagcttggactggaactacacccccagctctcctgggtctccagcttgcagaggaaagattgcaggacttctcagcctccataaat

SEQ ID NO: 245175 - DNA, 344 bp, Homo sapiens
aagtttacttttctgtctaggtgtccttgtactttttaaatatataaatatgctttttcactgagtagcaatagaagtagtatttttgctaggcttgagttgcttactattaaaaaaaattatacttacatatttataataaaacctaatcttaggctcagatgcacatacaactaaagagcagtgcttgtcttttgcttaatgttcatattacaaggttaacttttatttataattaatatatgaacgtgttcttttttaaaaaatacacaatgtgatggataaatctaatgtcctttttgataatcaccctggttttaagaatataactgtctagagaaact

SEQ ID NO: 245176 - DNA, 273 bp, Homo sapiens
tctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtata

SEQ ID NO: 245177 - DNA, 276 bp, Homo sapiens
atagtttcaaggaactgcaactcaccagataactgcacctggacaatgagatgccagacccagaccccttgccaattatggttgcctaagtaacctgctgctgcctgttgaccaccttctcttcttaatcctctcctaattcctatttttccatacttagttacatttcttcccttatttttctacctctaattttagtccattgagaagatggatttttgagtgatgtcccattctccttggctgcagcatccaaataaagcccctttccctggc

SEQ ID NO: 245178 - DNA, 587 bp, Homo sapiens
ttttttttttgagacagggtctcattttgccatccagcctggagtgcagtggcatgatcatagctaactgcagcctcgattttttaggctcaagttatcctcctgcctcagcctcccaagtgggtgggactacaggggagcaccaccatgcctggctaatttatttatttattttcagtagaggtgaggtatcgctgtgctgcccaggctgtcactcagtttttattaatattgttattatcaacagtctcagtgattgtctcctcctaggcttagatgctaatcacatctaaccattgcttcaaattatttaccacgggattcatggcattgaggaagagaatgtgggttactgacactcatccatcatcagtagtggaaaaatgtccaacaacacacttaattgtacagagcatcttggccaagtcacgtgccctggatggcgctgcatttgcctgaaggacgggcatcttttttcaattcacgcaaaagcacggtatgtgctaggagtggcccagaaaagaactcaacagcatagactctgatagtgaactgatgccaaacagtgggcattattgatcccacga

SEQ ID NO: 245179 - DNA, 455 bp, Homo sapiens
ggagctggtttctaacgatgacagtcagtctctgtctagactctgtgctcttaactgccacatcacactgctgcaatgagatggtcagtgaaatgatttttccagatttaaagataccttaattaagcggttgacagatctctccttcattcttactctaaggtgtcatgtctttgcataactaagaaaatagaagcaatcctaaaaggtcttttgcaaagttgtaccaccatatctgtccgtctcctaccatctctcctccctcctgttcctatagatgaactgtcattgttattatcaaagtctcgtccctctgctggtacattcgattcctacccccacttttctacttaattgctccaacagttatcacctttgtgttgcattatcaggttttatttctctacaaaattattcttatcagctgttatttctcctagatataaaaaaaaagc

SEQ ID NO: 245180 - DNA, 794 bp, Homo sapiens
attaatatgttgaaatttaatcacaaatgtgatggtgtaataaggtggggactttgggactttattaggtcatggagggggagcctcataaaaaaggctgccttgccccctccatcgtgtaaatcaccatctgtgaaccaggaaatgggccctcaccagacaccgaatctgccggttccttgatctcggacttcccagtctccagaactgtgggaaacacatttctgttgtttatgagccacccagtttaaggtattttgttatagcagcccagatggactaggccaccaccatagtcagggaagagctggctgatttgtgcgtgtctgcgctgtgtcccaatgaaagcacaataatcaatgaacattgattctgcaatcgatgtttgaaggtcaaaggagttgggaaagggggtctcctgaagccaaggaaaagcattgtactccccaaaactgtgccagccaggttaactttttgcgagatgctacagattgagatgctttagttttacttctggctctttaagccctactcaagctctaattttgatatctcgttctagacgccttagtttgggcccctcccaggctcccttctgtttttgttctttttttctaacatcatccttggcttttcttctcctttaggtttgatctcctgtctcttgggttgagaaaccatcccctctgactcctggccccctgtgacccctccaaagccccctgtacaggtctttggccacacagagattcaacagtctaataatctaaaattgtaaatgccaaaaaaaaaaa

SEQ ID NO: 245181 - DNA, 555 bp, Homo sapiens
tatagtatgcatcagtatggttggaaaagcttcttctatcaagtttaacaactttctggtgtaacttctgagagggctgattgcttattcatgcggaagcaagacgcccagttcattttgcccgtttttgctactctttgttgggtttgggaggctgttatggtagctgcaaatggcttctcaagtgacatttgctgacattcagtgaagtacatttatcagtattcgccagctcacctctacacatgcaatccattttgttttgttcttcatagcaaactcctttccgacacccgtgccctgaaaatgataaatggcaaggtggcatatttctgaagctgcactcaagtgtcactgtgaaaaatctttaatggactaagtgtagcttttcatgttacagcttgtcaggtttgatctcctgtctcttgggttgagaaaccatcccctctgactcctggccccctgtgacccctccaaagccccctgtacaggtctttggccacacagagattcaacagtctaataatctaaaattgtaaatgccaaaaaaaaaaa

SEQ ID NO: 245182 - DNA, 128 bp, Homo sapiens
ccctccctccccattctgtttctcccattcctctctccactcatctgcccatccatcctagatactgggtcaatgacattcacaagagcctcctattaaagaatccagaattagcctgatgatagaga

SEQ ID NO: 245183 - DNA, 495 bp, Homo sapiens
ttcatatcccatactccctctctcagaaagctgtgggaggacatgtactgtattataatccatgaataagccagaaaggaattcatagtgtcagaaaacaggacagccaacacagcaaagtaaaaggaattccaggataattgcaaatgtctcaggatgataccttatatctgacctagaaaacaaccagtccagaatggagtatgaggacagaaaattgatatagaactcttgaagggggaaaactaaactgatatatgttgtgttcgagcatattggaagcagatatgtaacagagggagtttaaagatgaattagtaatagaagattaagtgcattaaaaaatgaggcaattacagttctaggacaagcaaaaaatttgtgagaggaaaatataatagttcactacttggcttagctgtgaacaatatttatgtaattataaccctctaaacattgatgtaacaaaaatttgtgataaaactctattggaaa

SEQ ID NO: 245184 - DNA, 106 bp, Homo sapiens
tgaactctccttttgttccagtgttttcttctgtgtttccactcaactgtttttttaattgtgattttaaatactttgacactatgtttttaatgttcttcacact

SEQ ID NO: 245185 - DNA, 441 bp, Homo sapiens
aaataactcgaatatccataatcgaggctggttcaaaatgtatagcacgtcattccagtggagtgctccagaactggaaggaaacgaatagagctgtgtgtgctgatacagagagattgtcgaggtgtatcaccaggcatacaaatcaagacatagaataatgtgatttctgtgtccccatttgtattgtgtgtccgcagggacagtatctggaaggtacaccaggaactgctgaggagtggaactaggactctgagacaaaaggggtttgcttttcattttaaactgtattattatttgaattttttaaaaatcaaggactgttcaggtgcaatggctcatgcctgtaatcttagcactttgggaggctgaggtgggtggatcacttgagcccaggagtttgagaccagcctggacaacatggtaagaccctgtctctac

SEQ ID NO: 245186 - DNA, 238 bp, Homo sapiens
catctcatgggaatgtggtgaggattcattgtaatgatgcaaatgaaataactaagcctgactgcctgaaactcacacgggagatcttcaaagaatgttagttctcttctccatctattcttaccaacaaaagaatgcagaagacctattttcaccagaaggaggactggaaccagagttagcaggtatggagtcacatgggtgaatcaataaaacccactcaaaatttcatctatga

SEQ ID NO: 245187 - DNA, 349 bp, Homo sapiens
tgaaagctggacactgtggcatgtacctgaagtcccaccttgagaagccaaggcctgaggatcacttcagcccaggagttccaggttgcagtgcactattatcccatttgtgaacagccagtgcactccagcctgggcaacaaagtgagatctctgtctcaaaaaaaagaaaaagttgatgaagagtagattgaatatggttttatagtacttttaagttaaaagctggggattgatatggtagcttatgcctgtaatcccagtgctgtgggaagccaaggcaggaggattgcttgagaccaggagttcaagaccagcctgggcaacatagcaagacctcatccctaca

SEQ ID NO: 245188 - DNA, 228 bp, Homo sapiens
ctgagcggccgcccgggcgtgtcgcctcccggctgtgtgactcaggcaagcactgtgcctccctgagccacgtccccatctgtagggtgaggccaggagactgaaatgggaggtagaaaggcccctgcacaccgtgggcattggatgagggtcgctttcctccttccctccacctcccccattggagtcttggttcatccactactctgacatgtgattgtcatcatt

SEQ ID NO: 245189 - DNA, 651 bp, Homo sapiens
ataatcagtaccctgtcagggaaagagtaaacagatgattaggtacctcaaacttcaagcccagaatagttaggtacttatgatgcatgacaaacagcataaatggctacaatacatgttaagtataagagatatatttaaaaataatttagctgttttttttactgtatctaaaagtccccaactattaagatatctaataaatattcactttttaagctaaaagaagttattatatggctgtgtatacactgccttcttggtatcctcaaatattctggagttattaaataatcccatctaacatgtgagtcaaaaatgtgtagttcatacctgggtttcttcagctgagcaacagctgtatgtattaagtcagattcttggtcttcccaaaacaaaaataagtatcagataataataaagctgaaaaattaaggattgcacttataatatcggcctcaaaggtcagggatatgatgatgatggtgatggttatcacaataattaacagcagccaacacttttatagcacttattacataccaagcatgactctaagatccttttttttttgagacggagtctcgctctatcgcccaggctggagtgcagtggcgtgatctcggctcactgcaagctctgcctctcggg

SEQ ID NO: 245190 - DNA, 598 bp, Homo sapiens
ataatcagtaccctgtcagggaaagagtaaacagatgattaggtacctcaaacttcaagcccagaatagttaggtacttatgatgcatgacaaacagcataaatggctacaatacatgttaagtataagagatatatttaaaaataatttagctgttttttttactgtatctaaaagtccccaactattaagatatctaataaatattcactttttaagctaaaagaagttattatatggctgtgtatacactgccttcttggtatcctcaaatattctggagttattaaataatcccatctaacatgtgagtcaaaaatgtgtagttcatacctgggtttcttcagctgagcaacagctgtatgtattaagtcagattcttggtcttcccaaaacaaaaataagtatcagataataataaagctgaaaaattaaggattgcacttataatatcggcctcaaaggtcagggatatgcacttattacataccaagcatgactctaagatccttttttttttgagacggagtctcgctctatcgcccaggctggagtgcagtggcgtgatctcggctcactgcaagctctgcctctcggg

SEQ ID NO: 245191 - DNA, 844 bp, Homo sapiens
gtaaagagtgcttggtacaacaggaggcacagggtaaatgcttgggtaatggaactactgtcattatcacccatctggctgcatgttacaaggtcaatgagataatggatacaaaatgtaaactagatgaacataaaggcttattatatagaccagtgtgtcctgaagaaaactggtgtcctaaagtgtgtcctgcagaaaactagttccctggaatgttaatagctgtttctaaataaaggttttgcaggcaatatgttttgagaatgcagagttaaatgagaatacaataagtttctttattgttaaagtatttaatccctaatagtgatatacactgtgaatcttcaagaggacagagtaagcaaacctaactgaccaggagtggctagagtattgtcagttccacagaacaaatgtgagagaaagatctggatttggtgttagggtgcctttaacatctaacactggttaactctccttttaaacctgttggcttggcattataggttaatccatattcaggttctcagacctgggaggcggggagcttcgtgatcatcttgttcagtgttttccaaacctcagtcattccaatacctccctgattcttgtcctatctaaaaatgccactgcatgccagcctgggcgacaggggcgagactaataattaataaagtaatagtaaggtgtggaatgaacggtcttaatctgctaaatgttgttgctgaggaggccgactggatccattctgacttttctaaatggctcccaggtccgcaccctcttttttggggaggccctggcccggctggaacgccgcccccggggaactccccccggg

SEQ ID NO: 245192 - DNA, 267 bp, Homo sapiens
ccttttattattttctgtccactagggacaccgtgctcttaaatatttgggtatcaaactgaataaattaaatcataattaatggttttctagttgtattaataagaagtatacacagattgcaactgaaaaaagaaaaatgtacttgttaatgagatggatgatattttacttagtctgtgctgactgagtgaggatgaacaatatacactgtgttttgaatttgcttgtgagcatggtaaaataaaaatatctaatttttttcag

SEQ ID NO: 245193 - DNA, 457 bp, Homo sapiens
gccttgtgacttattcggccgccctcgggctttgagaaagttaagcactattttatatttgataatgctttttgtatgattttatgttttttaacattaatgtgctattaatgttaaactttattttaataaaattttgaagacattatttacttttaatgtctgactataaggtaaggtttttatagactttttaaaactttttataatttttcttaaagagcaggttagtgctttaagaaaaatttattgtgcttttattttaatgtttagtttacagaaaaattggatacctctttagctaatatgtttacatacagaattttctttataattaatatttttaaatttgtttaaacttttttttttggagacggagtcttgctctgttgcccaggctggagtgcagtggtgcgatctcagctcaccgcaaattccacctcctgggttcacgcca

SEQ ID NO: 245194 - DNA, 395 bp, Homo sapiens
tctcccccttttggttcctaaataagatggttacaagatgaaaggctacacacctcccccatattttgcacacaagaaaattcctggtgagatgttaaaacttcaccatggcaatgcaacttgatagcttatctttacaggtgcagtcaccctggcccgccggacacaaatgcatatctgatttttttcctaccccattttgtctgttatgtaaaatgcagattccccacatttttcttctgcccccttttatgtaaaaactgtgtgcttctcaatatcccaccctttcccctttaaatttggagccctcaaaatcatcttcagaaaaaggcatagacctgtctcctgggtgtgtccttaactttggcaaataaatttctaaaatgactgagatg

SEQ ID NO: 245195 - DNA, 370 bp, Homo sapiens
atccacagcaagaaaatcaggccacagaaagctgtaaagagccttgggatggagactgagaagaggcaggaccacctctgacatttacgtcagtagtgagaatcaggtggactgatgaaacctctagtaaaccaaaggcaccctacacctacgatagttgttaagatgtgcacagacgtaggattgacccacatcaaaccatcagaggaagcatgcagagatgcagcatgcacatgactctctaggcctcagtttcctcactagtaaaagagacaactttaatgagttggtatatgcaaatgagttatgtacaaatgaaatgaggtatgcaaatgagttgatgtacataaatgagttgatacatgcaaat

SEQ ID NO: 245196 - DNA, 471 bp, Homo sapiens
cctaggaaaggaggaagagctggtatccaaagattattgttcatggccctctaccagcgacagcttgtcctcctgagccatcttgcctagcatttgaatgatttagcttttaaagtatcattacaaagctttgtaatttacagtttttttttagctgtattactaccagatcctgatagaaattgttattatgcattatctagcagattcacaatattcttaacctgaacttttctcagatagaactgtgcatcctaaaacatagatgtggtggattctaaatcattgttcccaaacaccacaaattaccaactatttaaactcagacattattttatgtgttaagccagtctgatagggcacattgctttacctaccaaaatgtatatgtgatttttttttaaaataccatctaaactatcataacattactgataaattaatttatattttgagacagtatacattcca

SEQ ID NO: 245197 - DNA, 141 bp, Homo sapiens
cccccgtccctaagcgtgctttcaggatgatgcccccagagccttaattagcatcaactggctactgtctgtcggtcctgagcaaattagtgaagctcccagtcccctttcctcgtctaaataaactctgtctctctggaa

SEQ ID NO: 245198 - DNA, 434 bp, Homo sapiens
tcataacacaatcatgcacttgagtttcaatctggctgtggattttagagcacagattaacagatgcctatagagtctatataattttgaacgctagcatgtaaccctcacaatcactctcactagaatcaattcatttagggacatttggcttttctcttccaggcattctggaagtcctaagtgggtccacttgccatgtagcatagtgagcagttgttcagcatgtaggttttgtgcaagcagagctatgctaaagtaacagctttccttctacgagcttctttgacctggggaaaaattatcagtttctttatcagtaaaacagggaaataatacctagtttcaagtggtattgtgattaataaattatataaagaggctgtattcattatgttttgctgcctaacaaattaccccaaaatgtagtggcc

SEQ ID NO: 245199 - DNA, 371 bp, Homo sapiens
aataacacataggccaaagaattctcaagagaaatgttaaaaaatattttgaactaaatgaaaatgaaaatatgactcatcaaaatttgtgggttgcagcatacccacatttggtcattagacaacatacttccaaacaacacatgggtcaaagaagtctcaagataaattttaaaaaatattttgaactaaataaaaatgaaaatatggcttatcaaaatgtatgggatgcagcaaaagcagtgctagaggaaaatttatagtattgaatgaatatattagaaaagaagaaatatgtaaaattaaaaatctaagcttccaccttaggaaactagagaaagaagaattacataaacctaaaacagaagaaa

SEQ ID NO: 245200 - DNA, 1756 bp, Homo sapiens
gggagaaggagaggcaaggaaagagggagggaagaaaggaagaaaagaaggagggagagagggaggaaggaagaaggtgcaaaaagaagctagcaggaatctgatttaatttcttgctgcaaaggaggttatcatctaatacacctattctattccaggcacttttctaggtaaaacagatgtgaatctagcttcatggagccatgaaaatacagattaggtatacaaataaactaacaaataaatctacattacaaactttgattactgctatggaagaaaaatacagagtgctctaagagagaataacaataggaactgtatttaaattgaaggactataagaggagtctgaggatatgaaaaatagagctgatgcccaaagatgagaaaaaattaattaatgaggacaaataaggtaaaaccattcccaatagaaaaaaaatggaatctacaaagaaaagaacatggcacccttgatgagctgagataaggccaacataactaaaacagaatgagctagtggcatgagatcagtctgcagagacagtcatgggccagcttatgtaatgtctttttggataatgttaagcatttgattctgtcatcattcttagttcaacagaaagccactgacggctttcttcaagcaagaaaatgagcttatctgatttacattttttaagtcactaaggttgctaggggaactgattaagtatctgctaatgtaggagagatgacaaattatacaatggtgatagccacagaagaaaaaagaagtagaaagattctaagtacactctgaagatgatactggtagcaaaggtgttagattagattagatggggggatgaaggactgggtagtgtcagcaataattttcaggtatctccctttggcaaaaggatggattactgaggcaatcaagtctaaggtagaaagggttagggaagaaaaatgagaagctatcagagttttgttttggaaatgtttgatttaaaatgcctgaaggctatcctactgaagctgtcaagtaagcagcagggtatacaaatctgaagtgcagaggagaactgggctacagatgccagtttaggacttcttgggatctgaaaggtattgaaaatctgaaaatactcatattttatacattaagaagtatggaatatattgatgttgatagcatcccaaagccacagagcacacatttaatttgctcctagtaacacctatgagtaggtattgaaattacttttaatgatgaaaaattagtaaaatatttccttgtattttactatagtatactcccatgtcatctataataactgagaaccatctctatcaaaagatatgtttttaaaagcttatctaacaaattattaaaggaactaaaattttacaactttttcccctagatacactatacctttcctccactgattctctgtaactaatctgcctgcaaaatgggtgattagtaaaaacatttactgagtgtataaagtacatgtaggggtatacagaaacgggaagtagctcacccattctccactaagttatttcaactttcctctctggagggcccataaaagaatatggcagcaatgtagtatcaaactaccacagatgctagagttccacttgctataaaacctcacttagtttttctaatctgattctaatctataaaatttggataatactataccttttgagttgtgaagtttaacagataattaaaatatatatttatccca

SEQ ID NO: 245201 - DNA, 460 bp, Homo sapiens
gccttagaaaaataaataaataaataaataaataaataaatagcttggactttccggggttgcagaaatccgatttcagccgggctatttaccaaaatttgtttcaaaatgactgcacctttgcttttgcaagtcacagaatgcaaatgacgataatttgttctcagaagaagtttctcttgaaatgattagcaaagtcagtcatttgaaaattagaacgaagcccttcgctaactgatatctgcttctaaagttttcattcatgtaaacctcattaatgaagatcttttatttaaacgtcaaggggatttgaaatttagagtaaattatgaagcttgtatgtctagccaagtcatgggtcaaatgcatttgtgaaaaactgctaaagagcatatggttttgaatttttctacaatgactagtgtttaaataaattgcttgtactgcttaacttcatgtg

SEQ ID NO: 245202 - DNA, 1228 bp, Homo sapiens
catgttggccaggctggtttagaactcctgacctcaggtgatccagctgtgtcagcctcccaaaatgctgggattacaggcgtgagccactgcacccagcctggatatattttttaaaaagaaaagtatatctagttttttaaaaacattaattcactcaatagtcacatctaaacagacatatactatctatgcagattgtaggcacgctgtatacaggttagatgaaaattctttggcattactgttcaaataaaaatataagacaagctggtaatgagagcaatatatgtaattttaaaatttctgtctttcttttttttcttttcttttttttttgaggctgtcttgctctgtcattcaggctggtgtgcaatggcatggtctcagcccactgcaacctccacctcccaggttcaagcgattctcatgcctcagggtctcagagttataggtgtgccccaccacaccctgctaatttttgtgtttttagtacagacgggtttttgctatgttgaccaggctggtctcaaactcctgacctcaagtggtccggctacctcggcctcccaaagtgttgagtttacaggcatgagccaccgcgtctggccaatatatataattgtaaagtgtctaataatggcatttaaaaagtacaaatacagagatctaattagttttagtaatatattttatttagcctcatccatccaaagtattatttaacaatgtaatcaacataaaaattattcttatttgtggaggtattttctctttttctgggatactatgtcttcaaaatccattgtgtattttatacttatagctcatctgaataaggactagccttatttcaagtaagcaggagtcacatgtgattggtggctgctgtattcacagcgcagcttgatagcaatttagcttcaggacttttgtttttgtttttgaaatgaactaaattgccaaacctacatgtaatataccagatacactcatgtccttaatgttatttgatttgtttctttaggacgaacaacctattttattcactttgtttatataaaaagtattattcttaaatatgtactatgcacatatgataaaacatttcacaacattaaatggtaggaaatataaaaaggagtgtcctttcattgcgtctccaagcccagtcccctgaggtaaccactatcacataaaatgcagattttttccacatatatatgag

SEQ ID NO: 245203 - DNA, 380 bp, Homo sapiens
ttgaatcctggttccaccatttgctagttggtagacttggtcaggttatgtaagctttctgggactcgtttctcagtttgtaagctgagactggatggtaatataggtctggcttctgccattaggctctgctgacctacccacacgtcacacagctcacacccttgttgcttagccctctctttttttctatatttgcttaacttctttccttttggctttatcgctcattatttgactctgggtttgcttttcatgctggaagactggttttgtttctctagtgttttggctttcaacccacccataggcatacttttatcacaccctctttctccatttgctcctgacatttctgagtggttactcacccattcaag

SEQ ID NO: 245204 - DNA, 378 bp, Homo sapiens
cacagttctgcaggctgtacaggaagcacagtggcatctgcttctggagaggcctcagggagcttttactcatgacagaaggcaaagcaggagcaggcgcttcccatggtgaaagcaggagcaagagagagagagtgtgttggggtaggtgcactaccatggagacagcaccaagccacgaaggattcgaccccgtgatccaaacacttcccaccaggctccaccttcagcactggggatctcgtttcaacatgagatttgggcgggacatccaaactatatcatctgtctccctcatccaagaccatatgatccgtagctcacttttgtctagcaacagattaaattcaacattttctgtgtgatttcttggttgag

SEQ ID NO: 245205 - DNA, 653 bp, Homo sapiens
caaagttcaaatagtgcaacaatgtttaaaaacacactgttcatacttacgaatcttaccactttataagtaatgaaaaactgttacttcaacagtatttatcaaacaaaatttcttggagacctgatgatagtaggattttgaatgttgactacagggaatgtttcttagtctattgcaaatcactatttcaacaagttgttctaccaggactagcttataccgtagttaatggtgacatagaggttcaccttcctgccattagtcaagaagaaactagagtcctgcatgcacaatcagtatatatctagggattagggcagaatgaaacggaatgtgactcaaactgagattcttcacttaaaagtttgagatacctagttttttaaacaggatgaacttcagttataaatgcaaaggagaaaatacaagtgttctttgtagctcagaagtattgcacatatactttttaccatttcataatgaaatcatggggatttcttacttgaagttactcagtttcagtctctctttgtatactctccattttcttgtgggggaattatctccttatccccaggcttggtaagaaggttattgctgttggtattttcccagattggaagataaaaatggctgaagttggccaggcg

SEQ ID NO: 245206 - DNA, 537 bp, Homo sapiens
acagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtat

SEQ ID NO: 245207 - DNA, 472 bp, Homo sapiens
ttgtgtggtgtgtatatgtggcgtgtgcatttgtgtggtgtgcatttgtgtggtgtgtatatgtggcatgtgaacacgtgtgcgatgtgaggagagagggagtgagacattcacggagcacgcctgtctctcctggctgtggatgactggactctcgctcattaggtgatcccacctcagggtttgtggggagatgtctgacactagagaatgaacatgtgctttggggagaggactttcacatcccacagaaacactgccctgtccaggcttcatgcccacaggatcctggagccaggtcctaagtaccaaaaagcaaataaaagcagcttcttgtttgcagctaggccctcccacccttgaaacggtgggaatacccaaatggtctctctagttgccacaggggtgtcagcacctctgggagatgtgggagggaggtactggtggcaccactaaacctggatggacttga

SEQ ID NO: 245208 - DNA, 373 bp, Homo sapiens
aagtttcctagggaactccttggcttcaaagtctgcgctgtctttacttagactcctggtgggcaaacaatggctcctgaaaggggggcatgaccaaggacagccctgtgggggcagagctgtctctgggatcagctggcatgtggggctggggcatttcctagggcatcgggcggactgggcttgcatctggagccaggtcctaagtaccaaaaagcaaataaaagcagcttcttgtttgcagctaggccctcccacccttgaaacggtgggaatacccaaatggtctctctagttgccacaggggtgtcagcacctctgggagatgtgggagggaggtactggtggcaccactaaacctggatggacttga

SEQ ID NO: 245209 - DNA, 333 bp, Homo sapiens
atcatgcagagcagtggtcttctcaagaccctgagaagttggtccctggaacccctacaccacattcaggtgccatccttattctccctctgctattccttgggactccaaagcttttccttcatcccaggtagtttgaaggacgcctaccttttcagtactctctaaaaatgtaataccttaagtaggagcctatgcttggttatgcttagctcacttgagagacctataataaaagccaactcttaattttccatagatgctcaggaggtaagtatgggcttctgtctccatgacacactttaaaagccttctacttaaaagatatagtaa

SEQ ID NO: 245210 - DNA, 517 bp, Homo sapiens
ggattttattttagcagtatgcccaggaaaaacatacaggaaatactttctcatatttaaaatgatttaaaatgtcaacatcatttcttactctctttcctgaagacttacgctccaatcctggtggttcccattttgaatttttttcctattgcattatttcctatttctgtttttaaaattttccagctaagagatctccctccagctcagtattaaaactaacaccagcttttctttaatttgtgaagagctaaaagattgcctcacattggtgttgtgttttactcagtattttctgcctttatgtaacatctaatttgtttccaggtaggcatttttaaaagctctttaaaggaaagatggcgtgagaaagtagaacacttggaaatatgtttgtagtaagttgcaaaacagtgaaaatgactcactgttatctcctgttattttatcccaagaatataacctcatgaaaattttctttgaacattaaatctgggtcatgtaattatatggg

SEQ ID NO: 245211 - DNA, 206 bp, Homo sapiens
tttcagatgacctgttataacactggatgcacacaactactaaccatgcatttatgcattttgcttattgacctattttttatatgattcatctgctcataaatgttatacccatgtgactctgattaatatacctgtttatgcttgcaaacatatgtatgatgttgttgcctattttattttgtaaggtgacctaggaagtattc

SEQ ID NO: 245212 - DNA, 284 bp, Homo sapiens
caagaaaagtaagatgaattaagaatttgatatccaaagtatctttcaactacaaaaatagccaatagtttaaatatacaagaactctcacaatatatttctcctgatctcatcttggcaggctctttggtcattatcaacagccgggaaatggagaactgggaacatacagcgactacaatgtcagatacataaaagggagtaaaagataaaagtcatgttcctagaaaagttgggagaatgtctaaagaagtaattcatgtaaaaatgctgatttggggaca

SEQ ID NO: 245213 - DNA, 347 bp, Homo sapiens
ggcagaaccgagaagaagacgcgaaggcgcgaaagcgaaggaaggaggcgaacggcaaggcaacagagggacagagacagcacaaagacaacaggaacaaaaaccaaacagccagcgcagcgcaggggccggcctccccccaaccggttaaatcagtactttgtgcttagattattaggactgtaagtattgtttgcagctgagcgacatattttactatgattatgtctgcttacacctcatatcttatatattttgtttttcatggagttagtgactacttcagcaaacacgaatatattacaaaactctcctacagttcacaatatggtcaaacatcaccacac

SEQ ID NO: 245214 - DNA, 581 bp, Homo sapiens
tttttttttaactgaaacctacaatcatggcggaaggcacctcttctcagggtgccaggagagagaatgagttttgagtgaaggaggaagccccttataaaaccatcagatctcgtgagaactcactcactatcataagaacagcatggcagaaatcatccccatgatccaattatctccacctggtcctaccctcgacacatggggattattacaattcaaggtgagatttgggtggggacacagaaccaaaccatatctctgggagagaccacaatgagcaaaaattgcactgtagcatcagttccacacatgtgagtacatactatatacaaggtcctttactgaggcccttctgtgtgtcaagcatcatgctaaacatagtacatttaagccttgaaaaaacctgtaataagatgtacatactcttatatagagtatatagatgagggaacttcaggccagagaactaaataactttctgaagatcgtacaaccaggaattgccaaactaggattcaagttcagatcttaaagtctcaaagtctcccacaaatctaggtcctggggggacactgagc

SEQ ID NO: 245215 - DNA, 306 bp, Homo sapiens
aatgcaggtgcccagggcccatctgtgaatcggggcctctgggggtgggggcggggccctggaatctgcattcttatgaggccgttaaatgatccccacgcaccttcaaatggtacacttgctgctgtcctgaaggcattcaaccatcaatctggagcccaaagagaagtttctggaaactgacaagtgaggcattcttttctcatgactttttgcttttaatctgaacggcttaaaaactatatatagttccccaaaattcacatatgtgatccacctaaccaaaatgacagccaagaaacaatg

SEQ ID NO: 245216 - DNA, 347 bp, Homo sapiens
aataatgagatatcagctcacacctattaggatgacttataaaaaagacaaaagctaagtgccagtgagggtatgaagaaaagggaaccttcacagactgtcagttgggaatgtaaattggtacaaccactctggaaaacagtatgacgactcctcaaaaaattaaaagtaggagtatgacacgatccaggaatcctactgtgggtatatatccaaaagaatggaaatcagtgtcttcaaaagatatttgcactctcatgttcattgcagcactatgcgtaatagcccaggcacggaaacagccccagtgtttgtcaactgcttaataaagactatacgatgatata

SEQ ID NO: 245217 - DNA, 353 bp, Homo sapiens
aaaactatagcaggaaggagaaccaagtaggtttgctcattaaatgaaacttaaatcctttatattctttataatgattcattaagaccaaataagatactacaaagagcaaatggaaaattttaaattacaagattatattccagttatctcttattttagaacccatcatcatcttgtgtttttccccctagctaagtaaatttctgaaccgtattttcttttcttactataatcatatatttttgggatgagttacatactcagccctctgtacccttgggcatctgctgatttagccaaccttggatcaaaaacatttagaaaagtattaatatgacaataaaaaataa

SEQ ID NO: 245218 - DNA, 329 bp, Homo sapiens
ccaaaagttagcattcttgggtagaaaagaacgtagtttataatgtagactgctgagaggtccccccagccacacacacacaaaatgattcaaattatgctgcatacactatacccagttctaacaatattaaggaaaatatagaaattgtgatgttgttttgttttattgttttgagacagggttttactctgttgcccaggctggagtgcagtggtgcaatcatagctcactgcagcctcaaactcctgggctcaagtgatcctcctacctcagcttcccacatcagcctccagagtagttgtgactacaggctcataccaccacgc

SEQ ID NO: 245219 - DNA, 394 bp, Homo sapiens
cttgttcccagcctctcgatggactctggcatcctgtcgcagctgtttctgaacgcggggacaaaagtgtgcgcggcgaattccagcctcagttgccagatgtagtgaccctttaaggaacaaatccacagcaagagggtcacccaggcaagtccagattggaacaagagggtctgactcctccgggggccagggacttggcctgagtctagagggcactcgtggaactgtgagctccgttcacaaacacagacactttaaaagtgacttcgccgtgtgtaatgagtctagctccattctgacattgacggctaacggcattgagacctccacccattccttccccaatccccacacatttactttaaataaagaatcccttggcctccagagc

SEQ ID NO: 245220 - DNA, 326 bp, Homo sapiens
ctgttctctcatttcttctctgtttcatgcaagaaattcatttcagagtttccaggaattacttaagtctctatctgctttcttcttgtctttcaaattgtagaattttttaatttgagaatttttaaaaataaatttgctcaaaaatgtttatgatcacctaacctttaagaagaagcaatcagagagtttattttaagatctagttttttacaagggctaacttaatatctgagtcttcttagaaaacttggaattggaagaaaagagagtggtcttcactatgcaattagaaagctgcaacagatttgtaggctttgcaaaca

SEQ ID NO: 245221 - DNA, 1535 bp, Homo sapiens
gtcactgactaatccataatactaattcagcttctttgtccgagtgggagccagaattttaaaattgttacaggctaaaatggtagagtccacctgagctggatgtgaaggggacagggagaaggagcaagaagggaagtcatccttccccacagggctccatgtgcctctgggtgcaactttgaactttgaacctgaaacttgcactgctcccctccactcccttctccactttccccctcctgctcaggccctgtgtatgtggactgcagctgggggtaagggacagaggctggtactggggcaccagaggtcaagggggaagtggggtgttgagcaagagagagctgttcttgtttggtactgagcaaagcctacatccacaagcagttttctgtctttccagattcttgaactcttctgtgggcaaggagttcatgaactctttagaactggaagcaaccttagagcttttctagctccatgtttgtaaacttttgtaagctatggaacacttacttcaaattgatgcaggatttttgctccttagttcagctaaatccaggttcttgtctcacaaccaggaaaaattagacatgcggacacattgaagggtgaggcaggcagaatttattaagcgaaaggaaaactctcggcaaagagagggtttctccaagcaggtttccctctcacagttgaataccaggtctaccgtggatgagctgaagaggccaggcccctcccctgcataaggtgcaaattcctggtggatccccccattcccccaatgcacatgtgggcatgcccaggcaagccataggtagcatcggaaaaggcaacattcgattggttaaaaggcattattcagaaataatcatagtatccccaggtctaatgcaacccttgtcccccattctacaaattaggagactgaggccaacacagtgaagtgactggcccagtatcacacagcatgtcacacaggaaaccagaagaagggttaggcttacaggtggcatgatggaattagcagtagaatgctgtcatgtttcaccaaaagcaaagctttagcctcacttaatggagaagggaattgtagacagggaagtcaagagtcacacattaattgaagcaggccgaaaaatgagagggaggtggctgctgtgttcatgccagagagaacacctttgaatgaatgacaggaaggtgccctttccagggactgaggcagtcatgcccagggcatatagcttggctgagggcacccaggatcccagcacccatcctgtgcctcgtcccctcacctgcaggcctttatactcctagccatagacagtggcctgcacagcactaccaagaactaccgggagacaagaaagggacactctctagagaaggcttcaaggaaagcttatggccaggcctggtggcttgtgcctgtaatcctaacactttgggaagccaaggcaggatgatggctggagcccaggagttcaagaccagcctgggtaacataagaccctgtctcttaaaaa

SEQ ID NO: 245222 - DNA, 395 bp, Homo sapiens
ttcatgtcttaagagcaatgtattttcctgaaatccacttgctggccagtgtacccactatctttcttctcaagccaaaggttctataaaggtccttatcagcgcacccagtaaagtcacaacctcccactgatgatggtggtatcatctttctgccaatctctggtcaacagaaggatgatggcagggtactaacaataaacatacttatgattgaattctatgtctccttgtggttctgtcacagagatcttttgccagaaaagccaagatagaggaatatgaagcctgttgcatagcctgaaaaacagactttatgttgaaaaacatctcccttgaagaagcagccacattcatagagactggcaataacaggaagcagcatttgcctaccc

SEQ ID NO: 245223 - DNA, 737 bp, Homo sapiens
acgttactatgtgcgagaggcagggcgatgcggctggcagatagtgagagggatcatccagttggatggcttcagggacatggaaatcactagacttttagaaaccttcttcgaagtggcagtgctcgtgaagttctttacctttaccaaaggcatggctctccagagagcacaggctcctgcacaagaaccagcacttcatcaggagaggctgcaggtactaagtgatgtccttggctcagttttgtttccatggtaactgtatgccacttttcactagcacgtttcaacattttcataacagagttaaaactacatacacagaacacctcaaaaataaacacaaacgcagtcaagtcatcttaaaagaatgtgaaatccatgtgtatgtgttggtggctgcagagggggtgtgctcctgctctcacaagaacccggctttcttcatttccaagaaaagtgaagacaggtacaatctgaggagcttctgaacttatcttgggtagccgactgggcacaagtttcagtgaacgtatgtttggcatctgtgttgtatttttcaacttacaaaacttctgttaaaaacaatgtttaatgccagacctatggttaacagccaagctcccctaagttaaggcattttttgaaaccttgctctgaagtgacaccctgtggtaaacaatgataaaggccaacagtctttcctgagcaagaacagaatctaccaaaagatcctc

SEQ ID NO: 245224 - DNA, 887 bp, Homo sapiens
ggtggcaaatttgtagcaatagcccaaagtttgtccttgaatttcaatgttccacccccatgcatacctggggcaaagcaaggcatctgtcagcacagacactagttacatccaccaaagagagaaatccaggaacatcgtgtaaataacctggtcaccctttgaatgaattatgcggaatttgtgaacctactaacaagggatcatccagttggatggcttcagggacatggaaatcactagacttttagaaaccttcttcgaagtggcagtgctcgtgaagttctttacctttaccaaaggcatggctctccagagagcacaggctcctgcacaagaaccagcacttcatcaggagaggctgcaggtactaagtgatgtccttggctcagttttgtttccatggtaactgtatgccacttttcactagcacgtttcaacattttcataacagagttaaaactacatacacagaacacctcaaaaataaacacaaacgcagtcaagtcatcttaaaagaatgtgaaatccatgtgtatgtgttggtggctgcagagggggtgtgctcctgctctcacaagaacccggctttcttcatttccaagaaaagtgaagacaggtacaatctgaggagcttctgaacttatcttgggtagccgactgggcacaagtttcagtgaacgtatgtttggcatctgtgttgtatttttcaacttacaaaacttctgttaaaaacaatgtttaatgccagacctatggttaacagccaagctcccctaagttaaggcattttttgaaaccttgctctgaagtgacaccctgtggtaaacaatgataaaggccaacagtctttcctgagcaagaacagaatctaccaaaagatcctc

SEQ ID NO: 245225 - DNA, 462 bp, Homo sapiens
aattaatcttaagggaaaagaagacataacgatagctgctatgcataaatatatatcactacttatgggcatagataatgcatttttatatctagaagaaagtgagaatttggtattttaccttcccctaatgctctccaccctgcctggttaactgaaaatagtaatttgaattgtggaagtttaaaatcttgggttttctacatgtttatttgtcattatgaagttatagtcgtgtatcgatgttgctcgttacactcaaagaagggatatagaatgaagatttagtatgctagattaggtgtgagaaaaccaggaacctctggaagaacacatgatagaacttgagaaattgaggagatgatcacttgggatacagtagaaagttaggaggaaagcggtgggaagagcaggatttataggacccgacagtgaagtaatgtagctagggatgcacaaaaa

SEQ ID NO: 245226 - DNA, 208 bp, Homo sapiens
gcagtgctgaagggacatcaagcaaatagtgtgatgcctgtgggtgcaatgttactccttcccttaggttgccaaaaaaatcaatacttcatagcattcctgaaacgaaaaagcttatgaaccattgtgtttagggcgtaagctatctattttgggctacccatcacagcttctctcctttggtagaataaagtgaactgaaccacca

SEQ ID NO: 245227 - DNA, 417 bp, Homo sapiens
gagcatatagataataatagccaccactcactgaggtcttaagtgtactgttctaaaatgctgtatatacattatcttatttaatcctcacaacagccctgtgagttagctattatcattccaattttatacatgagcctttcgaggttaccaaaggttagataacttatctgaggtcccacagtcagtcagaggtggaaccagaattgaaacccaggtctgtcacattctgtcttttctgtataccagggattagcaaactttttctgtaaaggccaactagtaaatattgtaggctttgcagatcatattgtctttattgcagctactcaacttgctgtggtactgcaagagcagccatagacattatgtcaacactggtgggcacagctgaaataaaactttatttatttacaa

SEQ ID NO: 245228 - DNA, 406 bp, Homo sapiens
ccaaaccatatcatcaaccatggggcaaagtgtgttttgtcatccttttaaagtgaccatttaatgagtattaattatgtcacaggtaacatgctaaactttacatgttttctctcatttaatcctcacaacaacccaatcacacagacaatattattatcctcattatacggataaggaaacaaaagagtagaaaggataaataacttgctcaaagtcacctaggtagagggtgaagagtggaaattcccatccagttctgacatgtagtttgtgctggtcactgatctcattaaattaataacctcacttccacagcaggatggctcagggtgggaggcagagtcagccctgcaagcagcctctcccaggatgagacttagcattgctccactgaggactcgcc

SEQ ID NO: 245229 - DNA, 693 bp, Homo sapiens
ccgagaagaaaaataaaatccttcctcatgaactcaggagtagagaaaatgtgttaccctctaacagtgctggaaaacatttccagaaacatttgaaaatattgatcaagaatggaaaagtaaaaaataatgcaagtaacccattcttatatgagggacagctaggtttaataatgggaaatatatccttccagacctcatgtggtgtcaaccaggttttatgcaatatttaggagtggccatttcccctgttcttgaattcgtctcttaaaaaattactaaagccctttaaaaactcaaccctttaaaatctaagtgaaaaacataaaaacagagggttagtagaataatcaagcttattctctatttgagttttactttcgaaaatccattatgacctccaatcagtcctgaaaatagtcacgcacatatttgtccagacatgttataatttattccaactgagtgggaaaagaaagtttctttcatgtatatgcttgtatacctaccctcctatcctctaccatcaatagaaacaaatgactgcatgatgaaactcagggtatctctcagccccactactggctgataattaaatagcataccacttttgtactaccaagctagatatagtggaactctagaaatgacactggggtataagtaaatcctgtccaaaggcagtgcccatta

SEQ ID NO: 245230 - DNA, 425 bp, Homo sapiens
cagctccttctcatactttgtcgtaacttaaatattaatagaggcaggaggcagagaaatcctagacagacagggatgggtccctggggaaaccttaccttcaggtcaaaaacagcctgaaacccacagaccagagtgaggacttccattcctgtttgttggctctcttcttattggttctttctgaataatgccttttaaccaattgaatgttgctttttccaatactacctatggcccaccctgcccccatcctgttcctataaaggcccctgtcagtggaggggagacagcctgactttggggaggagacagcttgacttcagggaaacatgatctgcttttctgataccctctccagctcccctctccactagagaactgttttcatcgctcaataaaattctccactcttaccattcaaa

SEQ ID NO: 245231 - DNA, 487 bp, Homo sapiens
taacccacatacacctactgccaagagctctcttaggttcttccttctgggaatgtaactagcaccccactaactacatacataaagatttcttattttgtatatcatccaaagcaaaaacgttaccccaagacagcccttctcattggtccccaggtcgtctgttatagcccctcagccagagcagatgttcacctaatgtcctacctgtcaatacagctatgaacacccaaggagaaagcaaaccaatttttatagcaggctaaattaaaacaaaaactaagcagttcatgaaaatagtaaggttgcgtgtttttaaatatatttataatactcattactagcaagaatatagtgaaataaacattccatatggctgtgtgggaggacaattttaaggcaacaagaacctttaaaaattaatttctctttcacttagaaattgcactattgagtaacctctctacaaaaaaatccagtatgtaaa

SEQ ID NO: 245232 - DNA, 416 bp, Homo sapiens
gctggagtgcaatggcgcaattttggctcactgcaacctccacctcccaggttcaagcgattctcctgcctcagcctcctgagtagctgggactacaggcacgtgctaccatgcccggctaatttttttttttcttttttgtattttactagagatggggtttcgccgtgttggccaggatggtctcgatctcctgacctcataatccgcccgcctgggcctcccaaagtgctgggattacaggcgtgagccatcattcccagtgtttttcagtgccttctccgataaggaacccgagaggcttccagtcaacactgggggctgggttcagtgaattcagtcatgctggtagagcccactatttttgtcctagtgggcaaaaaaggaagcctctaggggcaatgactaaagtgttc

SEQ ID NO: 245233 - DNA, 218 bp, Homo sapiens
gtttttttagctttttctcggacacttgtccagcctttgaaaactgtctgtagagtttctaaaatatgtatctctctgaattgctatctggtttgttgtatatatttctatgtagaaaatatacactcaagttcttttccttcaccataatcatcccgtactaaggataactgaactgttatcaattctgtgaataaacagaacttaaattactttta

SEQ ID NO: 245234 - DNA, 883 bp, Homo sapiens
gtctgacgtgtaaagttagcgagggactagttgcagacaattttagctaacttaaaaataagcgcatctcaaagtcctgtttttcgaagcctgaatttggtattccagtgacgcacctgccctccagaagccaactgagggttcccatggagaataagtacctattcacgatgctaggatgtggggcaggagtgaagaagagtgaaatggccatcttcccttgtggttccagcattttccgagcatgccgagggcagagggtccctgtgtcttctttgaagatcaagaaacaggcctgacgtctcagcttgtgctatgaacagggagtgttgaaatccagtttgtcctgatggctttcactttgcaggctttgctctacagataatctgttataaatctaataaggtggaatgcctccctacaagtagcgaagccgagatcacacagcgttgccgggggcaggtagggaatcagtcactgtttgtgactgctggtttcattaaaactccaccacagtcatgtttctgggagttttgccttcctgtgaattttaatccccagcagccatggttgttgctttcattctttttgaaatgatggtggaaagagctcactttccctctgggttctggctgacaagtagatactgtgagactgcattaggctgcatctgtccgctctgcgtttccgccctgagtgagctctgagcagcgggagggagggagccaaggggccctgtgcaggtgacagccagaggggaggggctcgccataacgaggagatcagttcaacaaaggactgtgtttgttttctgagctgagaagcaccccgaagccctgtgggttgtatgtttataggttaacctgctggtggcattcccaat

SEQ ID NO: 245235 - DNA, 427 bp, Homo sapiens
gaagattatttttccaataaaatattacaaaccctaggaaaaagcaatccaccatgagccagggaagatgcaacaattgagaaagtagttcaccaaaaactggaggtagtagaacactttgataaaaggaaagaatatagagttcgattggctgtcatcggactagtcttggaaaccaaaaactaccaaaacaaaggcaactattctttgaaaagttgtctcttttaggggccatgtgctaccttgatgtggcttcctagtgtacatttcaattctctgctcccttcagatttcctttatctacttaaaaataataactctttgctctttacttccatttgaatgtattcttccatatgccatatggaagccagtatagcttagtgttgtaacattagattccgtaattaaaatttctgaatttacc

SEQ ID NO: 245236 - DNA, 418 bp, Homo sapiens
aaaagataggcctgtgtaatgtcatcaatttgagaaaatagccatttttctcttatgcattattagtaagataaagtatattaggaatgaaattgaaatagacattagatttcttctccatcatttgacctgttcatagttcaaacaattaagtcatgatagtgtcaacagggattatcttaattttaattgtaaaagaatctgttttctttcatgaggataaactatcaggctttgggcttggtacttttatttgcttaggaactgagtaattgcctcataaaacagcatgatggtactattaacaccgaattataagacctgttattatagaatttgcttttctagttgggataagacttcattttttggtgcttaaaataattagtttctccaaatgggtgtataataaacaggt

SEQ ID NO: 245237 - DNA, 457 bp, Homo sapiens
ggcctaaaagaggccccaccggtgtcctgggaatccctgtcagggagagagagagtgtgtgtgtgagggagagagaacatgtgttactgcataggaccacagagcagatgtagcaacaatttttttaaaaatatattcttttcatcaaagcgacaagattttggcttgacagtaagtgaattgaaaaacagcatttggcagattttttttcattcgctgtttatttaatttgctattcgattttatgggatctcttgataagattctaagtcttcgaccctgagtttgcaaatacgtgttaatgtattgaaacttttgttcagtgatggatacactgactctcttttcattgatcccttcccagattcgttgatacatattaaaaccttgttaaaatagtttgtcaaaataaaattttgtacatcatataaaagaacattacttcagatgttacaaa

SEQ ID NO: 245238 - DNA, 713 bp, Homo sapiens
atatcagagttatttagatgagctgacattcactctatgcttagaaagatggagttgaaatttaccatgtggtaaagaggaggaagagtatgcagaaaacaacattgtgaacaaaaccatggaaggatgaacatggcatggtgtttgggaactggggagtgggaactagaaagggatgtctgtggcccaggtaagggtaaggagagagattggtgtggaagctgggacacaggttgtgaaagctcttgggggaatcacactataacccaatggttcccagacttgctggctcatcagaaccaccagtgaatctatttttagatgagattcccaaaccttgcttagttctactgactcagaattttggcagtagaatctagaaaaagttctataattattaaatgtgagttaacttattccaggctatactgcaactaagggcagtaagtattgttagggactttagaggtcacctagtccagtctcatctctggcctagactgcttctctgctgtaacatccctggtgggtggtcattcagcctctgctgaatcatgctcattagtggagctcactgtttgagtcctgttagacaaatgtggttattggtgtgttcccttgtattgagttgaaatctgctgttttatttcacccactgcttctaggcaatatccctcacgtcgcattccagatatgatcttactagtgcagag

SEQ ID NO: 245239 - DNA, 439 bp, Homo sapiens
ttcctggaccaagttatttttgtagtttactaatatacaattgatcaaaacaatataaagctatcgtaacatgtgaaagattatacaaattgtaaaaattttgttggaaatatgtcttaatgagatgattagggctgtttttcccaattcacatttccgtagggaaatattccttaaaactagaatgtggcatggcttagcacatttcactctcattttgtttgatagatgtaaataccgagaaaatctgtttacataagtagatgaaaatgatagttttattgtgcactgctactcaatttttaaagcaatttctgttatatgccaaaaatcacagtgatctatcaaaagttattttcaaattacctctcagctgacatgtcaagtcctccttaattttttttttaaataaacacttggtttgaaaaaggatttgtca

SEQ ID NO: 245240 - DNA, 371 bp, Homo sapiens
tttttcataattactttagctcaagtgattgcatttaaataatgtttgatgtgtaatgtaatatttctaaatggcttattagttcttttacagacaagccttataatgtacttagtaatttttattaatagaatcctatatgttcagacactcaagggcaagccatttcttccgtgattgccactaatttgataaatttaaatgatgagccaatatgggaaggaatacaaacatacagctcaacaagataacctgttaaggtgaacctagatctgaatgtggtcaagtccaatttcctcaagccattcacaaaattagttacatttaagaatgataagactaacatttcattattttcacacagttatttc

SEQ ID NO: 245241 - DNA, 133 bp, Homo sapiens
tcttgtattccgttctccctcctttccatctcatctctttgttttccctacctgttcttttaacagaggactccgatgacgttagaagaggctgcactgcctagagcaatctgcattccatattagctttata

SEQ ID NO: 245242 - DNA, 410 bp, Homo sapiens
aagtacagcagtctcttcgatgtctggaaacgtgtctaattacgtttagagagtaactaaaaaaatagccagtgtcccggaacagacagctcagggatcactccatagcatcctgaatgacaggatggaactacgccaggaggaaaaaaaaaagaagggcgaagaaagaaagaaaagaagcaagtgtaaagccgggatgagacgccagcctctctccaaaataatcctccagtcctcctagggccttcggggccaccgcaactctcgttcaagttatttcccttcagtttccatgaggtcaccggcccgcccacatccctcacctggcgcggggaagcgcgccctcccgcgcggcacaccctctgcacctaaaccccggacagcgcccagggctcccctctcagggaagc

SEQ ID NO: 245243 - DNA, 296 bp, Homo sapiens
tctttctctagatgggaatttctgccctagagaggtcttggaaactttctcaccagaagagcacaacttgatggcaggaagctcctgatggaggcctgaaaatggccctgaaagggatgccaggggaccagggctccactattatcagcgtgtgactttggacaaggatgttaatggctctgtgactcagttacctcttctgtactttgcttaggggtctattgctttccattttgtctttttcatttgttaaatccaatgatgtcactgacagtaaaaactagtaaatagtaaaa

SEQ ID NO: 245244 - DNA, 484 bp, Homo sapiens
cgctccaggcctgggattaaactttctccgtataacttgtaagacaggcagattctcaggaaggtgctattgcttaggggagggaaaataacatttgctatctttattctagaaagcatacatatttggtgtgtataccatttgccactggcacagacaaccaccatgctcgctgtcggttgaccctcctcaacccagcttggctggtgaaatgggctgggctcttagagtgactctcgaatgaagcagacctttcactgctactcaatttccatttatgcaaattgagcttgccttcttctctgattttcctctgttccttttaaagttttttcccagcattttgactcctggcatctgtgtgcaaatgtatgaattaatatattgctcattgatggtgagtttatatttgctgattgcatagacatggtcatgcccatgataccaggttcaagctcaaggagcttcaatgataggataccat

SEQ ID NO: 245245 - DNA, 222 bp, Homo sapiens
gagctgaggactgcaggcagcctctagacactgaaaaggaaaggaatggattctcttctagagcctccaaagaaacacagccctgccagcatcttgacttcagccccataagacccatttcagacttcgagcttctagaactgtaaggtaatcagtttatgtggctttaagccgtgaggtttctagttatttcttacaacagcaatagaaaactaatgcaag

SEQ ID NO: 245246 - DNA, 665 bp, Homo sapiens
gggcagttcatttaagaaattcataaaatctggtatttttcctccaacagtagtacagatcaattcttacgatactacagttactagaaatacaagtttactaaaaaaacaagaactgcagcattttctacagaattctgaattgcctacttttctcagttacaattaaacgccaaacagaatgaattgataatatcataatagaactaatacaagaatatgccaatggcagctgggcacagtggctcacacctgcaatcccagcattttgggaggctgaagcgggtggatcacttgagcccaagagttcgacactagcctgggcaatatggcgaaaccccgtctctaccaaaaatataaaaattagccagttttatagcccggtctctaaataaataatacaaacttaaaagtaaaatttaaaaaaaatttttttaaaggcatataccaatggctattagtactcaactgcaacttaaactgtaacttgcagctaattaattcccagtataatcttaaaacttctgggtactaatgtagtactcaactaaaataaggttctcggctcacaatacacacaaagaaagttaaataatttaatctaaaattcttcctgaacaaggaagtgtggggaaaacttcctgtaagttgaattttgagaagca

SEQ ID NO: 245247 - DNA, 304 bp, Homo sapiens
gcttttaccacatcatttttatgctctttcctctgtgccaccagttttcttccctcttctttacttcctttcccttctcagtgctaatatagaaataaagactttactatcaccaaaactttgccctgtgagagcattactagcaagggaaagatgtgtattgtagatgttccagtgtgaagaatatgaaagacctccttctaggtaaaaacccctcattatccttcaaaaatggaaccaggggtgaagtcatcataatcatgaagagcctggggttcaccttatctctgccttgtgagggtat

SEQ ID NO: 245248 - DNA, 141 bp, Homo sapiens
agagttttccctgtttgatccatatgcagcttaaatatgtgatgttattctacattttatccagattcatttttcaaaccaatagtaatcattgttagcaaaaaccaataaataatcttttattctgttttaaaatttcca

SEQ ID NO: 245249 - DNA, 266 bp, Homo sapiens
tctccttcagtggtgacgtgtggcaaatggattgtaaatgaagatagactgtgtaatgaatgacgacactaaagactaatgtgaaggactttagggaaaacaaaaggctttcatctgaaaggatgatctgtggaccaaggtcactcataccactcactgctcattttctcatgttattttaaaacttttttcggcctttatactgctttcagcagcatttgtgtgtaagaagtggacgatgactttaataaagagacccgaatgga

SEQ ID NO: 245250 - DNA, 793 bp, Homo sapiens
cagagtcatgcctcttcattaggtattatctgatgataaaagggcacagtcgactagttgtagagactatatggctcacaagtcctaaaatatttactctctggccctttacagaatctatttgctgatctccagtctagagtgttactgatgggtttctgacacagaaatatctggctgagatggtccaacataccgggaaactcattctctcctatgagaaagtcatattctctgatagcatctttggtcacctgaaacctagtgtccattgaaggcacagctctgggaactgcaaaactgttctgtggagtgttatggagagtaaagccaggcagaccagctgcttctgagggctgtggataaaatagagaatgatacacttacatcctctaccttttgtttccaggcacagatcatttcaggtgccttctgtgcagaaatagctgaataaacttggagcttggtctctttgttgttgaatttacaatgttatttgaatgtaagaccttgtagatatgacatttgaaagttagggctctggaatggcactgcctggcttcagatccttcatttttttgctaaatgacaacaaacaagaggcttaggctctgtgcctccgtttcatcatagtcaattctggtatttgcagtagttatgttgaataaagtcacccagtacacggacttagcaaatactgctccttggaaaccacagctcctagggaagatacagggttaggttcctgtgaacctctgatcacaacatttttatcaacagatcaatatacata

SEQ ID NO: 245251 - DNA, 542 bp, Homo sapiens
aagttttcactgcattttgactgtgacctgtcacaaaatcaggtgtgaaattttgcttgtggcattatgttggcactcagaaagttttggattttgaagcattttggatttcagatttttgaattagggatgcttaacctgtagtctaaaatgatattaaatagataatctgaatagttacataactattacagacattgaagccatgatcaaaaagcttccaaatggaagtttccaggcccagatggcttcactggagaagtctaccaaatatttaaatatttaaataaaaattagtacttattctacacagtctcttccagaaaacagaagaggaggaaatagtccccaactcattcaatgaggccagtattaccctaatactaaaaccagacaaagccaagagcagtggctaacacctgtaatcccagcactttgagaggctgaggcaggaggactatttgagcccaggagattgagaccagcctgggcaacatagtgagacccggtttacaaaaaataataaaattagttgggtgtgg

SEQ ID NO: 245252 - DNA, 432 bp, Homo sapiens
acaattttagttcacaaaatggggaaaaaaattttgctaaagataatcattttcattcttagtattgctggtgtggcatatggctctggaaatttcttgtttactgaaatgccaagaagctatgtccatacatacagagagagaaaggactctggctctggttctgttggctccgcctcttgttttgtgttcttaggcttatctaaagatcctcaaagctcggccaggtgcggtggctcacgcctgtggcatccccgcactttgggaggccaaggcaggcagatcatttgaggtgacaagttcgataccaatctggccaatgtggtgaaaccccatctctactaaaaatacaaaaattagctgggcatggtggtggcacaggcctgtaatcccagctactcgggaggctgaggcaggagaatcgcttgaacc

SEQ ID NO: 245253 - DNA, 654 bp, Homo sapiens
tcttatctttatgtccgtttgtgttattttgctgtcttttatactttttagttgaatgtggttatttttattttcaattttccctgtctttaaggtcataaagttttctcttaatactgctttagcaaaatccaatgagttttgatatgcagttctcttacatctttcatttccaaataattagtaattttaatttggattcttcatcaacccataaaaaggtatttttaaattccaaatggatagatttggtgtgatttgagtactttttggtggtaaatgtataattttattgcactaaggttggagaaaataaaccatatgatttctgctttttgagatttactgagttttttgtgtactaatacccaatcaatatttgtaagtgttccatgagtgtctaaaatgagcatgtattatctgtggaaaatcaagaaaccctaaagccctgtgcactggtcagccagcttgcaaatttagtccaagacgaggtcaatgatctccttgccaatggtgtaagtggccaccggcacagttactggcataggtattccttacctgtgatgcaatgctcagggttcaagagctgacaataggtgtcagtgtgaactctgtcaacagccatgggttccaggtctacaaacactgccctgg

SEQ ID NO: 245254 - DNA, 454 bp, Homo sapiens
gatattaaaaatattgtataaaattacttcaggcagtgtgcataaggtgaagcatttatgaaacataaatgagcttatgtttagacttgcatcccacccccaatatatctatctcatgtatatgcaaatattccaaaatccagagcacttttggtctcaagcatttcagataagtgatacgcaacctgtactattatctcttcatagaatacccctgtctattttgtgaatgcaagtgtttttctgtgtagccttctctgatctttttccaataagtcttattttttataattccatgtaccccagctctattatagcgcttaactgcagtttattacaattatttatagcctctttacccactagaacagcagtccccaacgtttttggcaccagggaccagttttgtggaagacagttttttcccatggatgggatgtgggggtggtggtgg

SEQ ID NO: 245255 - DNA, 456 bp, Homo sapiens
attgtcattatcatcatcgttgtcattgttgaattggctcacttcttccaagaagatgtcttggctaacttcttaaggcaagcagttttcaaagtgtgataagaggatccctcgggattcctggtatcctttcaactatgtatttgtgtgtgggtggattgtcttctaatacttcaagcaaaacactgtatcatgatagattgaatgaaggagcagatatggcaatccagctgtctcatattaatcctagcattaaatacacttgcaaaagtgtaaaatggcacagctcttctcactaaatgattttgtttttgaaaatattgttttatataaaacatttatattaatatataatgggtttatagttgttacttaaagataaattgatacataaatatacatttttcaaaattcaagcatattatggtaaatatccatagagatattctaaatatt

SEQ ID NO: 245256 - DNA, 475 bp, Homo sapiens
tgggttactttttgtctagatacttgcaggtatctttttgttgctgtttttgttttgttttatgtcagaagagttgaaaattaggactcaacggaaaatcaggcacagaaaggggggaaatacctcacgttcacactcatgtgggagctacaaaaacagctcaccgaagcagagaattgttgataaaggctaagagggagagagaggggaggataaatagggagaggtctgttgagaggtctgttatcagatacagagtgactgctagattggaggagtaagttctggtgtgttgtagcactgtagggtgaatgtggctaacgataatttagtgcgtgttttcagaaagctagaggacgggttttgaatgttcaaaaataaatgtttgaggtgatggtcctgatttattacacattgtgtacgtgcatcaaaatgtcactgtgtcccataaatagtacaattattacatacaact

SEQ ID NO: 245257 - DNA, 462 bp, Homo sapiens
tatttcattttttagcatttaaaatatttttttttttatagagatgggggtcttgctgtgtagaccaggctggttacaaagtcctggcctcaagtgatcctcccatctcgggtctcccagagtgctgggattacaggtgtgagccccacagcgcctggcccattttcaacatttctataggtatatgtgctttgcgacctgggtttaagaaagtggttattgacactgacacatattgtaatcaactcagtagattttagaacatcaagctaatgaccctaccctagaccaattaaaatgcacttctaggatcatctttaactgtaaccctgaaagtggagtcctgaactagagaaatgtgctacttgtcttactgatttttaaaaatgcattaaaattaatactataaggaatgctctttaaaaatggtggaaaataaagtggaaattttaaatttgtcat

SEQ ID NO: 245258 - DNA, 438 bp, Homo sapiens
gtggccacctgttaccctggggcagctgagaagaaattgaaagggaattgcaatttttcctggtattgggtctgcggaagggggtctctactctttctcatcccacctctactctcatcccatcctcattcttcctcattagttaaaggcagagattagggaaggcactggccacagccacccaagtatcatgacttgggcagggtaacattttgatgcaactctatgcaaatggcacccctggaaatgggcacagttgtagtccaggtgctgtggcgtctggcaagtctatgtcgtgctgtttgggggtgatgctccatctctgccgcagaatatgtaaaatgttaaatctcctgtccagagaagtttcttcccatctgcctccatagagagactgtgactggaaacagggcaaaacacagagaggctgacaagagg

SEQ ID NO: 245259 - DNA, 869 bp, Homo sapiens
atgttaatttcatttcagctccagcatttatcctcatactagtcccctaatctctaggcctcagtttcttcatttgaaaagtgaaaggaatcgtttctgctttacctagttcataagatttcctttgaaggtcaacagaggtaacggatgtgaaattattagctaactctcaaactctgtaaaaataaatggtgttgtctgtggtcaactaacagcacaagtagagagctggaaaaagttgtgaccataattgtctcttccaattaattaatgcagtctactattttatatgctacttgcctaagagataaatgataaaatcctcattaattttaatttatgacccaaattaatttttggtatatttgagaaaattatgtttaaatgatatatgaggaaacacatgtttctcacacacccatgcacacaccaatccccaccaaccataaggaatttctgctgctgcttctctccatcgtgtttactcttattagattttgtctattaggtttttacacatgaaggagaaagatatattagatacttcttatgtgtactttagtttcaagatactaaggaaacaatgtaggaatttggtgagattgtaaatattatttaaatatagtatttaatacatctgttaactgaaatcattttaacatcttctatgaccattctctttagctaggagaatacagctagcttgtttaaaatgaacaactgaaaatgtaatcttaacaaatacattcagtaatattgagaaagacttttccactaaatttaaacaagttatataaccaggcttatgcaatgaaactggtttgcaaattctaattccggaaattagatatgattttcactaggagggc

SEQ ID NO: 245260 - DNA, 803 bp, Homo sapiens
cttttatgttatcacaaagtacatctttatatgttgtgtgccatttgataaacatgttttatgcatttgatttttaaatcacataggaaacaaaaagagaagtgacaaactaaaaatacaacaatattggcttttatatttacttagggagttacctttattgatgttcgttatttcttatggcttctagttactatctatctagtatcctttaatttcatcctgaaggactgtctttaggatttcttgtaggtcaggtttactagtaacaaactctgtcagcttttgtttagcttgaaatgtcttaatttctcctttagttttgaaggattgttttgctaagtataaaatcttggttgacagtttttttttttttctgttaggatgttaaatacattgtctcactgttttctggtctcgtggtttctgatgagaaattgggttttaatcttactgagactccttgctgctttcaagattctcgttgtctttgtttttgactgattataatgtgtcttagtgtgggtttgagtttatcttgcttgaagtttgttaagctttttggatttgtagattcacgtcttcaagttttggagttttcagtcattagttaatcatgtatcatttcttcatccctctctcttgcttttctttttgtaacttcataatgcatttgttaactggcagatcccttaggctgtgttcatttttcttcattctttttctttctgctcctcagactcaataattttaattgtcttcaaattcagtaattttccctgcttttgacattatccatggtg

SEQ ID NO: 245261 - DNA, 297 bp, Homo sapiens
actcgatgtactacaaataaattgttttcacggaaatgattccccgaaagtttgctgctgaactcaggaccctaaggacgtttgcttagggaatccgtgtccctcgagaacacctaagatgggtatgcgtttgtgcatttaaaaatgcctcaaggaactattgctgaggaacagaaaccatcgccggcgcagaagcgttcgcggaccacttggagatagatgccagtacagcaattctgttccaggaggcttcggcttaagagggccggggaggaggagaaccctcgggaaatagca

SEQ ID NO: 245262 - DNA, 554 bp, Homo sapiens
ttttattctaaatttctcacactcagaattttattctgttgcttaaaagcaacctcactccccacttccaccccccacattatcctgctccatctgtataggttactctttaggcctgttgaacctcgggactttgcaatattgggtcccctatatccaagagcctctgctttgttttttctttagcacattttctctaagaacttcgtaagaaaagatgggccaggcgcagtggttcattcacgcctgtaatatcagcattttgggaggccgaggtgggcagatcacttaaggccaggagctcaagactaccctggccgacatggcgaaaccccatctctactaaaaatacagaaattaaccaggcatggtgccacattcctgtaatgccagctacttaggaggctgaggcacgagaatcgcttgaacccaggaggcagaggccacagtgagctgagatcgtgccattgcactccaacctgggcaacagagtgagactgtgtctcaaaaaaagaataaaaagctcaccactagctccactgtaaccccatgca

SEQ ID NO: 245263 - DNA, 337 bp, Homo sapiens
ttttttaatttcagaaatgttcttttggggccagagtctgggcatatatgaatgcaaatccgtgtttgttcacaactaagcccagctgagacgatcacttttctgtaggccatttgtccaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggtaaaatatattagatgggcaatatttttcag

SEQ ID NO: 245264 - DNA, 365 bp, Homo sapiens
tctagaaactatagaataagtatctaagacttgaagagcatgggctttagactaaagaagaaaagtgacacccacaacagaaaacgtggttaccgcctacttaaaaagtaacaatgacctttatatctcaaaacctaccacaattcagacacatggtagatgcttgatagttatcaaaaagaccaaattttttttaagcagcagggtctcactttgttgcccaggctagagtgcagtggcatgatcacagctaacggcagcttcgacctttcaggcccaagtgatcctcctacctcagcctctccagtagttggaactacaggcatgtgccaccatgctcggccaattattattattattttttt

SEQ ID NO: 245265 - DNA, 419 bp, Homo sapiens
gtgcagaacattgtcccagagaatctgtgagaaagacttggttggtgcttgaaaattcaaaaagaaaaaaaaaagtggccaggctcagtggcttatgcttgtaattctagcattttgggagccgagatcatgccacttgcacactagcctgtgcaacagagccctgtctcaaaagaatgaaagaaagaaagaaagaaagaaagaaagaaagaaagaaagaaagaaagaaagaaagaaagaaaagaaaagaaaagaaaagggaagaaaagaaaagaaaaggataaatgctccaagacatgacagttagcagagtgaaaagaaatcagtttgcactgaaatatattctaggattaggaagccacgctttggaaacagcaagacaaggcaggaataagtgtcacgcatttgggggctctaca

SEQ ID NO: 245266 - DNA, 430 bp, Homo sapiens
atcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcagaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttg

SEQ ID NO: 245267 - DNA, 496 bp, Homo sapiens
ttcactcttgttgcccaggctgaagtgcaacggcgcaatctcggctcactgcaacctccacctcctgggttcgagtgattctcctgcctcagcctcagcctcccgagtagctgggattacaggtgtgagccaccacgcctggttgctgctgtatttgtgtatagctattttttaaacatttgttgtgcacctcctgtatgccaggctctgtgttagggcgtgagccaccacgcctggttgctgctgtatttgtgtatagctattttttaaacatttgttgtgcacctcctgtatgccaggctctgtgttaggttttgggggataaaagatgaataaggaagtgcacagtaatttttcacaccgtgagggaaatgtcaacagagacatgtagcttgtgctggaatgacagggacacagtggtgcactgtgtttgggggcagtagggactccacagtgcttctcctacagcactgtttatctcccctctccctccttg

SEQ ID NO: 245268 - DNA, 567 bp, Homo sapiens
tgtagtcacatttgaaagttgactgtattctgtacacaaaaatgcaaacatgcttcctaggaaaaaatagaaattttgcatatgattacacagcaaatattttctaaaactagggcaaagtcttaattcccaggacaactccttatcttaaaaacaaattattttatatgacacttttactctcacttgtctgttgaaatgagaaaataaaagtatttttgtggcagtgtgcacatctaataaacaagacattaaaatgtttggaggggctggaaatagggtcacggcctacccctttttaacaacttcattgactaaatacttccatgtcctagggaaataattcacattttgatatttttcagcaaaacaagaaaaggagagaaaacttagctgtaaaaggcaatattacagaaaatgacttagaaagttgctttctgactgggtgcagtgattcattcctgtaatcccagcactttgggaggctgagacaggaggatcacttgtgtccaggagttcaagaccagcctgagcaacatagtgagacctcatttctccaaaaaaaaa

SEQ ID NO: 245269 - DNA, 336 bp, Homo sapiens
agggcatcttcagcacagggtagagggccaagggtctttcttgggtgggtgtaaatagagccaaaggaagtttcaggaaagagatcattcacacatcagcaagcaccacacactgcactgcaacaaggtcgagttgtgcacgtgggctgtgctttggaagcgtccagacgtccgtgcaggtgttctctttagagtgtgccctgaatggcagtaagcagacaaggacattttatgtagaagagcatctggtatagaaggaactgctttgatcagtcccacgctctcttctctttggatggtgacttgcatcacaatcagaagcttctaaagttagta

SEQ ID NO: 245270 - DNA, 717 bp, Homo sapiens
tataatagtactcccttaattcctagtatgtacctctattctgcaatatgtcacattgtgttgtgcaaatatctgtggtgccaggctagaggctgagaatataaacatgaatagacatagattgtcatcaaagagcttatcctctaatgaactttattcttgcaccattgaaggaccttcacaatctggcttcagtcccttttccccagacatctatcttctagccacatctacttttctttcccaagtaaaccacttacattgtattacccctgaagtttttcctattgcttagctgataacatttattgaatgcttaccaagcgtggtgaaatcttgcccatgcttcaagatgtagccaagagtatatcatggtgactatagttaataacaatatatcgtatacaggccgggcgtggtggctcacatctgtaatcccagcactttgggaggccgaggcgggcagatcacgaggtcaggagatcgagaccatcctggccaagaagatgaaaccccgtctctactaaaaatacaaaacaaacaaacaaacaaaaaaatagccaggcatggtggcaggcgcctgtaatcccagctactctggaggctgaggcaggagaatggcatcaacctgggaggcggagcttgcagtgagctgagatcgtgccactgcactccagcctgggcgacacagcaagactccgtctcaaaaaaaaaaaa

SEQ ID NO: 245271 - DNA, 167 bp, Homo sapiens
caaattccacttcccagagagggaggaaactggtggcagccacatgtgcagcacagcagtgtcagctccagcaacaccgcagtccccagggtgtgcctccggcttcacggaagtcacctgctgcactggtttgccaactgtttgtttttctaagtcctcatctggga

SEQ ID NO: 245272 - DNA, 590 bp, Homo sapiens
accacaagggagtttctggggcctggccctctctctgctccttcctgtcccaaagggcttagtatttccctggatccaggcctgtttagtgtttggctggtttctggggcctccagcatggctcaggggagaccccaggtccatgggtaggaggagatggtgaggagaggaatggggatcccattcaggctcccctcgtgaagggggccaacactggtacttccttagacgggaagaggctgtggcatgggaagcaggtcaatagtttgtgtcaaggaggtgcagcccaagatcacagtggtggctgtttgatgaaggattttcctcagtgcctgaaaagcaatttactcttgtccttaaagcaacagtgggtaggcttctagaatgagtgtgagttttcatctcaagtggcagtgcccagctgtctgcatacctcagccccttcagacctggctgaggtattttagagggcattgtcttccacccatgctgccagtcctggcagttcctgcccagcctggatccctgggcataccctgccactaatgctgtgcagacaaagtgaggcctgctggccctctgttggcagc

SEQ ID NO: 245273 - DNA, 370 bp, Homo sapiens
gcgcggcctatcccaatatttctatcatgcttctctaatttatttttatatttatttatcgccatttatcatagtacatattttacttatttgtctattttctggctccctcactcacttcatgagggcagggattttatctttgttctgtctgctttctcagtgcttagaataggtcctcaagtaatacagatggatatgtctactatttgtaaaattgactaacaaaaaaggcattgtaaggcagggcgtggtggctcacgcctgtaatcccaggactttgggaggccgagggctgcggatcacgaggtcaggagatcgagaccatcctggctaacacagtgaaaccccatctctactaaaaaaaata

SEQ ID NO: 245274 - DNA, 408 bp, Homo sapiens
gtcagttacccatattgatatcagtttatccacatccatgctttcaagtttaaacaaagaaactaggcaaaggcagctatgtattcgctaggattagggaggagaagataatgaaccactggatagtgagaagaaagagaggtggagaaagtgagagaccccagtaacagaggacagggacacattgctaaggatagggacacattcactgtaatatagaaggccatgcttatatgtaaaatatgcagtaattgtatatatatgtacaaaagtgatgacacacatatgcacataaacaaaacacaattactgtctatgtttctttatttgtgacctaatgttttatgttgtttgtaactgaaaaaaaaattcccttctgaataaaatgtcaattttgcgattgcattt

SEQ ID NO: 245275 - DNA, 469 bp, Homo sapiens
cagacttacaaaagaagacttaccaataagattaaaataaattaacaacatatttttatgttgctaaagaataatatatgtgtttcatcgttaccgtatcaaataaaaatctaatggcatgtctaataaataccataacttcaaagtgatgatgaacttatatacaagatatctgaaacatctataacgtaatataaaaatgtctcatttcggttgatgatgaaatcacgggtgttactaatgccttttttcccctacatttataattgagggcaatgctaaacttcagaggttagtgaacataaagatacagatttttaccatgaagttaacaagtcacctgaatctatccatggactcctggtttctgaaccttaagttaagaacacttgatatagatgtatatgttaaatgataagggaaaataaaatgagtaaaacaagataaatgaaaacatgttaatatacat

SEQ ID NO: 245276 - DNA, 447 bp, Homo sapiens
gtaagttttgtgccaaactagggcagataaagatttatggacctaaaagtaggcatcataaaagctaatatttgttgaggttttgctatattccaggcagcgactaagagatttgtttattaaaagttttacagcaaatctatgatgtgggtacgattccgatcttcctttgcctcaagtttggagagttggacttgtcaactctggccgaaccaaccagtgaagagctgcagttatagctagataatcatactttaacgtttacttttttacctataagctagatgtccacatacaaagaaaagagaatttggtatttgttttccacccaagcactatttttttaggcacttgattggacagagtcccatttagttcctcgcaacattactggcctggtttttatttgttttgttttttaaactgcgtgctttttacaaatagtat

SEQ ID NO: 245277 - DNA, 425 bp, Homo sapiens
taaccaatctggaactcagcttcttcatctataaaaccagggggctatactgcagctgtgaaccattctaagaatactaatgacactaacttggtatgagaaatgctgtgcaggtcacattttctcaaatgtcatcttattggattgtcacaaaaatacctctacttgggccttagctccattttctagatggggaaactgaggctcagagagactacatgccgcatcatgaatcaacagcaaattcaggtcttagatccaggtcttatgatttaaggtcctatattcctcaaattatgatgattgcattttatattgaattttatatttctggctgcaaagtattactttataatatacattatatttctataaaaataagaagtttgataattttggtaaattaaaattgacattgatttgaa

SEQ ID NO: 245278 - DNA, 384 bp, Homo sapiens
taaccatatctgctgtatcatacaagcactcaggatcttggttgcaatgaatggaaacctatgctaaataactttctcagagggctcttggggctctggaaaccagacagaaggctggagaatgagggctgggcataggcaggtccagggaggccaagagggcagcctggctgtgaggcagctgctggtacagccagactgtccctgcttctgggtcacttgctccagacccaaagttctgcccaggaatgtctggtggtcaaactccagccatgtggctccctcttttcagaggtgaactcagtcttcactgataagggtaaggttcctggtgaatcctgcagcttgaatgtccatccccatgaatccgagctgagcctgcag

SEQ ID NO: 245279 - DNA, 410 bp, Homo sapiens
cccagttcttagactagtacctggcatgtggtaggaactccgtaagtatttgttgaattaacgagtggctaatggaagccctgaaagatcccaggaggtgaacattgcccgtttgcaggcatggaaactgaggttcagagaggttaagtctctagcccaatgtcacacagcaaacagctggaccaggtcaaacttagggacaagctaactccactagaaccccagcacatcagagtgtatcacagccaaccttcccatttcataggtatgaaaatgagcctctgagagggagggtgatgtttctctaggtcacttgggtccgaggcatgtgtttcttccctcctgcagcatggggtcagaaacagctgcattgttacaccggccggccctttaaaagcacctcctcactg

SEQ ID NO: 245280 - DNA, 434 bp, Homo sapiens
caagcagctccagggggtcctcccatgacaggaattcctgatgagaagaaaaggtgcagctctctctgacaagctggctcctctcctcagaaaaaagaaagaaacaaagagaagaggatgacattgaatgtatcagagaactaagaaacttctgccagcctgagcaacttctccagccagggcgacagagcaagaccatgtctcaaaaaaacaaacaaatgaaaaaagaaatttctggatgaggaggatgctagctctacattccacttcacaaccaggccctacatcagcctatatttgaataccatggcaattcactaccccacgatctgtgaggaaatttttccttacactaaacagattggtccagtttccacacttgggactgccagaaaaagcctatatatctaatataatttattataaatagatga

SEQ ID NO: 245281 - DNA, 443 bp, Homo sapiens
aagatgacagttccttcaaaattatccaagaaaatgatttccaacttagaatgccacacccagctaaactattaatcaattaggataaactaaggcattttcagataagaacccaaaggtttatcctttctcaggaggcgactaagattgtaggaaacaggagacccaccagagaagacaggcaaagggaatcccaaggatgatgatgaagctccagatgacaactaggcagcaggcctggagagcaaaagcagtcagactggagcaggaaggactccaaggagtgggtctccaaggggggtgggaaaaaaaggaatggatagataacctgatgtgactgggagtgcttgtaatttaccagtcctatccaagtgtgcagataggtcattaaaaaaaacaagaagtttttaaatggatcaatgattaactccaggaaaaaaaaa

SEQ ID NO: 245282 - DNA, 525 bp, Homo sapiens
gaggagaagacagatgggaaagaaattaaggagaaaggctttctggggcttggtgatcgattttgcagggctctcaacctttggaacacgtttgtagtcataatttcctctgaccctccttacacacctgtgaggcagaaggcattattctttccacttgacaaacgagggaagtggcaagtccccacacatctctgtgcctcaaagatcacactatggatctgtggcccaggtcactggatttagcctggcccttcctggagctcaggaaaaagaaattgtgctggacagatttgtggccatccttactcctgccatcttcctcgcttgggcccatgggcagttcctttctaagggaaacagctgggggaagctgattgacaggcatactgctgaggacaggagaaattgcttttagattcctggaccctctgcattcttaggctgtgaagagggtggaagtaggagggtgggagggcagagagaggattttcctcatctctgtaaagtggggagagagaattt

SEQ ID NO: 245283 - DNA, 568 bp, Homo sapiens
tcgttactatcttttggaaggttcataatatgttaatacagttattgagatgtgatgcctatcttgaaatttgtgtaatatcaaaagaaaagtaaaccaaatttccaaactataaaggacacttatagaaatagtcatgtctactaaataacatgtacctaatggtaatctcactgccctgtgtcagaataacttgagacattttctgaaatattatgaatttgttataaattagtgagatgaattcattcagcaaaaattgagtgcttgttatgtcaggcacgtaaccttgctcaaggacctcatagtctatagctgcattatccagtataaacagtcactagccacgtgtctactgagcatttgatagatggctagtccaaactgagatatgctgaaagtgtaaaatacaagatttcaaagacttaattttttttaaaagaatgtaagttatctcaattttttatattgttaatgttgagatgatattctggatattttgagtttaatcaaacattaaaatgaaattcacctgttttctttatactttaatgttactagacacttt

SEQ ID NO: 245284 - DNA, 267 bp, Homo sapiens
cagtttggactagccatctatcaaatgctcagtagacacgtggctagtgactgtttatactggataatgcagctatagactatgaggtccttgagcaaggttacgtgcctgacataacaagcacttaattttttttaaaagaatgtaagttatctcaattttttatattgttaatgttgagatgatattctggatattttgagtttaatcaaacattaaaatgaaattcacctgttttctttatactttaatgttactagacacttt

SEQ ID NO: 245285 - DNA, 510 bp, Homo sapiens
aaataaatttctattgttgaaaccacccagcctgtggtattttgcaatgacagtcctggcaaaataatacagtccttcagaggcacctattctttctgcctttaatttgctttggctttgttttatgtgtggccttgtttcatttgcttgtaaatgacttgagggcgacatccaggaaggagtatcttttcctgtgtccccacagggtgcagttcaatgccaggcacaaagtgcacagaatcagacctttgtcctcactgccagctttgtcgacctgctgacaagggtcagggggacccaagctgctatccacccagggtgcttttcaaaattcaagtcatggaaataatttagggagccacttgagtactttttggaaataatgagacagaagagcagataatagaaaatgccagcgtgtttctcaggcagtaaaagtgttacttcatgcaactttgtttgattttacatatttataaataaacagaataattacaaattatcctaaga

SEQ ID NO: 245286 - DNA, 601 bp, Homo sapiens
tttttttttttgagacagtctcactcctttgcccaggctggtgtgtagtgagtggcatgatctcggctcactgcaagctctgcctcccgggttcacgccattctcctgcctcagcctcccgagcagctgggactacaggcgccccccaccacgcccggctaattttttgtatttttagtagagacggggtttcactgtgttagccaggatggtctcgatctcctgacctcgcgatccgcccgcctcggcctcccaaagtgctgggattacaggcatgagccactgcgcccggcctgtacaactctttactagagaaaagtccactaacctcttgggcttctctccgcccatctgagaatgtgaaactgatacccaccttacaggacagctagaggtcttacagagatgctggctgtgagtgcacttagcacagaatctgacatgtagcaagcactcaaaacaatgtctgctgagtccacattttagaagcatcctgcactgacaggcaggaaaggggaggagctctggaacccccaacacccacaagcccaggcccaggacccccatcagtaaggtggtatctgtgctcttcatctctctc

SEQ ID NO: 245287 - DNA, 310 bp, Homo sapiens
cccctagagggcagcagagcctcacaggagtggggagaaagcccaaaacagaggttagtggggagtttcactcaaggagacacaaggaggcaatgcacacatttacggagaatgaagttaagctttgtgaaatgaaggaagtccgtaatacaaggagtagaaaagtctaaaatgtgaaccagacagcaaacacaaggctgggctaggaaagaaaagagtgaccagaagtcagtcacaggaaagcaaggcttgtctgctcagtgaatgttatgacccaagcaatcataataaacaggtaccatttcaccat

SEQ ID NO: 245288 - DNA, 420 bp, Homo sapiens
gggtactatcattgtgccccctcaatagggtcctcacacactcatctttattccgctcagctccggcagttggcagagagcagtgtgtcatgatgagacgttcctggaaagcctgattggccactcatttgtttccactgccacctccccaccccccagatggcaatggatattgccatgacaacataatgggatgcaatcacacctattgtggggcaggaatgttgactgcatgaaagagtgtgtgtggggccagggagaagatgagagaaacatagaccctcttgtgcccaggaagaaaggaagttaattcagaattgaggagcctgccttctgaattttaagttcccacctgatgcctatagaaactgtttattacttgccagctcacattattctcctactgtcacagtctttaaa

SEQ ID NO: 245289 - DNA, 208 bp, Homo sapiens
aactgtaaaatggtattagggcttatttcaataaatatatattaaattgtttaaagtgacccactttagcaagaattgtttgttactggttgctttcagatcagaagggagaaaagatggatgacctgccacggagccacctgtaagtggaagtgagcaagcaggaagtttttagtttatttaaaatatctgcccaaaaaaaagaaaa

SEQ ID NO: 245290 - DNA, 289 bp, Homo sapiens
tactaacacatacattaaaaaatacaaactttgaaggttgatataaaaataaatacaatttctaacatattctcacgttccaatgcgtcatcttgtaaaagccagagatatcactgttctaaactgctgctgccagggtaatctacctaaaaacccaaatctgatcatagtacatccccagttcaacccttcaatggcatcatatcccactggcacatgcctacttcatcaacttcctctcctgtaatctttatccttatatcctgtatttcagctttaccttttatct

SEQ ID NO: 245291 - DNA, 380 bp, Homo sapiens
ctcctgggcttaagaaatcgatcctcccacctcgcttcccaagtagctgggactgctgtcgcctaccaccatgaccagcttgttacttattttgttgctcaaattgttcccactttaggcactaggagctctttcacattggctcttgtatccctttgacatattgtcatccttgtggaggttttgagcaattctttactttctgtgactacaagatgctccagggatcctcttcctgtctttttccttgtcttttccacagcaccccagttactagcttaaaaatgacccacttctctctcccaggatgggagcattttgcatcacctagatatagtacctgtcctctcaaccctaggatttgactcacctgtccaatt

SEQ ID NO: 245292 - DNA, 331 bp, Homo sapiens
gaggagaaaaattgattttcaatattacatagttaatttgcagatgtaatttcagtgggaagaattgggaagagttccaaaatacaatgcctgaagcggaggtaatgaggattgatctcaggaataaaatatgtccagaagcatgttttaaaaagttaacccgtaacaggaatccatacaggaatccatacagggtaaagtattacttccatgaactaatcctcccatatggtcattgctgtttggtttgcaattgctgcattgccaatctcaatcattgagaggctggaggaggtttaggaagaaacagtgcattgatgtcaaaaaaagg

SEQ ID NO: 245293 - DNA, 235 bp, Homo sapiens
cccgccccctcccccttgtcggatgcccccagtccgcagggggcctgcgcgggcgcccgtctatcaagggctcgttcattctggatgggtgccgcggggttggggagggtgtagggggtgggggggggaggagaggtcggggtggggagtggggagggaccgaatgcggggacagcgcggggtggagaggagagaaaaagcaaaaagaggaacaataacaaaagaagaaaatata

SEQ ID NO: 245294 - DNA, 380 bp, Homo sapiens
ataaaaccaaaaaaaaaaaaaaaaaaaaaaaaaagcatttatcaaggatatttgtttagttgtatttttctaaacaaataaagggtggcatggagttatactgtacttacacggtgacaatgggttgccagccacaccccaaatagtttgcatttattattagtttattcaccagcttagtcctcctgtgaggaaatccaatctctaaaaatattcttccctgtcctcttcacactgggcacccctaccccacacagacaccactttgcttaggggagggagataagaattctgaattcactacagtgattgcttccagtggatggtcaatccagaattggagacaatcctgcatgaatgccacatttattaaaaaaaaa

SEQ ID NO: 245295 - DNA, 411 bp, Homo sapiens
ttttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcactcagtcctccagcctgggcaacatagcaagactcccaccccttaagaaaaaagaagagagaaaaaaata

SEQ ID NO: 245296 - DNA, 252 bp, Homo sapiens
atcctgtgcctctatgcaagagacataaagatattttcccattttgaagaaattatataataagaaaaataatgggaaggaacagtattaagcaacagctgatcattgctaacaagggcagacaagcaaagtctgtagggaatcaaagcaaagccaaaaggaagactagtagaaggtgaagctggatttctactaaacgaagaaagagcttgagctacatgtagaggagagaagaaacattgcatgaggtgt

SEQ ID NO: 245297 - DNA, 373 bp, Homo sapiens
attatatctcttctgcagactgctccaaaattactttactaaggggggctagtggtacaatctgattgggaagggagtgcgtaggggacttgtctggaagctgcatttgcatagcagacacttcattttatttgcagtgattgagggtgagtgttacagagtttaggaagaggtaagctaatgcccccgtataccactctttcagctgtcactgacctctaccggcttgcctatgatagtggtttccaacaaatttagctgctcttcaaaatcaccaagggagtaagatttttttaagtacttattttcagatctccctccagagccactgagtcagaatctcttgagtggagcttgggaacctagtgtttaa

SEQ ID NO: 245298 - DNA, 250 bp, Homo sapiens
tttggggcattcaggctgactgaattttagacccaattgacagtcatttttgcttgagtctttttgaaaatctttttagtattattaaaatggtttcttgccttaataaaatatacagaatatataatttaacatgtatttggctttgatagcacctcaggctcttgttcatcaattattgttttagtgatttataggtgtagctgttgcaaaaggaaggtggtcacacagcacatagctgccatgactt

SEQ ID NO: 245299 - DNA, 290 bp, Homo sapiens
tatcttacaggtcttgatataagaggcaccggacaacacaatgaatggtatctttggtaaactttttaaaaacaaaaaagtataggaatgtttcacatacagccattttcaagaaaaagtcaaaagcataatgttaaattttaggttggtgaaggtatttctacaaagagccaaataataaagtatatagcttccctgttatctgccttgatataggagaactatggaatctggaggggaaaaagcatgcatattccatttattttcaatgatctcattcaggctttccg

SEQ ID NO: 245300 - DNA, 529 bp, Homo sapiens
cacagcaaatcccaccacattccactcatcaaagcagtcacaggccagcttaggttccaagagttggaagaatcaatccacctcctctcaatgaaggattaatatttgtattcaatgagagaataaaatgatggcaccatcttggtaacaatgtagagtagcaggactgtggttgtgtgtcccaggctagaaatcatacattcaagcaagcaggaggatagtaaagtcaaggcctccaaggctgaaacacagtacagccactctacccaaccactgggtatctagaaaggctcactggtgagcagccaatctttccaaattaaaagtcctgataatgatcatcactttctaaatgagaggtcttgaggaagatgtgaatgggaaggaacagggtgccaaatttttcccaagggcttttaatttggttaatgtgactctacaaaagatgattgtatcactttcagacaattccggtagcaagtaagtaatttccttttactgctacagagttaatttgcgtgtgcagaaa

SEQ ID NO: 245301 - DNA, 453 bp, Homo sapiens
caatacagttatcaacttcaaaattgtaaactgatacatgactttaatctaccatccatattcaaattttgtcagatcagcttgtaatgtcctttatagcatttccccctccagttcaggatctactctataggagtcagccaactttgtttataaagaaaatgtaggcccggtgtggtggctcatgcctgtaatcccagcactttgggaggaaggctgaggcgggcagatcacttgaggtcaggagttcgagaccaacctggccaacatagtgaaactccatctctaataaaaatactaaaattagcggggtgtggtggcgggggcctgtaatctcaggtactcaggaagctgaggcaggagaatctcttgaacccgggaggtggaggttgcagtgagtcgagcctgggcgactgcactccagcctgggcgacagggtgagactccatctca

SEQ ID NO: 245302 - DNA, 212 bp, Homo sapiens
cggcacgagggttgactatggatttctgggaatgagggtgaccctcagtgtcaacagcaggtctaattggtggtactgctctgccaaaaatgtaccaccatattgtcaacttcaccaaaatgattgacatttacgtttgtatcatctggacttttacttttggttatggaatatttttaatgaggacattttgaaataaaacactgaagaga

SEQ ID NO: 245303 - DNA, 386 bp, Homo sapiens
cagacatacagaccaacagaatagtgttaagaatacagaaacaaattcatacacccacagcctgttgatttcccacaagcacgccacacctgttcaatgaggaaagaataatctcttcaacaaacggtgctggaataactggatttccacatgcaaaagaatgaagttgcactcctatccaatacatataaaattaactcgaaattaaaagctaaatgtaagggctaaaaccgtaatactctcaggaaaaaaacaacaggaacataccttcacaaccttgaatttaaattcttatatacgacaacaaaagcacatgcaacagaagaaaaaatacagaaatcagatttaatcaaaactaaaaacttttcagccaggtgcagtggttc

SEQ ID NO: 245304 - DNA, 503 bp, Homo sapiens
ctactactactaaattcgcggccgcgtcgacgaaagaataaacatacacaaacttaaagagataatgataatattatagaaatatctaagtcctggctcaacccatgaaatagctatgtgttggaacttccttaaatgaacaggtgtgtgagtgtgtgagagtgtgtgtgtttgtgtgtgtgaattctgatttgagaacagataaaattaaaactctacagctgggcatggtggctcatgccagcattttgggaggcaggggttggaggatcgcttgagcccaggagtttgggaccagcctgggcaatatagcaagatcccctctctacagaaacaaacaaacaaacaacaagaccctttatgttacctcctagaggtaggagtcaaggaagagaggcaccttaaaagttgaacaggaaagagagcaatacatttttattaaaaaattgtttggcatagcaaggattcaagaccctgtctctaaaaaaaaaaaagtagacgcg

SEQ ID NO: 245305 - DNA, 479 bp, Homo sapiens
cgcgggcagaaggaggcggtagccctggtccctgaaaaccaggccctgctgacaaatctcagacgccaggaacagaagaaccaggaaaaatgcctgacagcttgagccagatggacggactgttggaacacctgagggtgaagctgcgcgaactcctcaaagaggaacagcaaagcagccaccaagatggaccagaaagatgaacaaagaaaattagcagaaatcaaaggcagatgctaaagcagtacaaaaccgttcacacaacgatagagacggaattgatgaagaagtctgataaatgaatgacagagtgaaaggacagcagtgaccatggtaaggtgctgacgattctggtccactggatcccatcatccctaggacagtaaatctcatcgcagtcgccactcagcaagttaccactgcagcatttcctgtttgttccaaaatgaataaaggtgattctcatcacaagggcaaat

SEQ ID NO: 245306 - DNA, 380 bp, Homo sapiens
gtaagtgagctaattttttacttatatatctgaccccttagtatatatcatagcctttcaagggcaggaatagagtctccatccttacttcccagcacagtacaaaatagtaggtatttgtggaatgagtttactgaaacaaaagagagaggtcattaatttggtcactgtagaatgaactttaggaggtcatctttatcatttattgccccttttctcttcagttgtgatttcagttcctaaagaaaaataagagaccgtggctgggtacagtggctcacacctgtaatcccagcactttgagaggccaaggtgggaggaccacttgaggcccaggaatttgagaccagactgggcagcaaagagaccctgtccctaca

SEQ ID NO: 245307 - DNA, 173 bp, Homo sapiens
taccaggcacaggcacagacgcacacaaagacgaccagagaggctcccgggctccactctcatggagctggtccaatccacacacaatgggtactagcaacctcaaattttaaagtttgtttaaagcatgttacctataaaaataaagggcttttaagagccgtaagtggaaa

SEQ ID NO: 245308 - DNA, 182 bp, Homo sapiens
ttgcacatgattattctaactctattacatgctacttatttaaaagtaaaaatgtcagccgagcgcagaggctcacgccgatatcccagccctttgggaggctgaggtgggtggatcatttgaggtcaggagttcaagatcagcctggccaaaatgttgaaaccctgtctctactaaaaata

SEQ ID NO: 245309 - DNA, 368 bp, Homo sapiens
ttgttctaaaactatcaaaaaccagaatcatccaaggcatgatctgaactggactcaacctgaagaaaaccagttctctaccttggcttccctcatattagggaaaattctcatggattaaagagggcaggcagactggggggaataataaccgtaaatgtttaattacagaatatgattaactggctacgtgtgtgcttcagtgagcattcagagcgttaacaaaagtaagacacaagaattcttggaggccggacacagtggtcacacctataatcccagcactctgggaggccaaggcgggtggaccacttgagctcaggggttcgagaccagcctaggcaacatggcaaagccctgtctctaca

SEQ ID NO: 245310 - DNA, 248 bp, Homo sapiens
gtattttaagaggtgagtccttctatgaatatcttgaccttgaggtttacaaaggacttccagaccatggggtttgctttttatcaagtcgtactgtttacataaagaagtgcagaacctggctgggcacaatggctcatgcctgtaatcccagcactttgggaggccgaaggtggatcacttgaggtcaggagtttgagaccagcctggccaacatggtaaaaccccgtatcaactaaaatgcaaaa

SEQ ID NO: 245311 - DNA, 475 bp, Homo sapiens
ccaatggaatggtgctaaaccattcataagggatctgctcccacgatccagtcaactcctgctgggccccatctccaacactgggaaccacatttcaacatgagattgggaggagacgaacatccaaaccgtattatgtcaatagtggttgctaaaggctgggaagagcaggggggaaggagaggagcagaggttggttaatgaggtacaaagttacagttagataggaggaattaattttggtgttctgtgcaatagggtgatgatatttagcaatatgcgttgtatacttcaaaatagctagaagagaggactttgaatgttcttatcacaaagaaatggcgtgtttgaggtgatgaatatgctgattaccctgatttgacattacacattgtatatatgtcttgaaatatcatactgtaccccataaatacatacaattattatatgtcaattaaaaacaaaataaacgtta

SEQ ID NO: 245312 - DNA, 1247 bp, Homo sapiens
ctaacttttataaacactttatctaggatagctttcttttagcctttagtgtggtataattactaagccaaaaggttagcagatttaattttcgttatcaattagttgtttaagctttttatttgccctttatagtctttttcctttttttttttgaaacagagtcttgctctgttgtccagactgtagtgcagtggtgtgatctcagctcgctgcagcttctgcctcccaggttcaagcctcccttgtgcttcagccttttgagtagctgggatcacaggcgtgtactaccatgcctagctaatttttatatttttagtatagatgagggttcaccatgttggccaggctggtcttgaattcctggcttcaagggatctgcctgccatggtctcccaatgtgctggcattacaggcatgatcttacagtctttaaaaagaggcagtaaaaatgttgaaatcttttttagaaacttctgcacatcaatagacatcgttggatgagactaattgaggattcctcactttcaaatgtactgaattacctttagtaagattttgctatctctttaagtgtttgctgcttccagggcttaatatttatacatgtataggtaggcatagccggaaggtggagtactcagttcttcagaaattaaggatctcatctatttggctttggctcttggatcaccttgatcaatttaaacagtgatttttccctacgtaagggtgaaagaaaaagaaacaaatggggtagaacacaaaaattcctctgaatttccaaaagccaaagcttgcatccccggcagtgttgccatttactaccagtttctgtctgacccagtcagacatctgaggcctctaactggatccaggccagttaatgattagatccaattctgtcctggacccagtccagtttctgtcacaacttccaaattcagttcagataaaaaaaattgctcaaactcagatagctcaaaacatacatccatggagctttggaatcctagagagaagcaccccatttgctgcgagagagcagtagacacaatggatcctgtgggtacctcacttggccgcttgtttctgggggttgctgggagctcgactttggatcgcacttctgacaccatctgttaagggaaaacttgagacaaatttaacagagtttatttgagcaaagaatgatttaagagttgggcagcccctgaaccagaatagattcagagccactctggtgt

SEQ ID NO: 245313 - DNA, 400 bp, Homo sapiens
cctgggcgacagagtgagactccatctcaaaaaaaaccaaagtgaccaataaacatatgaaaagatcttaatattattatagtttttcatctaggaaatagatattaaaaccacactgagggccgggagcggtggctcacgcctgtaatcccagcactttgggaggctgaggcaggcagatctcttgaggccacgagttcaagaacagcctggccaatacagcaaaaccccacctctactaaaaatacaaaaattagctgagcatggtggcatactcctgtaatcctagctactcaggaggctgaagcactagaatcactggaacccgggaggtggaggttgcagcgagccaagatcacaccactgcactccagcccggatcacagaccaagactgtttc

SEQ ID NO: 245314 - DNA, 226 bp, Homo sapiens
agatgcagctgctgtgctttagaatgtgctccggctgatcttaccttcatgccttctttctttctacctgagactacacgaatataaagcacagctccaagctaaactgttacttggaaatgaagcccagtaaatactaccctctccctcaaaatcctagggtgggaacatgtcatatacattgaagaggggggaatagaatgctcataaaaagatctctgtatgt

SEQ ID NO: 245315 - DNA, 590 bp, Homo sapiens
agttaaagttactattttagcaagactaaacttttagcatgtattttgatttatgttttcaggtgatttatagtttttaaaaatgttagtatttattttttcgaataaatcacaagtctggaccagtcactcctgttttacagacagaaacactcagggaatttttatgatcagtatctggtgcttggaagacactcctgtgtctggatgtccactgaccacataactattaaatgctttttggcaaatgggaagattggaattcaaagttgtgcgtctattttctggtgcatatagccacaaacagagacaagtctttacaggtaacgattgttcaagttagaattgtatttcaggctcttgagctccgttgtctttttcatgatgttagaaataaatactatgatattatgtttaccaatatagtatgagtaactacagatctatcaccgtggagtgcccttttggtagtcacatttggtaaagtcatatgtctcttcagcaccactgttggaagttagatacagcaaactgaaccctgagagaatatatttctttcacattaccttcattggcattttccccgtagg

SEQ ID NO: 245316 - DNA, 371 bp, Homo sapiens
gatttttgctcagagtaagaatgcatggtcatctcaactctaaatgccccacagttgctaatgatgtatttcatggagggtccccatccctaaaagcaataattaattaactatacaagtgactaattaataagtcttcacaaaagatgctgtgaacagaatccatataaactctgactgctataggcattatggcaggttacattatttcaaactttactatgtgccaggcatggtggtaaataattgacaaccattatctcattagatcttccccaaatgcccatgaaagagggactgttatctctgtttttcagataaggaatctgagaattagaaagattaagtaattttcacaaaatcacagagat

SEQ ID NO: 245317 - DNA, 246 bp, Homo sapiens
aacgtgggtctattttctgggatttgtattctggtccattgacctatttgtcttttactaataccacaacatcttgattactgtaactttacagtaagtcttgaagtgggatattgtcattcctcaaacaatattccacttcttcaacagtgtgttgactattctaggtcttttgtctctccatgtgcattttagagttagtttgttgatatccattaaaaaagccttcttaaatttttactggga

SEQ ID NO: 245318 - DNA, 450 bp, Homo sapiens
gctgttgagattttttcattgagagccctcaccagcatatggagggaaacacagtgttcttctcaatatctcccagtgattcttggagtgactcaggtttcccacagacatctccaatctgaatgccagtttttgctgaatcctacagcttttctgcactttgccttctgtgtctaccaccccctttctgtgctgggccactccactgggcacaaccccaatgtctttcttccccagaatcctcatgaccgaaggctctggaggcagtaagtgcttcccgaaagtttgagacaatgacctcacagctcagcaaaaaaacttaaaaggaaacattagacattattcttaaaagcatttcttggcccagcgtggtggctcactcctgtaattccaggattttggaggctgagcccaagagctggagacccagtgtgggtaacatggcaaaaa

SEQ ID NO: 245319 - DNA, 114 bp, Homo sapiens
aactagatattgaaggaacatacttcaaaattataaaattcccattttattgtgacagaaactgaggcagagagcatttaagtgtctcattacacaggatagtggatggattgg

SEQ ID NO: 245320 - DNA, 148 bp, Homo sapiens
tatcaaaagacaatgctttagatatctgttcttacaggacagtgaagtattagaaaatcatgggaaaaagaaaaccaccggcaaatatttttccattttaaaatgccactgactttaagacatgctagttttgagaaaaaaaagaaaa

SEQ ID NO: 245321 - DNA, 446 bp, Homo sapiens
cgaggagtcgccccccatcgcgcacagcagctaaggttgtgcactgcatcagggcgcgcggctgacggagcaaggggcaaactgaaatccaattctcgctccattcgccaagttgtgagcctcggagtgggaacagcggacaccacagagtcaggtgtcccctgtgcccgtgtggacagagtggggatcctcagctactcaccaaagctttgttcaatgcccactttctgctgacccctcgctggatgatcctggagactcagtaatgatgagaccatcctgcgccatgcattcatggggctcccagtctaactgggagactgacacaagagtgacccacgcctgttgtcccagctactcgggaggctgaggtcggaggattgcttgagcccaggagttcgaggctgcagtgagctatgcctgggagagagtgagaccctatctct

SEQ ID NO: 245322 - DNA, 551 bp, Homo sapiens
gagagcattccaagaaagccctacagaagctccaaggcttcacctaagctagcctctatagtcactcaaccacacttctattgcactgtctctgttgcgggctaaggtcagggccagcccagattcaatggaaggggactacaaagagcatgcatgaatacaggattcttgattcatcagtgaggagggggaagatcttttggaggcaacacatcagactcttgctcatctttttctgccccttcagatatgtcaaagagaagaggaagtgtgtcatgtgaagactaaagaaacttttagatctgctacatctgggttcacagcctgactccatcaatgaccagccacgttatatatatatttttccctgatactatctctctaagggaattgacaatacctgctgatattgtagggttattgtgagaattaaaaataaaatgggaacagcttttgctgtaaagtagaccgtgggcaaatggtggttattgttcacattattttcaaaatctaagaaataaaaacttatttaacatgagaaaaaaaaaaaa

SEQ ID NO: 245323 - DNA, 587 bp, Homo sapiens
tgtttttgagtttttattatggaacattctaaatatacacaaaagtagaacagaataaaaaaacccatctacccatcacccatcatcaataccaacactaagacaagcttctttcctgtgtactcccatatatgcttcccatcccccatggattaaagtatgaagcaaagtccgatcatatcattcattagtaaattatttagtatgcatataccaaaagatttttaaaaactataaccacaataccattttcaaaaacaattctttaacttctaatattcagtcagttttaaaatttctccaattgtctcataaatgtgtttgtggttagctttgatcaaattaggatccaaacaaggtctatacattgcaattaaaccgataaatatctttaaattcattttactctacaggttttcctgcccttctttccttaaaaattttttttccttagatcatttgtcttatagaatttcagtgtggatttttgctacttgtgctcctgtggtgatttaacaatgttcccctatatcttaaatttctaataaactactcatcagatctagaaacttgatgagagtctagag

SEQ ID NO: 245324 - DNA, 479 bp, Homo sapiens
tgtagcagatttactatttattttttatttttttagatttactatttataaatgacttctaattattcacatcttggggaaaataatgtcatgcatactaagaaaatctgaaattctttagcattacatacttgactaataagttaaaaaaacattaatttttgattatgtcaatcaactttacaagacgtgaaataatcattacttagtctaggaacattgaggtggaacaggaaggcagcaattgaaatgagctttgtttgagtcatgctaagtgtgaaagtccattaggcactaatgtagagatgcagacaatatgatgtttcattctggagtttcggagaaaaagctcacctgccgatattgatttgtggtttcttggcctagaggttgtatttaaagccatgagaatatttgacatcatcaaggaaatgagtgaagacagaaaaccagtccaaagatcacccaagggtcttcca

SEQ ID NO: 245325 - DNA, 441 bp, Homo sapiens
tctttttggaaacagggtcattgcaactatagttagttaagatgaggccatgctggagtaggctgggcccctaatccaacatgactggtgttcttttaagaagaaatgatttggacacagataccacacaggggagaacaccatatgaagataaaggcaacaatgggaatgatgcctttgcaaaccaagtatgccaaagatcaccagcaaaccaccagaaatagaaaggcatgaaatagagtccctctcattgttttgagaaggcaccaccaccctgtggatggcttcatcttgggcatctggactgtaagacaatgtggttctgttgtttgagtcacccagtctgtggtactttggtacagcagccccagcaaatgaatacactgagaaatgtaacaattgaaaaataaatttttagaaatacgtttgtccttaaaaaaa

SEQ ID NO: 245326 - DNA, 230 bp, Homo sapiens
cagccaacatccagcacccaccactagacatgtgagtgaaactatcgttggacttttcacctcagctcacctgctagcagaatgtagctgcatgaataagcccaggggaaaccagcagagggacctcccagctaacccacagaatcatgagaaataacacattgttattttagttatgttttggggtaattcgttacctagcaatatttaactgaacagaggccttaact

SEQ ID NO: 245327 - DNA, 500 bp, Homo sapiens
aactcctccactccacagcagggcagccttctgacgttccctattagagcctgggaagttcctccaaggaatatctgcctatgcattgccattacaggatgaggctgtttgtgaactcatcccataagaagcagcacaaagcaaagcattcaaccaaagaaactcttcctataaccttctcacttgaaaactgtgataaaataaaatgtttttcttcgatgatttaaagcctagcaaaagtctttagaataaacagacctcaggtctcataaggacccctaaacaaagaccagccctcgtcacaccaggtcacagctgctaagtcccccttgtattcctgtgctgaagtaacaggagtttagtgtgaacatcagaaaggtattttgggggttacagacacagcacaaggaattaagaaataaagagcagcagagacactccttggcaaagaaaaggaagagagcactaaaggttcaaaggaaaaaaaacctatgcggccg

SEQ ID NO: 245328 - DNA, 701 bp, Homo sapiens
gaaacgcacactgcaaagtctaccacttgtgtgattcattcctcattcagattacctaattcctaatctgcttaatttcccaaacagtgaaaccggaggacaggccatgaactttcacgtacaagtctttacattggcatacgcttgggtatcctgggtaagtatcaagaaatggaatggcctagtggtacagaacgtatatctttaacttcttaactaactttttcaattttttttttttttggagatggagtctcgctctgtggccaggctagagtacagtggtgcgatctcagctcactgcaacccccacctcccggcttcaaccgattctcctgcctcagcttcctgagtagctgcgatgacaggcatgtgcaaccacacctagctattttttttatttttagtagagacggggtttcaccatgttggccaggatggtctccatctcttgatctcgtgatctgcccgacttggcctcccaaaggtgctgggattacaggcatgagccactgcgcctggccttcaactgtttttaaataattggaccttttacattcctgccaccagtgtgtacgagctcagtagctccactttcttaccaatcacaatatggccagtctttttaattttagcctttctagtagattttattagtatctcattgtggttttcatttccatttccctaataactaataa

SEQ ID NO: 245329 - DNA, 438 bp, Homo sapiens
tctttaaaagttgtaaataaaacctaaaactaagaagcaaaattggaaccaaatgcctgcagaagctctgtagagaggacaatttgaaaaacactgttatttcatgatgactttgtgtataagacaacagtattgaatgccagttaggttggctggaggcttgtctgggttgtattatttatatggctctaaaatgaagttgagctaagatatataaatggggcaactggttttcctaatcaggatcatgtctgtgtttccatgtttgtttcacaacagtacgagggctaaaccatttgaatttgacaactacatgccattaaatgtattctgaatgtagtatatgagccagttcctctcaatattttcactgaataacaacatcaagacatttagctgacaaatgtttttctttctaataaaccctaatagtatttg

SEQ ID NO: 245330 - DNA, 450 bp, Homo sapiens
ggctgggcacagtggctcacacctgtaatcccagaactttgggaggccaaggcaggtggatcatgaggtcaggagtttgagaccaccctggctaacatggtgaaacctcgtctctactaaaaatacaaaaattagccaggtgtggtggtgtgtgcctgtaatctcagctactcgggaggctgaggcaggagaatcacttgaacctgggaggcggaggttgcagtgagccaagatcatgccactgcactccagcctgagcgacagagcaagactccgtcttgaaaaaaaataaaaataaaaaaatataaaatttttattttttagagatggggtcttgctaagttgcccagcccaatcccattactcaacatctttttggggaactgagagttcagaaggacaagtaaaaagctaataccctctccttgtaaatgccaaaaagcccaataa

SEQ ID NO: 245331 - DNA, 541 bp, Homo sapiens
taaattcgcggccgcgtcgaccaagctgtggaatcaagacaactttggctgagtcccattttatataggactaaaggagagtgcagtcctcaaaggcaataatatttatgagaacaaagaagactgtggagaaattttaggcagtagaagagagcagaaaggccaagaggatcagggttgaagtaagctatatagcaaatcaggcattgcccagttacctgggaattacattcaggcaaagcagaaatacctgaagctagttgcttatacaaccaaatattgagaagtaaagatattttcatctagaacaatcctaaaaatcactcttgtttctaaaaggccaaaggtagtgggcaggtatacaaagaaagggatatttatgagagagggcctgacatttaatctatttatgtaagtgacatcaatacatattgtcaagcctggatatgacataattaatcattaatacaacctaattgcagaagttctttttaaaaatagagttatgtctcagaataaagaaagatccctagctccaaca

SEQ ID NO: 245332 - DNA, 383 bp, Homo sapiens
ttatccctttatcttcaactcccttcaaatcatcagtattataggcaagttaagtttctattgtatgtattcgttttgtgcagctttatgtaacaaaactggtgtgtgtgtgtgtgtgtttgtgcatataaaagcacaaggtaccaccagagcacaaaggagaagcaactaagaggatactggaacatgagggaaaggttcatgaaaaataattaaggatatataagggttattctgataaggacagccgatagagaacagagaacaattctggggatggaagagcatatgcaaattaggtacaaaggctcaattaatacagcatgatttgcaagctattcactgtggctgaaatacggatgttgcatacatgtatgcattaa

SEQ ID NO: 245333 - DNA, 1279 bp, Homo sapiens
cactgactctggttagctgaatacccgatgttgacagtttctccctccctctctctctctgctgtttcctctatagagctaagtctggtttgcattgaaataagcatgcagtaatatgccttttgccttaccaacttgtatttgcacacaggcagcacagattcaccatttcacttcctaccatgaactaaaagaattgtatctcttcaacaaacaccactttatttttaaccttttttttttattgtggtaaaatgtatactacataaaatgtgccagtgtaaccattttaaaacatacaattcagcggcattaagtacattcacagtactatgcaaccataaacactatttccaaatctttttaatgactccaatctgaaactctatatccattaaacaataactcagattccctgtcccccaaacctgtggtaatctcaagtctactttctgtctctatgaatttgcctactctagatatttcacataaatacaatcacactgtgtttgtcttttcgtgtctggcttatttcactcagcatgttgtcaaggttcattcatgttgtagcatgtatcagtacttcattcttgtttctgccagaataatattccatggcatggtcataccacattttgcttatccatttatttgttgaacacttgagttgcttctgcctgttggataaagtaagtaatgttgttctgaacattggcatacagtgtttgtcaatatacaaacattggcatataatgtttgagtccctgctttcaattcttttgggatatatacccaggagtagctttctgggtcatatggtaattttttgtttaacttattgaggagctgccaagctgttttccacagcagctgcaccattttacattcctaccagccagcaatcacctttaaacatgaaaaacatgaaaggttttaaatgatatttcccaattttctaagtaaacatatgaattatagaatcattgggaagcataagagaaaaaagaagaaatacctactcataatcccaactgtgtaaaggtaataactattaacattctatttttatttatttatttatttgtattaaaaaaattaagacagggtctcactatgttgcccaagctggtctcaaactcctgggatcaagctgttgtctcacctcagctacttgggaggctgaggcaggagaatggcgtgaacccgggaggcagagcttgcagtgagccgagatcgcaccactgcactccagcctgggcgacagagcgagactgtgtct

SEQ ID NO: 245334 - DNA, 537 bp, Homo sapiens
tttctgttgttacaagattgtttaaaagaagaaacttaataactgttaactctttcagcacttatgtttatttcataaatcatgttttcagacaaatttctctcaaaatggttggtgggggaggaatgtacactaatcagaattactaagacagacaaaagtggttgcagcactgctttagttgctcctttgagttttgttaccatcataactgttcaaaacgaagctttactttctttacatccatgtttttctttttaaaaatcattacattcacgcctgtaatcccagcactttgggaggctgaggctggtggatcatgaggtcaggaattcaagaccagcctggccgatatggtggaaccccgtctccactaaaaatacaaaattagccaggtgtggtggcacatgcctgtaatctcagctactcgggaggctgaggcaggagaattgcttgaacccaggaggcagaggttgcagtgagccaagtcgtgtcactgcactccagcctgggcaacagagcaagtctctatcctaa

SEQ ID NO: 245335 - DNA, 897 bp, Homo sapiens
cactattatgatcttcctcgttttgaggttaaagtcggtgtttcctttctctgggtgtgagaatcgaccatgatgctgtcacagccaagacatttcctctcaaaccacggtgagcgcagaggtttcacaagaaattttccttcccgtccatcatgttcttgggcttgaacgaaaggttatttgtagttggaaagtctgaacgacatcatcagacacgttgtcttaggttgtgtgggaagaaaagaatcagtttaaacgaggcttacaatttcggttgcatttcaaatgggattgctttaaaaatgccaagcacataagaagagcctgtgcctagaaactcaaagagagtggatgctgactgcgtgtccagtccactcccggggcacagagcaggcactcgagcgatggttgtcgaatgaacaaccaaatgggtgaatgcgtgagtgggtgagcaacacattctgaagtgaccggaatgttctggaactgatcaccatcttctgctaatgctgactcatgttctgactttgaaccgttcattaggcgagagctaactaccttgagaggctcctggtgatcgtaactcttgctgaatggggaccaagaggcacttcagtgtaattagttccagttccatgacccaaagaggcctgagcggcagcacgtttccaacacatggcctgctccaggtcttgaagaaatagacacaggcaccactaacgctttggctgatagattatgccagcaatcaggctctgtggaggatctggtgcacagggaagataacgtgtttaatctgtctcatgccccttcttgagccaatcactgtcagggggatggggaccttagagatgatggggattcatagctgggtgtgaggatggggactcttcccct

SEQ ID NO: 245336 - DNA, 508 bp, Homo sapiens
gcacgagaaaaaaaaaaaaaaaccatcaggagccatggctcatgcctgtaatcccagcactttgcaaggcctagaggccaagacaggaggatcacttgagcccaagaatttgagaccagtctgggcaacacagggagaccccatttctacaaaaaatcagaaaaaaattagccaggcttggtggtacatgcctgtggtcccagctacttgggaggctgagatcacttgagcccaagaggttgaggctgcagtgagccatgatggtgccactgcactccaacctgggtgacagagcaagaccctgtctcaaaaaaaaaaagaaaactcctttcattgaagacataaaccacaatgggaagtacttagttctgaaagccagggcataggacctaggctcttgttcaaaatttcctgcagaacagctctatcatgtaattcttctttattctatttttcttttttgggagtgaacagagccatctgctatagtgtgtttgttaaaaaaaaa

SEQ ID NO: 245337 - DNA, 369 bp, Homo sapiens
tgctgatcttctcatcctagaggtctcactgcctctgtgtcctgaagcagacataccctaggccttctgagataaacacacaatctcctgcctgctctacatcaggcagtctgaaggcagagaggacctgcagatacttgaaagaaacagctcatctgctttgggaaccagggaaattcatgccacacttccaggatcactggtctcaggaggatttaactcaagcttggagtaagagttgacatccacaatgtcatcatcatctaattctgtttcctctttccctgccttcctttgtcctagaagcattctgtgatgactaacaaactgatttattctgattaaaaatagtagctatcattattcaaa

SEQ ID NO: 245338 - DNA, 451 bp, Homo sapiens
cttttggggttgtggatccctttgagaatctggtgaaagctatgaagaccttccagaaggatgcacatactatacatgccattttgcatacagtctctgggtatatcgacctgtcaatgtccattgaccacccccaccccccagttaagaattacccacttctggctgggcgtggtggctcaagcctgtaatcccagcactttgggaggccgaggctggtggatcacctgaggttaggagttcaagaccagcctggccaacatggtgaaaccccttctctactaaaaatacgaaaattagccggacatggtggcatgtgcatgtaatctcagctacttgggaggctgaggcaggagaatggcttgaacccgggaagtggaggttgcagtgagccaagatcatgctactgcacttcagcctgggcgacagagtgagactctgtctcaccaaa

SEQ ID NO: 245339 - DNA, 440 bp, Homo sapiens
tgatagataatgtatagttgagaaatgttaagtttctgtgagtcacctgaactctgcttgctctaaatttcttctgaatcctgaaaggccccaaatttgattggtgaatacagagggcttcaatagtgagtcctgataccagttcttgatggattatctctttactataatcacctatgctcacagcgggctatgggttttccttgtgaaatttattatgttggcgcaaaagtaattgtgatttttgccatttttccaccaacctaataaaactcccatttagcagaagctgttgatgaagaaattatctagaactccacgagtctatcaactattttgtttccaaatgagggaagtgttgtaaaggcattaggatgttggtatgatgtacagatatttaaagggtctgataaaataaaggatgtttttctaagcatatg

SEQ ID NO: 245340 - DNA, 604 bp, Homo sapiens
ctactactactaaattcgcggccgcgtcgacatttgataaaatttgagtaagtgcattttagattccaagataaacataatagatttaatgcacgtgcttatttctatacccttaggaaaccccaaggaaatgagagtaaaggaatacaagaaattgtataaaaccacaggacaaaaagaatgagaaaataggcagagtccaagaacactggcagccaagcgtcttcattccaatctgtaccctagaagtaggaggctggtgaaaatgatttttctgagagaaatatttttttctagaaaaaaatatgtacagatattgacctttggggaccactaatgatataattaactctgcttaattattcacctatggtaacatctgtaattattcacctatggtaacatatgttgggtgttgacaaagccacactcaataagaattctattctgcctttaaattttaatgaattattattattattattattattatttgagacagagtctcactctgttgcccaggctggagtgaagtgagccaagatcacgctactctactccagcctgggcagcagaccgtgactctgtctaaaattaaaaaaaa

SEQ ID NO: 245341 - DNA, 388 bp, Homo sapiens
gactttgactttggtgaggtgtcagtaaaatggtggaaaccaaaagcaagattatacttgcttaaaaaattaatgaaagacagtaaataaccttttcaaaaaatgtgtcaggccaggtgcagtggcttgtacctgtaatgctagcacttagtagggaggctgaggcaggcagactgctgagcccaggcattcaagaccagcctgagcaacatggcaaaaacctgtctctacaaaaaattagcaggtgtggtggcattcaactgtagccttagctactcaggaggcagaggtggaagaatcacctgagcccaagaagttgagcctccagggagccgtgatcatgccactgcactccagcattggcaatggattgagaccctgtctcaag

SEQ ID NO: 245342 - DNA, 320 bp, Homo sapiens
tctaagttagtcatgtgtagagactactgacaatgctaaaatcattcactgggcagattgaaatgcattttgtggatgttttctctcttagaaaaataattgttatcatttgaatttttttctgcgtcttagaaatatttttctccttgtgttcctgtatgattggtttggtgcacatcttcacttaactctccacgattctctcaggttctgatgatatgagagactgactccaatacctctgtgtccctaggagattgtaattgaaatgcgagctcttagcattttctctgttttgagcttaaaactgaagaactaaa

SEQ ID NO: 245343 - DNA, 403 bp, Homo sapiens
catacggtcggaggacttgaatgcccagtgacgtttggtgacaatctgaagccaccaaggggccacactctgagtcagaaaggacctcaggaaaggagttcaaacgcccaactgatgcaagaatccctctgcaacatccacgactgccagactcctgtttaaaactttctgacagcttcccacgctcacagggcaaagttcaaactccttgacgtgcttcaggaggccttgcgcagtctggcctctacttacatctccaattttgtttttaagtattcatcaatttgcttactaattcctttatcaacccatgcatcaaatatttagtgagtgcttacagtgtaccaggcactattttgggaattgaaaatacacaacaataaatgaaacagacaaaatcctc

SEQ ID NO: 245344 - DNA, 470 bp, Homo sapiens
aaaacttagctgtgtgtggtggtgcatgcctgtaatcccagctactcaggagactgaaggaggagactcgcttgaacccaggtggcagaggttgtggtgagccaagattgtgccattgtactccagcttgggcaacaagaacaaaactccgtctgaaaaaaaaaagccataattaagacttttcttagcaagtcatctccctcatcttccccgcaccttgctgaaccggcatctgacctacttggggccgggcccaagctggtattgggtgggcccagcaggctgggttgacccacccatctccaggggtcacagccttcagccggagccacccaccgcaggccaggcaggccggtttccaaaccatagaggagaagagggatcctggccacaccaagagcaggagccaaggttgtctcctggagaggagcgcacgggaggcagcgccaagccagggcacacacagtctc

SEQ ID NO: 245345 - DNA, 582 bp, Homo sapiens
gactatgcgttactgactctcttactaaccagcgctacagcctgatcataagtcatgctagggcaaggactgccctcctgggaaatttgaagaccttctggccaatgaatgaggtgtaatttctcagaataattttactctctgatgaaaggagggaataaggtaacgagatgttccctccctcccttctcacattggaccttgtgtgaggacgggacactggagctgctgtggccacctggaccaagagaatcaaggaggagctgacccaaaccctgatgctgcaaagccattggccagcgctggcattgtccgcctctggagtccttgttacaagagaattataaactcctgttgttgagactttgagaccccatggcggagacggagggtccttccactgcagcacaaagtggggcacttgcagtcacatcgcctgtgttcacggtggagcggatctactgcccttgtagggctgatgcattgcaaggggctgaacctcctgcactgtctcctcttggtgtaaataaacgggttaccgagcaggctctttttctttatttctcaacatatcacagaact

SEQ ID NO: 245346 - DNA, 510 bp, Homo sapiens
  misc_feature (23)..(23): n is a, c, g, or t
  misc_feature (33)..(33): n is a, c, g, or t
gctgaaggtgacttgactctctnctttaacgancgaaccaggtgtaatttctcagaataattttactctctgatgaaaggagggaataaggtaacgagatgttccctccctcccttctcacattggaccttgtgtgaggacgggacactggagctgctgtggccacctggaccaagagaatcaaggaggagctgacccaaaccctgatgctgcaaagccattggccagcgctggcattgtccgcctctggagtccttgttacaagagaattataaactcctgttgttgagactttgagaccccatggcggagacggagggtccttccactgcagcacaaagtggggcacttgcagtcacatcgcctgtgttcacggtggagcggatctactgcccttgtagggctgatgcattgcaaggggctgaacctcctgcactgtctcctcttggtgtaaataaacgggttaccgagcaggctctttttctttatttctcaacatatcacagaact

SEQ ID NO: 245347 - DNA, 262 bp, Homo sapiens
gcttgataattgccgggcgtactgttgtctcccacactcgggttaatttcataccaacagcggataggttggtccttccactgcagcacaaagtggggcacttgcagtcacatcgcctgtgttcacggtggagcggatctactgcccttgtagggctgatgcattgcaaggggctgaacctcctgcactgtctcctcttggtgtaaataaacgggttaccgagcaggctctttttctttatttctcaacatatcacagaact

SEQ ID NO: 245348 - DNA, 185 bp, Homo sapiens
agaccccatggcggagacggagggtccttccactgcagcacaaagtggggcacttgcagtcacatcgcctgtgttcacggtggagcggatctactgcccttgtagggctgatgcattgcaaggggctgaacctcctgcactgtctcctcttggtgtaaataaacactgtgccacctgagcctgat

SEQ ID NO: 245349 - DNA, 201 bp, Homo sapiens
aatggtcctcatacacacccagctttctgcctttcagaccccatggcggagacggagggtccttccactgcagcacaaagtggggcacttgcagtcacatcgcctgtgttcacggtggagcggatctactgcccttgtagggctgatgcattgcaaggggctgaacctcctgcactgtctcctcttggtgtaaataaacac

SEQ ID NO: 245350 - DNA, 215 bp, Homo sapiens
ctgtagaggtcgttttgacttgctctgacttcgcgcggttctcgcggcttccccggttcccgggttctgcacagcgcggctattaaagtgcatggagaagtgcagtccttgccccgcatcccgcagggaaatctcattttaaaagctcaaagatgtaatgagcgttaaaatctaaaatatgaaggtgttttattaaagtgatgtttgtgaacaaa

SEQ ID NO: 245351 - DNA, 472 bp, Homo sapiens
tgcaaccacgagccactttctctctcaaagtgcccaaagctgctccagtgagttgtgttcctctcactcaagtgaggttgggagctgtttgcaatgcacttgctctatttcaaaccacttcctcatgtctctttcctccaggctaggaaagaccctgctatttatcagatgagcttgggaaccattaggaaaactcaaagtcagaagcaatcaacctgcaaatacttccccgggggtatgggttgaggtcaccagcaggggaagcccccttggacacagtcctgcttgttttgcacctaacatgggctgctgggcccagaatcaaaagttctgtgtggcacagcaggctgagccgagttgaggaaacacaagagtggaggtgtcagagagctcacatttgctgttgtttcctcttgggaatcaaacccaagcttaattgtggtatcaggtgctctaaagaaacaaactgaaa

SEQ ID NO: 245352 - DNA, 393 bp, Homo sapiens
tgtgaagcaccgtcccctcccttggcagtatagggagaggccaggctccaggccagtagttgaccagaaatgattgattgctctaacagggaggccagccagcagggggttaattttgtacaagttaacccttaccacttattcaagtttctgccacagtgagagcagaggtaccagagattaagggtaccagagactaaaatgtttaaaatgtttcatctcagggtctgggccaggtagtgaaggaagcagaagttagaggagtcttgacagagaaaatagaaaggcatcaagtaccatagacttccattgccattgttgtgtggttgtgcaaactttgcaacttatttccacttacattgatcagctgttggaaccatcagttatttcatt

SEQ ID NO: 245353 - DNA, 463 bp, Homo sapiens
gggagaattagtcactttcaatttgtaattctcaaaaggcagaatattacagaaatggaaaacatgagtagtgtcctctttccgttgtgagcaccctgcatcctggtggcaggctgtatagcctgtaggaagtctctgctgtaagggtggttagtgttccctcctgggcagtgctctgatttgcatgtttgaattcatttgttgaaagctgacctttgggccgggcctggtggcaatcccagcaccttgggagggatcacttgaggtcaggagtttgagaccagcctggccaacgtagtgaaaccctgtgtctactaaaaatacaaaaattagccaggcgtggtggcaggtgcccgtaatcccagctacttgggaggccgaggcaagagaattgcttgaacctgggagtcagagtttgcagtgagctgagatcgtgccactgcacaccagcctgggtgacaga

SEQ ID NO: 245354 - DNA, 474 bp, Homo sapiens
gcactctgtcgcccaggctgtctcaaaataaataaataaataaataaataaataaataaataaataatataggtgtgcaggaataaatgaagagctgttagtatctgcaaatgctgcaagactgcaaagcaggattcacactcgattccattcctaaattgcctcctggaagagagtgatcctgggaggacccagatccttggcctgggaactgaagaggaaaatggatgactgatgtgctactcaacctttaaaaatggctttaaaactaattacctaagccacgttcaatctgacaggaggtattattggagctagcgcatcagtcagatcacttaattacttcataaatcctgggtcttagcatagattttaaagcacttttacacagaacaccattggagcagtttttttcttttcattttcttttaaagcaattaacttgcagagatttgcaggagattgaaatgaaca

SEQ ID NO: 245355 - DNA, 142 bp, Homo sapiens
acagaaagaataggcagaaatggtaatatttcaaagtagtctaatgtccagatgaatatagagcaaaatggactcatgaggattcaggctgagagaatgtagaaaaaatgaacacaagacgagttactcagactcgatttta

SEQ ID NO: 245356 - DNA, 466 bp, Homo sapiens
ctaattattttatcttatttttgtagagacaaagtctctcttttgtagagaagggcccaggctggagtaaaatatttaaagtattgagatataaaaaccactaccttagaaatctgaaccatgtgaaattatcctttaaaaatgaaggtgaagtaaacactgtctcagacaaacaaaaaataggagaatttgttgccattggactggccttgccagaaatgttaaaagaaattctttagagagaagcaaaataataggtcagaaacgtggatctacttaaaggaagaaagaacatcagagaaggaacaagtgaaggtaaaacaaaaacttttcatattcttaattgttctaacagataacagtttgttcaaaataaaaatagcaatagtatatttgattatgtatgcttatatatattcacatgcttatgtacaagtgaaataaatgacagaaataatacaaggga

SEQ ID NO: 245357 - DNA, 436 bp, Homo sapiens
atttctataatttggctgtataatcttcaattaagtcttcttatgacaattctacagtaacattttctgtaacgagaatgtagagataatttagactttcctctagcatgacgatgaacattggtttgggggtatgtctaatagtttagaatttttttctctgcttcacttctcattgttcgtaaggtcggtaaacttttaggactgttgttaattttgggaaaacttctatcaactttctgtttagtagatctatatggtataaacacagtaattataacgtattccattttacacagttccttgagcatgagaggacatgcttacctcagagtgtagggttaggaaggatgcttaacgcctgaaagggctagaaaagttgaagctggttggattatggagtgatggcacacatgtcaaggcaggtggaatattc

SEQ ID NO: 245358 - DNA, 633 bp, Homo sapiens
tctcgatcgttacgactgaaagtaggcaaaggttttttgtttgcttcgcctccttcgttgagctctctttccgtaacaaatggaaatagaagcacacaaattcaagatgggaggctctaacagactgaagatattgtggctttcaaaaaggagagaacattttagatgatatgaaggaaatgtcaccccgttactaagaattcactctattcgacagatatatacacgcttcagcaagtgctcctaaggatgagaggagagtaagttattttcatctaacagtctctatcaacactcttcttaaaacacctaatgcttaacaacagtctaaagaacacactggctactcatacctcccataggcagagaccttgtcctttttgagctgctgtatctcaggtaatcagcaatcacttagtggatgataataatttgcaaattcctctggagcctctaaagaccgtatcatgaatcatcaattcaaatgcctacaggagtcgggcaggtgatatgcaggaggaaatagagtcatttagggcccataacaaaggggagagaggccgggcgcggaggctcacgcctgtaatcccagcactttggaaggccgaggcgggccaatcatttgaggtcagg

SEQ ID NO: 245359 - DNA, 1140 bp, Homo sapiens
acctgtaatcccagctacttgggaggctgaggtaggagaatcccttgaatccgagaggcagaggttgctgtgagccaagattgcgccattgcactccggcctaggcaacaagagcgaaacttcgtctcaaaataaaaaaaaaaaaaggaaagaaaaaagtatgaattgtataagcatgccagtgtaagaggagaggcagaaattcagtctacatagtcctagcacagcttagtgctaagcacttttgttggcaataatgtattgtctttctaggatgttgtcatatgtcttcttagtcattgtacatgatttattagtttagtccaaacgcacacaggtgtattttgaattcatctgtatgcacgaatttttacagaaaattggcaatccaactatgtttttattgaattgtgcaatttattttccacatgatgtctattacaggttcagtatccctgatcagaatgttggaaatccaaaatgcccccatatgtgaaacttggggccacaagtttgagaccagcctgggcaacatggcaagatcttgtctctacaaaaaaaaatgtttaaagaatttttttaaattagcacccgtagctccagcttctcagaagattgaggtgggaagatcacttgagctcaggagttcaagactgcagtggactattataactccactgcactccatcctaggtgacagagcgagactatttaaaaaaaaaaaaaagtttcatataagattaccttcaggctatgtgtataaggtatatataaaacacaaatgaattttatgttttaattcggtcctatccccaagatagctcattatgtgcatgcaaatatttcaaaatcaaaaaatcgaaaacacttcgggtcccaagcatttcggataaggaaaaacctatagttctattcctcctcatctaccttctggaaactcagcatttaaaagcttttaagtaccataaacatcaattcaggaaggggtttcttaggcatgggctataatagcagccagagctgtagagtgaagctgaatttgaactccagctctgtacttaatagctatttggattaagctgttttcttatctgtaaaatgtaaataatagttatttcacattacgtatagaaatagatg

SEQ ID NO: 245360 - DNA, 955 bp, Homo sapiens
cagaaaattggcaatccaactatgtttttattgaattagtgcaatttattttccacatgatgtctattacaggttcagtatccctgatcagaatgttggaaatccaaaatgcccccatatgtgaaacttggggccacaagtttcacatatgggtgtattttgaattcatctgtatgcacgaatttttacagaaaattggcaatccaactatgtttttattgaattgtgcaatttattttccacatgatgtctattacaggttcagtatccctgatcagaatgttggaaatccaaaatgcccccatatgtgaaacttggggccacaagtttgagaccagcctgggcaacatggcaagatcttgtctctacaaaaaaaaatgtttaaagaatttttttaaattagcacccgtagctccagcttctcagaagattgaggtgggaagatcacttgagctcaggagttcaagactgcagtggactattataactccactgcactccatcctaggtgacagagcgagactatttaaaaaaaaaaaaaagtttcatataagattaccttcaggctatgtgtataaggtatatataaaacacaaatgaattttatgttttaattcggtcctatccccaagatagctcattatgtgcatgcaaatatttcaaaatcaaaaaatcgaaaacacttcgggtcccaagcatttcggataaggaaaaacctatagttctattcctcctcatctaccttctggaaactcagcatttaaaagcttttaagtaccataaacatcaattcaggaaggggtttcttaggcatgggctataatagcagccagagctgtagagtgaagctgaatttgaactccagctctgtacttaatagctatttggattaagctgttttcttatctgtaaaatgtaaataatagttatttcacattacgtatagaaatagatg

SEQ ID NO: 245361 - DNA, 894 bp, Homo sapiens
tctaggaaactgctcatctctcaactattgccagaataataaggcattaccatgcttgaagtaactttagtggaggacatacacattttcctgtttagtcttgctgccattagacaatccatatggaaaaattactggtacagtcaagaggaagttgtcttcaagactgtgacattgtggccaccaataggagtccactctcagctgaggaattccttaagtcatttgtgatgctggagatgatagcatgtagccatgcaaaatttcacactagtatattgatttatagtgttcactttcctccaatatgaaacagtttatttcttctacacctagctcagcaaggcattctgtggattaccttattagtaattataacaggctttatggctataatttactttaaaaatgctgagcagtattagaacagttataaatcaatatttctttttggttatcttatgccttcctatcttggagaagctttagaatcaattcattaagaaaataatcatgaattaatgagtgtgtcacatcaattaatttgtgcacaggtttaagaaacaaatattgttttcatcctactgatgcttctaagtaatgcagaaaatgaaataaaattatattgaaaaataaaaaaaaacaaaatggcctcgttggctagcggggagcctgcggcggttccttagggagggtaatcagaacctcctcatgctccctggctcgacgtcggctgggggagggtcaattactaaaggggtatacggtttcccaaatacgggataccaggaaaaactgtgcgaaggccacaaaggccgaacccaaaggccggtgctgggtttcctaggcccccccgcgactccaaatgggctagtaaggggcaacccagattag

SEQ ID NO: 245362 - DNA, 373 bp, Homo sapiens
ccaaccccagtttgtggggctggttttaattttaccaggcaggaaaattccagctgcttgctgacacccaactttaaaaagggcacaaagccttttactccgaaagtgaagtaagagcttatccttagaataatcagtccaataaaaggataaataatcctaacttgttttaagtaggagacaaaattttgaaaggaaggtttgaagagcaggaaaccacttggataataaagggtaaatatgacgaagatgctggaaacactttggccagcctgtttgcctttgtgaacagggaaaaagcatgtgtgtagttttggaacatcactctttgtatagcctgccaactatttaaaaaataaaacatcttacagga

SEQ ID NO: 245363 - DNA, 488 bp, Homo sapiens
ctcccgcctcggccctcccaaaatgctgggattataggcgtgaccaccgcgcccggccctactttgacttttactctgttaggttttccagaatgctgactcttctgccccttgaaccagggactccaaagaataagattcatgggggcggcggcaaggagttaatgtattctgtctgtggccagccatcttccctggtacatcttcttttctcagttcaaactgaggaacgggttagttggaactggagtctttctcttcccctattttcctctgaaagagttcagtgtaaaagtttttttacccattagctgggtgagaatgccagataaatggcagaacaagttaaaaatgagattgttccctcaacttcatgtgaaaggtggagtacttggctagatactctgtttattgtgtaatggattgaaccttgaaaaataaaaccccataagaatagcatatgtcatattttgaccgcttaaaagccc

SEQ ID NO: 245364 - DNA, 479 bp, Homo sapiens
gaggctgcagtgagccatgatcatgacactgcactccagcctgggcaacagagtgagactccatctcaaaaaaaaaaaaaaaaaagagaaaaaaaattgcattggccaacttggaggcttcagtgttattttgccaagaagaatgttcacttttgtcatctaattttacactgctccttcagcaaactgactttatggagagataaccctgtttacctttagaaagaaggaagttgtggattcctcagtcttactcccattactattggtcattcaacagcccatcttcccagaaggaaagatgtaacctgacttttgcgccagaataagaacaacaaacggaagaaaaaaactgagttttatagtagaagtttgtagttgaatgagcatgtagctcaaaatgaagttaaccacttaaacttgtcatatgggggaccaaaatttcttataataaaaagaactatatctgaaaataaaaa

SEQ ID NO: 245365 - DNA, 513 bp, Homo sapiens
tgcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggttcctcaacttaaaagggatgaggagaccttggagacggttctgaggagactcaaaagatgattatatgattggaagtcagtcctatgaggaaaggttgagagaatgaaagcccatcttcccagaaggaaagatgtaacctgacttttgcgccagaataagaacaacaaacggaagaaaaaaactgagttttatagtagaagtttgtagttgaatgagcatgtagctcaaaatgaagttaaccacttaaacttgtcatatgggggaccaaaatttcttataataaaaagaactatatctgaaaataaaaa

SEQ ID NO: 245366 - DNA, 621 bp, Homo sapiens
agtgagccaagatggcgccattgcactccagctctgggctacagagcaagactgtctcgagggggggaaaaaaatcttccttcgcttctgacattagagcaggcagacacatgcgcgcgcgtgtgacacacacacacaccttcctcacatttttatcagaagttctctctggaatctgcactgactgaggcttcttttgagcttcacgccccacttcttcccccgtcgtctttctcctaggcacctgctctttaaaacacaagtcagcacaagggatcagaatccaggtttaactttgctgctggaagtaaacaagtgaggataaaattcttagtgaaattggacagaattttgctctcatatttgccctttttaataggttgacaaaagggagattttgctattgttaaacacctcaccatttttattcttcttgctccctttttcgccgtttgtgcctacactggggttagaaaagatcttagtgtcctctgcagccacttaagcgaatccctttacttgttccctttattgacaggtagttatttctaagctttctaatcttaccatacttccataaatattttatatataagctctagaatttgttcatagcttttt

SEQ ID NO: 245367 - DNA, 247 bp, Homo sapiens
tgtgtggtcccaggggagaggcccagagcttgtgggaaccgacttattttgctgaggcagcgtcatcttttcatcctaccaactccttttcctttgtgagcatccttcaagctataggtccttgtgcctgcattgtcttttatgcctcatgaccattggcaaaaatgggattgtctttgttttttagatgatgaaactgaggcttgcaaggtttagagccccctctgcactaggatctgaacccaga

SEQ ID NO: 245368 - DNA, 715 bp, Homo sapiens
gagagtctgtgtcaaaaaaaaaaaagaattagcttagacctgggcaagtagttatgaggagagattgcctttggggaaaatatcagaaaataagatctggaaaataccgttttttaaatatatttattctatcaacaaggtttgattatgagaaagtcttagaaagtggacatggaaaaactattggattcatggctgggcacggtggcttacgcctataatcccaccactttgggaggccgaggtgggcggatcacctgaagtcaggagttctagaccagcctgaccaacatggagaaacccagtctctacgaaaaatcaaatgaaacattataataacttgaacccacgatatttaatttctattctactcagattactccattacactccacccttaccatctattatcacactccattctcaataaaccttaccatctacttctcaggctgctcctcttcgcccaacttccgccttactttcgtctctctctactagttatcttgtctctcttctgacgatctgctacattctctcaagcccctctcttttactaaccttaattccctcttatccctatctctctttcaccacatccctctcttttttatcattcctcctactatcctcccttttcatcactgctctctcctgttctactgactacgtctatgtctctttcttcactatctctgctactctctcggtgacg

SEQ ID NO: 245369 - DNA, 399 bp, Homo sapiens
ctcacagggttaatgataattacaagccaggctttaggcaaaatcataggtaggcattgaccaaggtgtgctggtgcactgtgacccatctccctgcagctgctagctaaaaggagcatgttgaccatttgcttccccattgttcctttagatagaatctctgggggccaggcatggtggcttatgcctgtaatcccaacagtttgggaggttgaggcaggtggatcacctgaagtcaggagttcgagaccagcctggccaacctggtgaaaccccaactctactaaaaatacaaaaattagctgggcatggtggcaggcgcttgtaatcccagctactcgggatgctcaggcaggagaatcacttgaacctgggaggcggaggttgcagtgagccaag

SEQ ID NO: 245370 - DNA, 365 bp, Homo sapiens
gagttcacttttctacagaatacaaaagtccattctgaggcttttctgatgcatgactttccaacttttgcttaaatagtacctgggttgaagtttcattacattccgaggcagcacctgcattgagacgatctatatcaactataaaagttactcataccaagaaacatagactatgtgagctgtgtaaaaatacagtaaactgatgcaatgaagctacttagctctgaatccttatactttgggttgaaccataaaaattgccaatatctatgtttgacccataaaaaataatttcttatggttcaacttaatatttaagtgaatttaaataaaaatgagcaaacagtaactccatttcagat

SEQ ID NO: 245371 - DNA, 433 bp, Homo sapiens
aaggaagctgattaagcttccatagagtgttgggtgttgccatggaaagagcatagacaaaataaattgtgtgtttcaaccccagagctgccacagatgtttctggctcaatggagacttgcctgtggctagctaactctgcaagaatgtgtgaggtccaggctgggggtggtggctcacgcctgtaatccagcactttgggaggccgaggcgggcggatcacctgaggtcaggagtttgagaccagtctggccaacatggcgaaaccctgtctctactaaaataaattagccaggcattgtggtgtgttcctgtaattccagctactgggaggctgaggcaggagaatcgcttcaacctgggaggcagaggttgcagtgagccgagatcgtgccattgcactccagcttgggcagcagaatgagactgtctc

SEQ ID NO: 245372 - DNA, 339 bp, Homo sapiens
tgtctgtttttggttttttgggtttttgccaccacatttctattaagttgtgtgtcattggataaatagggaatctaagtgtgtgtgtgtgtgtgtgtgtgtctgtgtgtattgcgggtgtatagtcacttccagtacagccaaactatcaccccatctgagacactacacacttcatttacgtctctagtatggaaattatgacactgtattgaagttatttgctcatgttttttgaattcactccactgaaattcagaagctgtcagtcttcagtgcgtacatgttaaagagaatggacgcttatttgatgggagtactttaggtcgatggaggaca

SEQ ID NO: 245373 - DNA, 698 bp, Homo sapiens
ggttttaaagggggaattatttcagctacgttttctagttttctgaggctgcctgaaaaagagaagaaaagatacttccctgccagtttctctgctgaataggtgaaagtcagacagctttttcgtgctgagtccacagacgctcctcggtcatctttgatgaacatagactggaatatagaaaccaatggtcaggccctgaaccgggtcatgcatgctgaagaagcaatcgttggcctccatttgtgtatggcgcgtgcgtggtgatgtcttaaccacaccaattccacctggacgggctgcagttgttaccaattgtgagtgaccataccatagggatgaaccagcagagaagacccagtggtcacatgaggccaggctgagtgcaatgaccaagacaaaggcatgtctaggttacccagtgggagcagtggaagcggcgcttgtcatttggagcgggtcaggagccatcccatgccaccgcggcctctgtagtctcacgacttcctctgcacgcccggggcacttcattcacggcatggatgtggccctcgtgttgctgattctcatagtttttggtgcatccttcttcactccatcagccgcgaggattttgtcttctgccgtcttgtgttttgacttccccttctgccctttctctcaaggtcgccgtttgcacacagcagcatctggaggga

SEQ ID NO: 245374 - DNA, 505 bp, Homo sapiens
acttcaatttttaagagcaatgataaaccataattatagagaattatttttatctaggtacagtcagctttgaattaaccataccaacaggccagacaagtaatctgctttcattaccacccagacacctctatacaagcaatcaaagcaaacagctaggtggtgagaaatctgcatatctgcccctggaaacaatggggatatacttatctaaatcagcagttccacaggtcaaaattatctttacaagaatactaagacatcactcgcctttttcactctcatttcctcataagactgctatatcttggtatcataagagaatatcataataaaataagatcatgtggtaaaaggtgaaagtagttttgatgtccttttcctgttaccggttagctaccaatgaagtacagatttttaggttgaggtgcttttaaggttctatgctgagaatttaaccaggatagaatgtggtttagaaagggaaaagatgggttgtagacca

SEQ ID NO: 245375 - DNA, 210 bp, Homo sapiens
tgtcaacgtcctgcaagaaagaaaaggcaagaacgtcagcgatggctccactgactgattaaggcaaaggaagtcgccactatgccctggatctgttcctgaaggattacagcatgaagaaaaataatgtgggtagccgggcttcatcttagcaacacgagcacctcattttggttttcagttggtcttttaatgaacaaatgtgttgga

SEQ ID NO: 245376 - DNA, 3111 bp, Homo sapiens
  misc_feature (198)..(199): n is a, c, g, or t
  misc_feature (1727)..(1727): n is a, c, g, or t
  misc_feature (1935)..(1936): n is a, c, g, or t
cccgcatctcctgcacatctccacccctgcgcaggaggagatccccaggctgctctctccatctctcctacagctccctgcaaacgagggggaagctgctgagagtccctatcactgctggccttttaatgttgtatgcaaggaggaagagggcgagggataacttggtgctggacaactgacctgcggcccgaaggnnctctggggagggggtgcaaaagaggagcggctgggctgggggactccatgcgggggcgatggacagggcggcgctcctgggactggcccgcttgtgcgcgctgtgggcagccctgctcgtgctgttcccctacggagcccaaggaaactggatgtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccctagaaccttggacctgagagtttcccttacctgatcgacatattttcctttatctgatcaacccatcaatcatgtggatttcttgggattctaatgttgaaaaggtttatattcaccttttgatgatttggggaatatatattgacatacaaggaagataatctgtttcctaagcaagaaataacaggaaagatcccttatgccaggaggcctgccatactcaggataagatccttgaatatggaacttagttacaggnctcaataatggtgggtgaacattagtcatttttaaaagacacctcttatagcaataaggagacattaacatgaatctcatttattctctcagtattttaactgaagaaattatactgtttgtgtgtggatagaagatgttgaaaagttaacataagcattgggtgctgacttaccctttcatgtacttccaaagaaaggtaatcaaanngaatcttcttaagtgatataatatccctaaaaaaatgatcattacagatgtttagtgacaaagaatcaatatgtaaaaagtataatgaatgatttagattttaagtgccttttcactgggagaatctggaaaaacctccataaggtatatagcaatctttgatctttagattcatacttttatcacagatcagttcaactgttaaaaacccacctctgagatactggggggaggatcctgaaacatgcgggaaaaggagaggtaaacagtggaggtaaaaatataatttcatacattgtaaagaaaagcaccctttaaatgtgtaaagacagtgttttgtaaagaattttgtttaaaaagtttctattttgtaaatacagtacttaagttatatgatttatattaaaacatttattgacaaagcctaagagctaaggcagtaaaattatctcataaataatattagcttattttttttcatactattaatgctatttttttggacatcgaagagaattaacttagcagttagttatatggatgtgtatttcttgctaaaatgacagttttatatgttatagattaaaatatgttgcaaaatatcaaaaatttgtgttatttcagcagtaagattaattgaattctcttttcacattagttatgcttaactcataaggttattataataaattatattagtaaaagtcttaactggaaaaaagaatctaaatcagaatagtgatcaatttgtggatttgatatcctggatatttattatattttatgtaatgctgcatttctatttgaatgttaagtggtctttcttgtttttaatattcatgcatgtatattcatcatattttacaaggttcctggtaaaaattacagggctctatttaaggatgtattttaatgtaaatgcttatgttttttatgaattgttaaatatttcagtattatatagaaaaaaatagatttttaaaattcagaatggacaaagagaatattcattttcttattaataagataaagaaatgtttccctgccccacagtcttcattctatttctctttaattttattcactgaggcagagaaacaatttttgaaaaagagcaaacccatggaaaatgtctcagatctaatattaaaatcaagactaagcatttaactgtg

SEQ ID NO: 245377 - DNA, 2877 bp, Homo sapiens
  misc_feature (1493)..(1493): n is a, c, g, or t
  misc_feature (1701)..(1702): n is a, c, g, or t
agcctgcaaaaaccacagagggcaaagccagaaagatggaaaggcacccacccatgcagctcaccacttgcctcagggagaccctcttcacaggggcttctcaaaagacctccctatggtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccctagaaccttggacctgagagtttcccttacctgatcgacatattttcctttatctgatcaacccatcaatcatgtggatttcttgggattctaatgttgaaaaggtttatattcaccttttgatgatttggggaatatatattgacatacaaggaagataatctgtttcctaagcaagaaataacaggaaagatcccttatgccaggaggcctgccatactcaggataagatccttgaatatggaacttagttacaggnctcaataatggtgggtgaacattagtcatttttaaaagacacctcttatagcaataaggagacattaacatgaatctcatttattctctcagtattttaactgaagaaattatactgtttgtgtgtggatagaagatgttgaaaagttaacataagcattgggtgctgacttaccctttcatgtacttccaaagaaaggtaatcaaanngaatcttcttaagtgatataatatccctaaaaaaatgatcattacagatgtttagtgacaaagaatcaatatgtaaaaagtataatgaatgatttagattttaagtgccttttcactgggagaatctggaaaaacctccataaggtatatagcaatctttgatctttagattcatacttttatcacagatcagttcaactgttaaaaacccacctctgagatactggggggaggatcctgaaacatgcgggaaaaggagaggtaaacagtggaggtaaaaatataatttcatacattgtaaagaaaagcaccctttaaatgtgtaaagacagtgttttgtaaagaattttgtttaaaaagtttctattttgtaaatacagtacttaagttatatgatttatattaaaacatttattgacaaagcctaagagctaaggcagtaaaattatctcataaataatattagcttattttttttcatactattaatgctatttttttggacatcgaagagaattaacttagcagttagttatatggatgtgtatttcttgctaaaatgacagttttatatgttatagattaaaatatgttgcaaaatatcaaaaatttgtgttatttcagcagtaagattaattgaattctcttttcacattagttatgcttaactcataaggttattataataaattatattagtaaaagtcttaactggaaaaaagaatctaaatcagaatagtgatcaatttgtggatttgatatcctggatatttattatattttatgtaatgctgcatttctatttgaatgttaagtggtctttcttgtttttaatattcatgcatgtatattcatcatattttacaaggttcctggtaaaaattacagggctctatttaaggatgtattttaatgtaaatgcttatgttttttatgaattgttaaatatttcagtattatatagaaaaaaatagatttttaaaattcagaatggacaaagagaatattcattttcttattaataagataaagaaatgtttccctgccccacagtcttcattctatttctctttaattttattcactgaggcagagaaacaatttttgaaaaagagcaaacccatggaaaatgtctcagatctaatattaaaatcaagactaagcatttaactgtg

SEQ ID NO: 245378 - DNA, 918 bp, Homo sapiens
tgccagaatggcttttgctgagtgcatagcaccagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagcccagcgcagcttctacagctccct

SEQ ID NO: 245379 - DNA, 472 bp, Homo sapiens
atttccgccacgcagatataaagcaacagaatattgctacccaacctagtattccaacgcagataccttgtcccagtcaccattccctttaggccgtttaacaaaactaagacatttgtctgtgttaataggaagccactaagtggccaatgaagaaatgaagaccaaagacaaactaagaagaaatacatcatatgaatcaaagtcttgaagaaggcatgagtggaaagaatcagataaattctacatcattgacaaggtttagtcttagaaaaaaagaaatttctcttaccgcaagtcagagaaaagagaagagacgacaaattcattcaacctatcatttaacaaagatttcttaagcccctattaattggcagtactgtagaaagcactagagagagattttaaagaggaaaataaactgtactcgggctctcctgctagatggacttaatcgcttcgaaaaaggagg

SEQ ID NO: 245380 - DNA, 440 bp, Homo sapiens
taaaccttatcataggtatatatgcatgggaaaagtaagtatgtatgtatgataggtatgtatgtacagtatacatagggttcagtgctacccatggtttcaggcattgaccagggtcttggaatgtatctcccatgcataagggaagactactgtaccttagttatcttatctacaaaaatcagatgatattcttgccctataagtatcacagaattgatacaagattttttttaaaaaaaagaacaatcctgagtggaaaaaatatggcaacttaaaaagtagctgagtgtggtagcccacgcctgtagtttcaagcaattggagatgctgaggtgggaggactgcttgagcccagcacttcgaggttgcagtgagctatgatcctgtcatggcactccagcctgggcgacagagggagaccctgtctttaaaaacta

SEQ ID NO: 245381 - DNA, 233 bp, Homo sapiens
catttaaaagattttttacaaaatcctggacacagctgtataaatagtaaaagaggatgaactgattatcttttactgatcatggtgaaaccaaaatcacctagtttcacagatatgtggaaggtttctcctggagtctgtaagagtgacagcaggtcagagaatggattaagagtctggggaaatgaactcttgggcaaacttgcttactagatacaaaccgagtatagtgc

SEQ ID NO: 245382 - DNA, 489 bp, Homo sapiens
gtttatggagttgagcacacaggcaggtgctggaccagaaaggacacacttttccaggcttggctcggggtcttcatgatgctttaaagtttgatggtctggagcggaaatgccagagcaacctgcaggtgataaagaagaacaggtcatacagtcagaagtccaaaatcaaggtgtccactggattggttccttctgagggccctgctggagaaactgatccatgcctctctcctagcttctggtggttgcttgcaatctttggagttcccggcttgtagctgcgtcactccagtatctgcctccatcttcacatggcattctcttttgtgcgtatgtgtctcctctgtgtccatctccaaatctttacaaggacattgccattcaggattagggcccactctaacctaggatgacctcattttaacttgattacatatgtaaaaaccctacttccaaatactgttcataggtacagatgttaggatt

SEQ ID NO: 245383 - DNA, 646 bp, Homo sapiens
aacaaagttaacaggaccaaggtgcagagagggtgctaggacagcgaagccaaagaggacccctcaaacccaacaagagctgtgcggctccctgattcctcgccagtgttgctaccgcccttggctcttcttgcatggctggctcttgagacccctggaagctgatggaggcaacgtgagaagcacatggacatccgaccttgagcttgagaggcagaggcctgagttctagttacagccccagcagtaccagttgtgtggactgggagggaggctatcacgtacatactccaagcctccaagcctgtttccccttctgacacaggatcttttgtggctggtatagagtgggcactcaataaatgctgtctggtcgtctggctggcatgcctcatgggcctgagaattgaatagaattacagtgatagaagcatgctggtattgtaagtggtttgtaagtgtgaggactaaattattattaaatagtaatcacatctaatcttggataaattagtaaaagcaagaatgggagcagtaaaaacctaagcaacccgaactaaaattttattgaattaattcaatttcttgtcatgtaacacaaccccagaagagaataaaataaagtttatatacatacacccatata

SEQ ID NO: 245384 - DNA, 478 bp, Homo sapiens
atactgttacaatggcaatttaatttcaacatgagctttggaggggacaacattcaaacggtagcagtaggtacataactgtcagcatagaatcaatttaaatgacttgcccaatacctggaatggaacgtgcaccccgggccatgttagctgtgttctaattaactgtgctgatgtttctgagggtaaatggcttagaatgtgtagtcagttaaatagtttcccttcaaattcatgtctacctggaatctcagaatgtgcacttatttggaaatagggttgttgcagatgtcattggttaagatgagtaatgcatctataagccaaagaacaccaagccaccaccagaagtaagaagagaggcacagaacagattctccctcagagcttccagaagaaaccaatattgctgacaccttgatttcaaacttctagccttcaggattgtgagataataaattcctattgtgttaagcca

SEQ ID NO: 245385 - DNA, 327 bp, Homo sapiens
tgagctatgatggtgccactgcactctgggctggtcaacagagtgagattctgtctccccatctcccttcctcctaaaaagccaaaaccaaatctacttcatatatattatttaattctcacaaccctatcagattgataccattaatcttgttttatagatgaggaaatgtaggccccagggttaagtgattttactaggtctcatagctaataagtgatgagtcctttatttatttatttatttattttgttttagagacaaggtcttgctatattgctcagactagacttgaacacctggctcaagtgattccctcacctcagc

SEQ ID NO: 245386 - DNA, 1315 bp, Homo sapiens
  misc_feature (648)..(648): n is a, c, g, or t
taaatcagaaaccactattgtatagatttcttgagagcagggactttgttttgttcattactgtacccatagcctctagaacagcatgtggcacgtagtaggcagtgagtaaatatttattgaatgaaggtatgaaactgtctcatttacttaaacagcaggcttttctttaatgttccttggtttgccccttttgttaggtcttcttttttttcttttgagatagggttgctctattgaggctggcatgcagtggtgtgatcttggctcactgcagcctccgcctcctgggctcaagcaagcctcccatctcagcctccttagtagctgggactacaggcgtgcaccaccacatctggctaatttttgtactttttgtagagacacggttttgccatgttgcccaggctggtcttgaaccccttggctgaagtgatctgcctgcctcggcctcccaaagtgctaggattgcaggcaagagccactatgtccagcctttttttttttttttaaacagagtcttgcgctgctgctcaggctagagtgcactggcacgatcagggctcactgcagccttgacctcctgggctgaagctgtcctcctgcctcagctcccgcatgcctcacccccaacttcaccccacagtngctgggactacaggcatgggccaccatgcctggctaatttttgtatttttagtgtagatggggtttcaccatgttgcccatgcttgtctcaaactcccggactcaagtgatcagcctgccttggcctcccaacgtgctgggattacagaggtgagccaccgcacctggctgttagctcttaaggggagcatgttttctgtgatatctgtgtgatcgtcccattaaatagaatgaattctactattctttggttttatcaagaatcgactttctggtctgttggccagtgaggcaggcattactggttacctaactgatagtcttccctgtgcctgcttctttcatgctcaagaaccgtaattttgttcagatattgagtaagcaacaatgcacttaggggaggtattaacattggcttaaacctttcatgataattctttagtaatcccagtgactggcatagactggtctcatctcattggttctggccaatcaaagaaagtctcctgggggagggttcttggaaagattttcttttttgatcagaatgggagacagttctgtgaagaaagcctctttttgctgccactcacatttcctgcgtttgaatgtggtagtgtgagtgtgattctgaaagctatagcagccgactcgtaaccccgaggca

SEQ ID NO: 245387 - DNA, 512 bp, Homo sapiens
gcagagtatcattctgtcacccaggctggagtggagtggcatgatcttggctcactgtaacttctgcctcccaggttcaagtgactctcctacctcagcctcccaatagctgggattacagccatgcaccagtgcacatggctaatttttgtatttttacaagcaatagggtctcaccatgttggccaaactggtctcaaattcctgaactgaaatgatctacccacctcagcctcccaaactgggattacaggcatgagccactgcacccagtccaaacaacatttttaaaaagcttcctgtagttcttctttttcttaagaagtttccttttactttttatccatttatttcatatatgtttttattgcccctccagatacatagtgggactcttgtattttttgtgttgatttatcttcatggatattttaggaagaggttgggacaagttacaataggactggcaacaagatgccatttaaaacaggaagttcccagagtaagtctca

SEQ ID NO: 245388 - DNA, 232 bp, Homo sapiens
tcatagctgtagagtcaatacttttcccagatttagacaagcagttgggtcttactcctggggctgttttatttttatctttctcaaatgcttcataaatattggagcagaatgtatatctatggtcagctagctaaacgttattttgcactagaagtcacccctctgatttatttcttttcctcaaatacagtgtgtgtatatatatatgtatttatatatctttaggttt

SEQ ID NO: 245389 - DNA, 272 bp, Homo sapiens
ggtcataaatgcaatttttaaaactttttcttacatagttgaacttatatcattgctttcaccttagacgagaatcatatagaagtagaacttttttaacatttggaaacttaattgctttttatttatttcaatttcatatggctaatacatttgtcgagctcttttgaaaatactattaattagttgtttaaaatgttctttgtttttcaacaaatacttgtttcaattctgttaattaaatatgttataatagtcttgtaattgttaaa

SEQ ID NO: 245390 - DNA, 486 bp, Homo sapiens
aggagctgccaaactgttttccaaagcagctgagcaatttgattcccaccagcaatgtgtgaaggttccggtttctccacatcctccccaactcttgtcattttcctttttaaaaataatagccgtcacagtgggtatgaaatggttatctccctgtgattatgacttgcatttccctaatgacaatgctgttggtcatcttttcatctattctttggagaaatgtctacttaaacccctgcccttaaaaaaataggttttttaaaaaagttgttggattttaagagttgtttattctggatacagatccttttcaaatatatgatttgtaaatattttctcttattctgagggttgtcttttcactttcttagtggtatgtatcatttgcagcacacattttaaattttgatgtttcccaatttatctgttttttctcttgtctcttttgcttctggtgtcatatctaataaagtgaaggtcatg

SEQ ID NO: 245391 - DNA, 408 bp, Homo sapiens
tcaacacatataggagaagcaataccggttgtgctcagcctctgctgcagcctcccctcagtagcagcccttcaggccattaaagaccaaaaccatttttgaaaaatctggatttctgtgaaattggataacttatgggggtgcagtgactacaacacagtaggcactaataaagttgacagaatcagtctttgttttaagaaaagtcatctgtaataattctgcagattaatgttaagtaatattaaaaataatttatgacatatagtgcttaaactaaagggagaatcccaatcatacctctattagaggcagagcgagagctagaaacaggactctcattttgctgcattctaagagtgtgggagattgggatggggcagaggcaggctcatggaggaattcacg

SEQ ID NO: 245392 - DNA, 528 bp, Homo sapiens
ttggtctgttgggcaggaggagagagcaccatgagtgtgagcagcatcacaaagatttcagactcaatgtgacaatgtgatcctttacggcttccagagattgtacctgatttcctttaagaatgcatattaaagttaattgcttggttttgagcatgcaaacgctgaaatgtgctagaatggtcaaagttcaggggtaagtgaactttactgcagcatgttgagaacagaatgaatgctgacaaagaagcagagactttttaattttaactgcaggtcaaaagaggactcttaacacaaggtagctgaaactgggcaaacacacgatcccagatggttttatacagcataaaaatgaatgagccaatgtgggttcatcgatggtaacaaatgcatcactctgtatgtgtgtgagggggtatgtgggaactctctgtactttctgctcatttttgctgtgaacctaaaactgctctaaaaaataaagtgtattttaaaagaaaattaaattaaatgtttaaaaatttt

SEQ ID NO: 245393 - DNA, 515 bp, Homo sapiens
ctgtctaaatgtagaaaatgtagcctttattattcttctctaaaaccatagttgtaaattttgatgaggaaatattgattggttttcaagtataagatgagcctcctttttaaagagtattttatacctataaagagcaaaataatacgttagcttgaagactagataaccacatcttaggttatctttgaagacttccacaaagccatcacaaatggctagatctgtgataaaacaggcatagtaaaatgttcactgtagaagtgaggttgtggctatgtatctttcactatacaattgtcagctgttctgtatgcttgaaaattgttgtaacaaaatatcggaagggaatcatagaataagaagatatctctttaaactctgccgtgggagagtcgataatttaagcagtctgtctttatttccttcaatccattaatattcataacttatttctaaggtttagaaatatagctgagtagaatttgaacaaaaaagtaaacaatactttaaaa

SEQ ID NO: 245394 - DNA, 611 bp, Homo sapiens
ttttttattttgcagagaccaggtctcactatgttgcccaggcttactgtatttcaaaggtatcactgtcatgtaccgttttacttcaatggttttattgttttgctttatcttgttacttttttacctccacaaaaagaaaatgaagacagcagagacaaagccccagacagaatgaatgagtactaaggtgccttgaacacaaagtccccatgagtaagaaggcttaaggcatactgtggaaagaactgtctttggtaaatatatcttttgagtcccacccagtcgaactgagtgagagcagtcaccatacaaaatgattctagtgcattgtaaactagtcaggaagagatagccctttacgtattatgttactctttaagctgataccaaagttttcagctcaggacagaatgacggaattaagtatgaaaagagaaattttttcacagattaaatctcaagtacactggcaaaactgaccaagtatgggcaaggtaaaagtttagggaactcccagggggtcacaaaaccataagcagtcacaaaaaccaccctttccagtatttcacctaaatctagatttcaggttcatcatagctttaaaatta

SEQ ID NO: 245395 - DNA, 527 bp, Homo sapiens
ctaaatgagtctttgagacctaatgacttattggaacctattttattttatgaggtgaaatttcaaaatctagtccttcacgttctgcagatctttgaggtcaggggctgtgtccccaggcactaagagcgcgggcttgtgggagacctaggcttacattctagcctgtccccaggcctaggcttacactgtggcttcgtagtttaccaggaagtaacccgggcaaattcacctcgttggtatgaagagagtgtcagcagaggtcgcctccagaggaggtgctgtggagactgagcgcatagcacccttaaaatcctgggaccagggcttctccacgggtaagcttaatgcaagtggagcagtgatttccagctagtgccaggcccaaggtggatgcactgtcaccttagttggattgctttttaattacctcatattctgttaaaaatcatatttctttttttttttttttgagactccatctcaaaacaaaacaaaacaaaacaaaaaccctcaacagaatgtca

SEQ ID NO: 245396 - DNA, 371 bp, Homo sapiens
tgtggccagggtgggccatgtgatttgtgttggccaatgaaatgtgagaatgttgccaggttgcagttctgacagacatcacttgtgggctgcggcacttaagagcaaggtgaccttcctaacactccgtcaataagaaataaaattttattgtgttaagccactgagatctcagggttgatctgatataacagctaactttaattatgctgattaatatagaaacataaagtcagtttgaggatcttccatttggacatgttggttaataacaacatttttctttgacttcttttcggcattcctactggccttgatcaaaagccctgtaggttcagagcctaaaatggggtttgggtagcatattccag

SEQ ID NO: 245397 - DNA, 1340 bp, Homo sapiens
gcaatctccccacttaggcctcccaaagtgcagggattataggcatgagccaccgcaccccgcagtactttccctcgtatacaagctactctcctgaaaaaaatagcaggaacccattccaatgtccaagctcccctaaagtgccaactcagaataactttcatgtttaaaaacagctgtcttcacattgcccattgtgaggttgtaaaaggaagttaagatgtcaagcaatttagattctgttacccatttccctatgaaaagagatgtgttaaaagtctttaactacttaaagggtcatcatgaaaaataagaattctattccagaagacagagttatacacagggaggtgtattatatacttgctaataaatttttgtgtaggctctttagtaaatttatctgataatggaataatcagcctttttggtggaaaggtacatacagaagctaaatcatcatctgttaatagtgtttaagagatttcttcattgagatggaatatgggcaagatgacctttaaggtctttttcacttttatcattggaaatccccagaagcaatctgatagtcttaaaactttgtcctttctaagtcctttgtattcattttagagctcttcaggaaactagagaattttggactttggttgacaaaagcggtctgacctgtgttcgtagctgggaacatgaaacacaaaattctgggtttaatcttctgaagaaatctataagtagttactggcataaatggtattactatactaacaaatttaaaagcctataatgtattaaaactcttttttactcgattacttttatttttttaagacacagtctcgctcaatgccccggctggagtgcagtggcacggtctcagctcactgcaatctccgcctcccaggttcaagcgattctcctgcctcagcctcccaagtagctggaattaattacagacgcccaccaccatgcccggctaatttttgtatttttagtagagatggggtttcaccgtgttgcctaggctggtcttgaactcctgacctcaagtgatcaacccaccttggcctcccaaagtgctgggattacaggcatgagccactgtgcccagccctcttgataatttttattcttgtttcttcttatctgtgggactccaattagaatggggttgagattgtggcattcagttttataccaatattttacccaagtgtgtcatggccttttttaatcattttaatatccccagaaatgctagaagtgtaaaggaataacagaggtaaatttgctgtcattttatgccacatcctcttttcttactttgcttcttgatacag

SEQ ID NO: 245398 - DNA, 690 bp, Homo sapiens
tttttttaagagaaaaatggcattttatttattttaaacaacagcatttaaagttatacctataaggggcacacagaagatatatggagagtttaaagaatgaaaataaactcacacgtgcccaccaccctacttgaaaaacaggattttaccagaaggctcgagtggccctccagattgtagtttctggcccctcccgttcagaggtaactggcatcctggttttcatgttgatcagtggtgtttaaagtacacctgtaggaagttccaaagtgcaggaagggaacaaagcctccttgcagagaaatcttgtactttggtgtttcatcatctgtttgtgtgacaaatatacaacgttaatgttgaagatgtgggttagtgaaattgagacctggcgcttcctgaggctggcagcccggttgagcctgaggaccagacttgaggcagttggcagtccgcgcctcgttgccctctgtctgccctgggtaagtgagaggctccttgggaggccagtggagatggctgtgggaggacagattgagtagctgtccttggagctgctcctccctcccttcgtggagaaatagaaacagctttcctccggccctcacctgttgccagggctccacgctggtgggggcgagctgcgttttgctgagttgcaccgtgggagagcgttggcggccgcat

SEQ ID NO: 245399 - DNA, 310 bp, Homo sapiens
ctaacatacgcactgttaataattctcttaagtagcttaatttttcctgtgtataatgataattgaatttttttcctctcagatgtattcatctgtttcttcctgtgtttctttttcctttctgatgagagaatgaaccctcaaaccgcttctaatttaagctaacaccgcacaggcttttttgtaatattgtatttgctttccttcctcttctctttccccagagtgtattacagaagagttgtaactatttctcaattttaaacagctgctttctggggaaacaaaccagccggagaataaacttaaa

SEQ ID NO: 245400 - DNA, 612 bp, Homo sapiens
tgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcttcaatttaaatatacaacttttatatcatgtatcaaaccagattttatattcaaactatcacattttaaattcttcacataacagtaagcgcactagtcatatatgaaatgtcatttagatcaaacaccaagggtcaaagcccaggacaagaattaaaattttacacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatcaaacttgga

SEQ ID NO: 245401 - DNA, 357 bp, Homo sapiens
tgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcttcaatttaaatatacaacttttatatcatgtatcaaaccagattttatattcaaactatcacattttaaattcttcacataacagtaagcgcactagtcatatatgaaatgtcatttagatcaaacaccaagggtcaaagcccaggacaagaattaaaattttacacttaaagattttgtctatctccagtggcagacatta

SEQ ID NO: 245402 - DNA, 184 bp, Homo sapiens
tcaatggtcacttgagtttttgtataattttgcaatttagataaaatgttgaaactatgtcttccaaaaggaacgtcctgattctttcattacttggatgtaaaaatgaatagtatttttaagtggttgtgaagtattagaaacaatttctgattctattaaataaaaggcaggaatttggaca

SEQ ID NO: 245403 - DNA, 525 bp, Homo sapiens
gggaatcgaagaatagtcagctaggaatagagctacagaagtacacttacataaaccatcctggactttaatgtccctgggcagattcagtcgcaaaatccaatatgatattttgtaaagttttcaagttggacatttacatttttgagaattttgagacttcatcttacacatgccagtattaacacacatttggacaatagctttattaagtctataaagctattgaaaggaacatggcttacccttgttatttcactagttcaggttgcaacgaaaggtttttttgtccatgaacacttggcatatcttacttagcaaaaaagaaggatgtacattttactatagaattaatgtatgaacagtgtgtcactgctgttggatgtaaaaatgtatatgaaaccatttcattcacttgattacatttctgaagtataaataaaaaaatctaattctttttgacccatttataaccaataggattttattctttcggagagaccattcttccatgccagagccaag

SEQ ID NO: 245404 - DNA, 480 bp, Homo sapiens
agtggataccacgttgtgaggtcagccactgggtcacttgtagtcaatgcaaagcttgcacaaaccaacgtcagcctagtttcactcagtttgacctgagactttccaatacaatctgttgttttgttttgtctcaaaaaaaagagaaaagaaaagaaaaaggtttcagatgaagttcaatgacatctaaatgggacgggtaagggtcccagtcttccccataaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgt

SEQ ID NO: 245405 - DNA, 437 bp, Homo sapiens
atttcctggctctgtacactgaggggacctggaggcaccccattagcaatgagcacacctggcttccccgtactggcttttaaataccattagtcactaaagaaaccagagtttcttgaagaaatggtggctggttccagggccagagtagtgaaagtacaagatgaagttggaatattttgttgtcccagaaaatatgaagaacgatgaggacacatccgaaggacacaaaagcctgcttgaaggggttcccactggccaaacctgggacaatcagagcatcaaaatatatgatagtaatagattataaccctttgaaaaaaggagaaaaacatgaggccatactgatataagtaagagaataatgaaatatttggtgaggaacaggaaatttgcatggcttcagaatacttctccacagaatactcgttaatttc

SEQ ID NO: 245406 - DNA, 425 bp, Homo sapiens
aataagcttcttagatagcctattgctttgtggttataataattatacactccactggatagcaagcaatctacttatctacacgtgtaagtttgacttgaagtttcttctatttttcatctgctggagtaactcaattactaggccatctgtatttgcaaatctgcaaagtgaatgttgtcatccagtagccttgccacatgtgtcctgagtactttttacattctttagcttccttgattcacttcagccaccctagaaattactgagtttcaaattagattaagtctccctgagaagtgaaataaatattggatggagagaaggaaagaagattcagatgggtggggatgaagaatgagccgtgtgaaggaagcatgtttgctaataaacctcacggaggatgacctgagtacacaatgcgg

SEQ ID NO: 245407 - DNA, 708 bp, Homo sapiens
gcagagagtgcacaaaggccccctgcttgagtcctcttcagggttagctctcagaaacacaatctgcagaacagatttttgttccaacatccttgcaggagaatttgcccttagcttcccccaccccagccaggctgaataaaattatgctgaaactactgtcttatttgaggaaagtaattagtcataggtgggagggggtggggagattgcagaagaatgttcatgaatattaggattttcagctctaaggggggactttgtaaacagctttagaagaagaaccaggccggctgggtgtggtggctcatgcctgtaatctcagcatttggggaggccaaggcgggcggatcacttgaggtcaggagtttgagaccagcctggccaacatggtgaaaccctgtctctattaaaaatacaaaaattagccagccgtggtagcgagcgcctatgatcccagctactccggaggctgaggccagagaatcacatgaacctgggaggtggaggctgcagtgagccgagatcacgccactgcactccagcctgggggacagagcaagaatctgtttcaaaaaaaaaaaaagaaaaataggaaggaaggaaggaaaggaaaggaaagaagagagagagaaagaaagagagagagagaaagaaagaaagaaagaaagaaagaaagaaagaaagaaagaaagaaagaaagaaaga

SEQ ID NO: 245408 - DNA, 619 bp, Homo sapiens
gctcctacagggcttttatggtgcagctcgccaatgatccgtgtgttaaagactccccaaatacacattgacacgatagactggagttgtttgggtctatcgtggcaatgatccggggataatggcagtgtcttatacaatttcactgagattggagtgctcatggtcctaatggcagaaccggaactgccccagttaagtcccaccatggcgcccagtaaagggtgtgtgggtctttgaccttctgcttcatgacactgtggcatcgctaattttactgatattttaactaacataattgagttagcatttttttccccctgaaaattcatttttgtaattcaacacctgaattagggagtccatctagtgatggtttcatttgggtaatcataagctaaagacctaggaaaggtcattcttaaacctaaagtgttttgggaaaaataatcgtgggagatgcatatgagcttgagacagagttaatatggaataaataacctcagtcctgagaaaacctagttggctaggctgaaatagacaagatgagaaggtgggaagaagatgtttttaaaaataatgaaagtaacatattcaataaaaataattcaaacactgt

SEQ ID NO: 245409 - DNA, 524 bp, Homo sapiens
ttttgagatgttttgttttgtttctgagatggagttctgcttcttgtcacctaggctggagtgcaatggcgccatctcagctcactgcaagctctgcctcccaggttcatgtgattctcctgcctcggcctcgtaagtagctgggactacaggcaccctctgccacgtccggctcattttttgtatttttagtagggacagggtttcaccacattggctaggttggtctcgaactcttgacctcaggtgatctgcccaccttggcctctcaaagtgctgggatcacaggcaggagccaccatgcccagcctaaactagtcttaaatatattcaaagaggtaaaggaaaacatggacaaagaactaaaggaaatcaggaaaataatgaaaaattctggagctgaaaagtacaataaatgaaatgaaaaattcactacaaggattcaataggagatttgagcaggcagaagaaagatcagagaatatgaagataaaacaattgaaattactctgaggagaaaataa

SEQ ID NO: 245410 - DNA, 380 bp, Homo sapiens
tgagctgttctgacactaaatacaacttttcttcttcacgcttcacttgtctgcgtacctcattcttcctagacgcaggacaagagctctggcaaaggcgctgcagccacagaggtttccggccggaaaaatcggcaccccagagatcccatgagaacgtcacgtacagcactgagacggagccctaatgaaaactgtggctctgggtgataatgacgttactgtgggttcatcaactgtagcaaattcgccctctgctgggcgttgttggaaatgcagaggctctggggggtcaggtatgtgggagctctctgtacctttcttgtaatttgatgtgaacttaaagctgctccaaaaagataaaatcttgaagaaaagcg

SEQ ID NO: 245411 - DNA, 382 bp, Homo sapiens
gcgtaggaattaacccttgtcctaaaactttctacatttctttctgggtttctctgttgtgatttgaatccttttctgggggcataattattttgtactatctaattaataggagactttgcattttgttgtcttttaaaagatacttttggcagggtgtggttgctcacacctgtagtcccagcactttggtaggctgaggtgcaaggattgattgaaaccagcctgggaaacatagaccccatctgtaccaaaaagtaacagattagccaggcagcgtgcacctgtggtcccaggaggtcaaggctgcaatgacctgtgatcatgccactgcactccagcctgggcaacagagaccctgtctcaaaaaaccaaaaagggg

SEQ ID NO: 245412 - DNA, 419 bp, Homo sapiens
atgcgctcatagaaacggtaatacgatgctctttacttctttaagtcaaatccacgttcctccgggctgcatcctgaagaattaaccgtaggagaaacaataaaggtcctcccggacagccatgagcagccctggtgctcctcggaagcccccgaggcgagaagagaaggccacactgggaatgtcgttctccgaggcggggtatggggagggtatggttgtgagcaggtggccatgacggaggctccagattctcgtgtagcagtcctggcccacggccgccacgactccttcttcttcgttcacatgcacgggtaggtaggcggagttattcacatgaccttcgtactgtgttacacatttagtggccctcaagtcccacagcttgatagttccagtcatgtctgatgacaccagga

SEQ ID NO: 245413 - DNA, 589 bp, Homo sapiens
acatcaacctccattgcaaatggccatagaaaattccaatttttcagttctttcttctaattcagcaatagctaactctttggcagatgagaagagtagcttgctcagtctccatccccatcctcttatgttcagagtctagaaagctagaagctacatatttcagactaatttgcaagtaagattctgaatacaaatgagattcctccaaatagatactatttgtaagacaaaagtaaagtgggggtcctctttcttccgctccatcttttgggaagctgggtcatcaaaaagtgagtgtctagagatagtagtgctgctgactatattcggtgtcagtgtctagtcatcagcttcttgggtatctacaagtggtttcagcagtagcaacaaccagaaactgttgcagtgtctattcattcactttgatggagtgcagaggtatttctgatggtaatagttcctaattgagttttctgatttctggattgcaggtaagagagtgtgttcataaacctaataattccagtattggcctcctgatcctcactgctgttatcctaaagatttccagcacttggtccttgta

SEQ ID NO: 245414 - DNA, 397 bp, Homo sapiens
ggggctgggcgcagtggcttacatctgtaatctcagcactttgggagactgagagaaaattaattccagttggtgttctgggcagaaatgaagaggaggaggaagaagacaaagcagcttctcccctttcctttgcactgagggcaggcccacgccactttctctggtgtggccacaccatcgtccacacgatgaaaagcagaggcccagggaggctgaaggactttcctgaaatcatccagggaggagcaaagccagccctgaatcccaggtctcctaatgattaatccagaacgccttccacttctcttttctgccacatggccttaaaacagaagacaacccagatgggacaaactagactgaataaatattcataatattctaatattcataa

SEQ ID NO: 245415 - DNA, 380 bp, Homo sapiens
ggggctgggcgcagtggcttacatctgtaatctcagcactttgggagactgagagaaaattaattccagttggtgttctgggcagaaatgaagaggaggaggaagaagacaaagcagcttctcccctttcctttgcactgagggcaggcccacgccactttctctggtgtggccacaccatcgtccacacgatgaaaagcagaggcccagggaggctgaaggactttcctgaaatcatccagggaggagcaaagccagccctgaatcccaggtctcctaatgattaatccagaacgccttccacttctcttttctgccacctcccccctcaacccattttcctagggttggggaaataaagttggaatttgtatgggtca

SEQ ID NO: 245416 - DNA, 507 bp, Homo sapiens
cagcctccatttactgagcactgtggttagacttggggcctgattcctttggaaatacagatggctggcagaaaaaaaggaagcacgaggtggttgccaatcctgcattgctttttgcaggaaggtctcaggagagtgggtgtggggagaggggagtcaagggagagcctctgtggattccagaattgcttaactggggtcatgccaagctcttaaaagccacaagtagcatttgggctccaggcttatgtctgttcctgtccagccaggcctgggtggtgtttcatcccaggcctcctgagatttaagctactgctgagattttgttatagaaaggcaagaagggggaccgaagatgtttctgtgctccggcctcctcccaaacccaaccagcccctgtggaatgtgcctctgccgggctaggacttggtttctaatgagaagaaaacaaggctgcctgtggctttctcctccctcctggaggggcactgagctcccagctaagga

SEQ ID NO: 245417 - DNA, 715 bp, Homo sapiens
ataccacccccactagcctcttctgcaggataacttgaacactgcagtggccctgtccatctaaactttacaaggttttgtaaacgttactgaacttgcttcttcccgactacattaaagcacttacttgagatattaaacattttctcattagtcctgtttgcctagtcagtcacttgtatagacagggcaacagcacggcctgaatattgggcaggacaccgccctgcgcgatagtaactttgcccaacagcttgttgagcttctcgtcgtggatggcgagctgcaggcgtcggggggtgacgcgggtcttcttgtctcgggccgcgttgcccgccaactccaggatcttggcggtcaggtactccagcaccgcctccaggtacaccggcgcaccggcccggacccgcttggcgtagttgcccttgcggaggaggcggtgcactcggcccacagaaaactggagaccagccctggaagagtgcgttttagccttggcgcgagctttgctgccctgcattccacatccagacgcagtgaagtatttaaatacttgtttagaagaaggaaagtgattgattctagtaaaacgcaagagctaaactcttataatctatattcggcaaagtagactgtgctatctcctgaacacagatttcagccaatcgaaaagcaggtgtttaaaaaaatttaaaaaaaaaaaaaaaaaaaaaac

SEQ ID NO: 245418 - DNA, 463 bp, Homo sapiens
tgtggtcacgactggcagtggtgataaaggtcggtatgaccttactgctctccataaatagcccttcagtcagtaatgtccttgcatgatatggtcacattctttcaagagcagccctgcttttatgtatggtaccttccttccacagagctttccatctcaggtgaagctgctttcttgccccaccataattcctctcaatgacttcaaagcagggcctctacattcgatttttttttaggatgagtctgtctaccttttttttagagctatgctgtctactttggtagccagtagtcacatgtagcaacttgaaatgtggctagtctgaattcagatggactttaaagtacccactgaattctcctggtaactttaaaatgctgatgacatgatatgtatatagcttggacatgatgacagtttgatatactgggttaaattaaacatattattaaaatta

SEQ ID NO: 245419 - DNA, 736 bp, Homo sapiens
agaagccgaagacccaaaaacctgaggggctgctgatgcatgttctggagtccagagtttaagaacctggagttctgatgtacaagggcaggagaatatagagatctcagctccaggaaagtgagagattcttctttcctctacctgttctattccttccctcaaccaattatatggtgcttgcccacgctggtgagggtagatgctaatctcttctggaaacaccctcatagacctgcccagaaataatggtttaccagctagctgactgactatcccttaacccagtcaagtggatgctaaaaattaaccatcacagttattaatatgatgtaatggatatgacaataatccatgtacttaaaaatataagtattattaatgacagcagccactccttaaccccctaaactcctgtcataactcaagctaagcattttttcttatactatctaatttcatacttaaaaacctgtaagttggttattacacacatatagatgagatgaaatatagatttttattacatacatatagattatattatttattaaacacatataggttaatctcagaaggattcaataacttgcccaagctcacacagctagagagtgccagtagctattatttcaaccaagtgtgtgctgcttatgacagcacactgactttccatttttctctaaatacctcatataatgagtgagcatccttttttatctcaaaaataagtaac

SEQ ID NO: 245420 - DNA, 413 bp, Homo sapiens
cactcacaagttagagaatgagacttcagctaattctttactgtgtctccttcttgttctgtgtgttttttgaaggagaaagaagtcaaaagttctctatcatcataaagtcaaaaattcatattttatttgttttgctcttttcttcggaaacatcaaatttatagtacatattgcttttcttgtcatttctctccattttgtaatttgtgtatgcagaattctaagatgacctctaagagtttcaccccctggtgtgtatgtcccatgtaattccaacatcaaggatgagcagacctgtgactatgagggatagttactctcatgagtatataaagctacataagacttcttcctagcccactggagagagatgcttctgctggttttgagtaagcagccatgttgtcaca

SEQ ID NO: 245421 - DNA, 421 bp, Homo sapiens
tttacaaattaagtccaggaacctgaaaaccaggctaaacatgaaagaatcaataagcaaaagaaaatgagggattcattaatctgcttagagaactcaaatcagtgaccataaagatggatttctggccaggcacggtggctcacgcctgtaatcccagcactttgggaggctgaggcaggcggatcacctgaggtcagtagtttgagaccagcctgggcaacatggtgaaaccccgtctctactaaaaatacaaaaactagccagatgtggtgtcggacacctgtaatcccagctacctgggaggctgagggaggaaaattgcttgaacccaggagacagaggctgcagtgagccatgatcacgccactactctccaacctgggtgacagagcgagactctgcctttaaaattaaagaa

SEQ ID NO: 245422 - DNA, 97 bp, Homo sapiens
gcaaaaacaacaaatcttattttttcagcctgttcgatgtatgtgtgaaacaatgttgtccaacaataaacgggaatcttatttttctgaggttttt

SEQ ID NO: 245423 - DNA, 783 bp, Homo sapiens
gggaaactatcatatgaaaataaaagcttctgttcataagggtatatttaaaactcatttattaaaatattgcttagaacttgaaaattcatcagtaggtgaattgtttggaaagtatggtttatccatacagtgagatgttatacacttttaaaaataacttggatctacatgtagtaacctggaaagaggcccattatacactgtttaatgaagaaagcaagtttctgagtaatgtatataacatgattccatttatatacagcatacaccaacagcacacacttttatatatataacttaggtcttatatatatttgcatgagcaaaaaatagagaagagtacacagtaaaatgttaatattaccttaagggggtgaagttttaaatgaaagaaaaatctagcaaagtttaaattaaaataaaatcccctgagaagaaagggatcagaatggttacatggtccagaaaggaaaaggtggactcaatcacagctttgttttaccacctccactcattatgcgttttcaggtcgggttgccctgacgcaccagaggtcagccctatgctaaggcagatgacaatgtgttatgccacaagtgacattggtaaatagtgcatttggagagaaaaggctataaaacttctcatctgtaaaagtttccaaggcatacaagaactttggtatcttggtaaaaagaatgtgtctccaggcacacttggaatctaccatgcttctggttgaggccctacagcctccagggtctcccggtccatatcagt

SEQ ID NO: 245424 - DNA, 572 bp, Homo sapiens
gagacgtagtctctattgcccagcctggagtgcagtggcacaatctcagctcactgcaacctctgcctcctgggttcaagcgattcttctgcctcagcctaccgagtagctgggactacaggtgtgcaccaccatgcttggctaatttttgtattttagtagagacagggtttcaccacgttggtcaggatggtcttgatctcctgacctcgtgatctgtccgccttggcctcccaaaatgctgggattacaggcgtgagccactgtgcccagcctgtgttacatttttaatatctttgcctttgattttacttcatccagtacagttttttttaaatttgcatttgcactattgctctttgcccatccttttagccttttgagtcactttactcaagtgttagtaacatctgaatttaacttttttcccacccaatctgaaggtctctcttttgaaacaaatttattccatttaagtttactgttgtaaatgtttggtttaaattttattattttggctttttttcattctgatgtatttattaaataaaggtgtgttcaactaaatttca

SEQ ID NO: 245425 - DNA, 580 bp, Homo sapiens
accagagaaatgtaggcagagaaatggggtgagacaggagaaagaaagggtcataggagcaaagggtactgttggtgagtgtcactcgtggataaattcctgactggagtggaaggaaagtgacggaaagacatttaggggcaggcatattgaatattttattttttgattggtaatattgatactcctatgatgtaatcatagcccctttctcaaaccatcccaaaattcagtagtctcccacacatactccatgttaatcatgccctggccacgtcagttttaaaggaaggtattataggttgctgtggggcttgaataaaatagccatcagagtgagatataagatcagggcttcagaaaaaaaaaaaaaaagaaatttgatttaaaaccaaaaaaggcccattaaaataacccaaactttgaggaatttgtaggaatctggaggtgggcatcaaacttcccactaaatgtagagagtggggtaggggaagggaagatgcaggaaatgggtcaatttaattttatgtaaaagtctcaaaagatgggataacatcagttaacacctggactatacaaa

SEQ ID NO: 245426 - DNA, 455 bp, Homo sapiens
tcttgcattgctataaagaaatacctgaagctgggtaatttgtaaagaaaatttattttggcatatggttcctcaggctgtacaggaagcatagtgctggtatctgcttctggtaagggcctcaggaagcttacaatcgtggcagaagacaaaggggggccagtgaattatatggcgagagggagcaagagagtgagggggctgccacacagctttaaacaaccagaacttgtgtgaactcagaacaagaactcacttatccggggggtggtgctagaccatccatgaagtgttcaactctgtggtccagttacctccctacagggccaccttccgcactgggaatcacatggctttgttttttttctctctctgtcacccaggctggagtgcagtgagccgagactgcgccacttcagtctggcctgggtgaaagagcgagactccgtctcaaa

SEQ ID NO: 245427 - DNA, 1006 bp, Homo sapiens
ggcttcagtctgtaggtgactacagaaggaggaggagctccgtctgttctctcttcaggcagttgttgtgtctctcagcgcttgttgggttcacaacctattaaataagccggggccggggccagggctggtgcccggggccgcactgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgt

SEQ ID NO: 245428 - DNA, 905 bp, Homo sapiens
ggcttcagtctgtaggtgactacagaaggaggaggagctccgtctgttctctcttcaggcagttgttgtgtctctcagcgcttgttgggttcacaacctattaaataagccggggccggggccagggctggtgcccggggccgcactgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccattgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgt

SEQ ID NO: 245429 - DNA, 406 bp, Homo sapiens
cgcccatggctgctgctgtacagcctgctgaggtgactgttgaagttggtgaggacctccacatgcaccaggttcgtgaccgggagatgcctgaaggtaaggaggtgataggtgccatctaccctcggtttgcctctggctgctgctgtccccaaggttccctttgaggcatcccacacttcgagctcctttctgcttgtagccagctttcccgggggctggccaggaacaaaagctggctctgccttgaattcccaccccttagtctttccccaccgagtccagtcagtttcttttcacctcccctcccaatcgcccagttcttgctctctcatctcattctcccaggctggcatgggaccatttatttatggctcttgtcgaataagcagcagttgaataaatg

SEQ ID NO: 245430 - DNA, 470 bp, Homo sapiens
gtgtatatatacccccgaagtgtggaaaagagatctcaacaggtgttggatgttattatgtattttaaatgtacccactcacattaagtgcataaagatgtatccagacaacttgtgagaacttacgtgtttctagttattttacaaccacatagccctcaaaagcaacctagaatatggaaatatatcctcacaacgctaattatccttgttaggtacactagtacttccttttcctaatactgaagaagtaaatgtgattgaaatacaaaccaaccaaatataatgaagagacatttctacatgtcaaagttggattctagatttttagacctgtgaggaatctcaacctcttcattttataaatgaggatattgagacctagaaagggaaaccaacttggtcccaaatcacttagctggtaattggcagattaaacaagtgctctgatttcagaccctagacttaaa

SEQ ID NO: 245431 - DNA, 452 bp, Homo sapiens
aaaattatgtatatttaaagtgtacaatgtgatgctttgatatgtgtatatattgtgaaatgattaccatatcaagttagttaacacatctatcacctcacgtagttaccattttttttttgtggtgagaacagttaagatctattctctcagcaaatttcgatatacgaaatgaatagagtggtacatcaaaaattacaaaggattatacagattgatacaatgttattttatagatgttaataattgttttgttcattgttataatggtatattaatattctagacataagaatattcatctttttaatttgatgttacagttgtaattagcaagcattttgcagcaagttgtatgtatacatatgtatgtatgagatacatatatatatatatacagacacatatttatactgtaagactctcaaatgttaaatgctttaatatgcaaa

SEQ ID NO: 245432 - DNA, 692 bp, Homo sapiens
ccttgtttcctagatgagagaacacaattgcataaatgtttcaaagtcatctccaaaatctcatggtaaattaaaggaaagacaagactagcatcctggattctgagttacttcctttgtgaaatgaaagagagaaacattattaaaatcttgtattatctcaatcctatttgcagcatgagttgtcataagatttataacataaatacttatcataacataagtatgcaaattggttgatttgttttgccctttactttctagatccagaggatattagaaatatgccactttagggaaaatacactagggaaagacctaagagcaaagaagaacctcatcttgatgttataaaataacaatgtaataatacattcattctaattgctcactgtatctttcaaagtaaaatgtaaatttgcattagtttttagacaatatgtactctaactttgaacttagtgtaagcaatctgctgtaaaaaatagtcccaaaatatgtctttggctcaaatacatgaggagattatttctcagccttgtaaacaattcagcaaggcactgggttggtgggaggtagaaaaagctcacgaatttaacagaagatcttcaaggtcccctggctgagaacgtggaaacaaggccaccaggaattcctcggggcagacggggtccaccccagaaggtgtgagg

SEQ ID NO: 245433 - DNA, 719 bp, Homo sapiens
ccgggaggagaattcgaagttaatcaatagaattcgtatattaattcagaaacaccttttgagcactgactttgccagcttcttgcctgggaactggaatgtagatgggagcgagacacagtccctgctgtcctcatggggctttcattttgtgaaacctgactagtaaagtaccaattattgctaaggcaagtaacacaaactttcactgctcttttctttatttagatgtcttcatctacaaaatgcgttctatttcagtaaacacacaaatatgtgtaaggtttcccatagtttgtgtcttacttctgagcctactgaatgttgttttccctataaaatcttgagcctctctagctggtctttacctaccaagaggatacacaggaagatgacatccttaggatggaagcagccactctactctgttgttttccagaaacgtagttttatattatatttaatcatatccattagcattattattgttgaactcaattggcgtttgcttagattttccttttgtgttttccaatcttgttcatggttccttcttgtatctcagacctcattgctgcatcttttcccttctcaattatgtacatcatttatacgtttctttggtgaagtatgttggtggtaaattctcacctttatttttaagaaataattttgacagcttattacagttttttagatcataaatatcttggaagttc

SEQ ID NO: 245434 - DNA, 638 bp, Homo sapiens
accatttgcttcctctcccgagggtcagagccgcctcacaccgcactcagggtggactcctgctgagggcgcgtcctcccacttcacacccaagggcaggtgctgcggagggactggagtgtgagaatctgtggccaggacacttctatacatggaggctctagattgcctactggtcaccaaacagatctgggtcctttaaggaaaaggtttatttgagtatttcacggaagccctggtgggtccatgttctctgcggcgtcctgggctcggatggagggcgtttctgccctagttctgtgcttagctgtgcatccctgggcgagccgagtttccgatccttgcctcgagaggctgctgctaggactgaggaaggtttttcgagtgaggattggcagacgttttctgtaaagggctagatagtaaatattttcaggcttgtgggccatatggactttttcacaacttctctgctgttgaagcacagaagcagccacagacgtggacagcgggcgtggccgtgtccctgtgagacttgcctaccgaggcaccagcgagctgtggtttgcttgcccgccctaacctatagcaagtgcctggccctgcaccaagcacagagcaggcatcaggcaagattg

SEQ ID NO: 245435 - DNA, 792 bp, Homo sapiens
ccaggtctggtttcctgctgcctactgactagcaaccatcagattctctgtaggacagaagacagaatttggcatctcctgccttctggtagtcagacttgttgctgaaggacagaagcgccctccaaagagtgccctgtttcctccctgtattgcaccatgagctcatacctagtgtaggatcaccactgctcgtctggagattagcactgcagcaacctcaggtacccaaggcatattggggcctgcagacatgtggctaggaaggaacggaggtagggcccttcatgcctccagacctcctgcaccttgttcattccatttgcctggaaagcatcccatgtcctacccgagaacaacttattaccatagattctctccagatagcatggaccttagagcatccctgtacttcctgcttagcatacagccctccagtttacccacttctctgtgaacctctagcacttcctgagttgcaagataattcatggttttacttgttaggttctcactgggttgtgggcttccagagggcaggactatcttgttctttgtcgctcctatccccgtaccaccccagtgtctagtacgtaggaggtataaacagttgttgaaagaagatatctgtaagttttacttacagaagaactgattctttcagaatatctaaaatgagatttaaaaaaatcattttattgaaaacatcagttgtcttaaaattataggagtttcccccattttgcatttcttcaatgaacatgtattacttgagcaataatttttagagtg

SEQ ID NO: 245436 - DNA, 480 bp, Homo sapiens
aaaaagttaaattcataagactagttatgtagcagaaaaaaacataagattcaaattcagaagcctgtgttttaaagctgtatttttggctaacttgttatgtgatctcagtttcctcacttaggaaatcattgagaagcgactcatgcatgttctaccacaagcttccatggataaataactttgaaacattccagataatacaacttcaaacctttgtctttactgagtgaaaatgattgctgtagaagtcgttcagtcttacgactggagagtcaagctctaggatatgttggtggatctgttaaccagttgattaaatcctagtaatattttatttcaaatctttcttctttgtttttctttttcttttgagacggagtctcactctgttgcccaggctggagtgcagtgagccgagatcactccactgtactccagcctgggtgacaaagtgagactacatctcaaaaaaaaaaa

SEQ ID NO: 245437 - DNA, 719 bp, Homo sapiens
caaactaattatctctctcctacttgacacccacaaaactaaaaaactggaaggaagggaaaacttctccttaaaagaatcatagaacaagataaggtgatcaagatgaagaagaggatgaaattccataaagaggaagctttgcattctaggccacttttgctctggggtcatttgctgatctagcagagatgtagcagatttggaagctgaggctataggccccagggacaaaagtggaaatccagggcccatcaacactgggggctttgtggctgggtgggcactgtgtctgtaatcccagcattttgggaggcgaggtggaaggactgcttaagcccaggagtttaagtaacatagtctatctaggtagcacagtgagactctatctctattagaagagacaagacaagacaagacaagaagcttgagtaaatgaccccctcctttgggcttgaaaccaaaaaagtgatatcctaccaggaaagatgaacaagaagaaaagcagtccacaagtggaatgtgattaaacttctgaacatctgaagcccagacactggaaaaagatgaaccttaagtattagtaaccaacggggaacaaaacaaagctcccctagatactagcaaactattcatatacctgcttactatgttcaaaaatataaaatcccaatcctgaaaaatttggcaagtaacgcgaagttactttaaaaaaacaa

SEQ ID NO: 245438 - DNA, 1061 bp, Homo sapiens
accaaattgctgaacatatcactagtattttggatttgctgagtgcagtcttcccattaaaactaagtgttcagtagggaggcgtggtggctcacacctataatcccactactttgggaggccgaggtgggtggatcacttgaggtcaaaagttcgaggccagcctggccaatatggtgaaaccccgtctctactaaaaacaaaaacaaaaactaagtgttcagtgagattgtagcctatgctacaacaatagtaatgccaattgttttagagaaaagtaaatgagaggctaccagttgtgtttagaggaggtcgacgttttattttagacaaaattcacaggaaatcacagtgggaatgtgataaggggtttgaatgattgatggggacaggaagaattcatttgagagactagagatgagtcagtattctagatcgtgaagtaaaatagtgagtcatgtagtgacttagcatgggttatccttaaatcccagtgtcttaagtgtattttttattcatactgcatgtctaaggagggttggcaaggagtgctcatagacccacaaggaatccaggctgagtgtggcaccatcaacatatatttccatgaccatagtggtggtggggaattggaacatggtaaattacacataggactatcgaatgggacttgccttgcctcactgaataatttatataggtggcttttaatgctacgatactggctaattctttccgatacattgaccatgaaatttatgagttggcacctacaattcccaccatgcctccgcttccctctgatctgttctcacgggcttaccaatgctgcccgcttctcctcttatgtgtattttctccgtcaatgactgtacacctatgccttttcttacatgatgtgcactattacttcccctttaaattaggctcggtctctctccccctaataccacctgtcattcgcattgtctattgtctctatttaaattatactctgtcacgctcctccgtcctgccgtctgtgactctccctgcttcgttagcacgtatcatctcccgtt

SEQ ID NO: 245439 - DNA, 383 bp, Homo sapiens
agaggacagatgaggaaaccaaggcttgggaggagaagcggcgcatcctgtggcacacagtaggtgtgacacaagacagctgactctggcttccaggctcttcccacagatctgcagagcttctgccctcccagccccacctgccaggactaggtcctctccgccggccctgcagctgcgttctctgcctctgctctgtggactgatgcctcacacgagctccctggcctctggcttctgcctccccatgccctctcttgtgaacagtccatcagggctgggaggaaagcaggatgaaaccagttcccagcgaagcagcattcgccagcatttacttcatacctccctttaatcaactcacttttctctaaaagctttaaaaa

SEQ ID NO: 245440 - DNA, 464 bp, Homo sapiens
ggtctactctgaaggtttaagagatccctgagccaacctcaagcttgcggacagactagcactccccagcctccccctaaaattcggactgaatggcgggccaaggatactgaaggggttctctaacatccttatgatggtggcttctggaatacactgcactagaaagtcaggcttccttaagaatagctggtcatactcaggcaacgttcccagggataaattagattagatgaaaattacaccataattagggtacttatttctagaaattcaataggaaattctcctggggttctcatgcttttaccttggtcttccccaaagggtcaaagtgcttattaaggctgggcacaatggctcatacctgtaatcccaatacttggggaagcagaagctgaaggaatgcttgaggccaggagttagagaccagccgaggtaacatatcaagtctctacaagaaa

SEQ ID NO: 245441 - DNA, 509 bp, Homo sapiens
ctgggcgacaaaagcaaagctccgtctccaaaagaaaaaaaaacaacaaaaaaaccccagaaaaacaacgaaaaatgcagtcgatccatacatgcttagaccagcgggtacaattctaggaagaaacaagaatgagaagaaagcctcagcagcagggatgcaggattgaggcacagcatataaagtaatgaaggaacaggggttctgtggccggaggatttgctcacatatcactgttaggggagccagaagccactggacaggttcagccaaaagtcagttttccatcccgaggacctgcccctgtgtcagggctcctctgtccattacagcaaattgaactggagtcatcctctgctggaccctgccccactgactcactcttgctcagagagtagcagcgatgcctctcaccactgggaaggcagcccactcctgtggatgggaaatttgttctctagtttggctgggtgtgcgtgtgtagatcagggcagaaatccaaaaaagag

SEQ ID NO: 245442 - DNA, 965 bp, Homo sapiens
ttttggaatatttatatatacataatgagatatcttagggatgagacccaagtctaaacacaaaattgattgtttcatatacaccttataaacatagcctaaaggtaattttatataataattttaataattttatgcattaaacaaagttttgtctggacctacaacttgaggtctggtgtggaattttccacttttggtgtcatgttagcactcaaaaagtttcggagttgaagcatttctgatttcagattttcagattagggatgttcaatttgtaccattgttatattaatgagttgccaataagatcagtatttgggtttgacctatgggatagatgcttgggtgtgtcagaagacttctatatatgtaattatttaccaaaaggccaataatgatgttgagatttgacatgcctgcccattaagagacagcatttgtgggccataaagaagtctaaaaggcaatcttgtatcataaataagagatggacttttgaatgagagatcctagacttaacacctgcttctcccacttactagctgtacaatgtttggtgaattacttaatctcttggtttctgagtttcctcgtcagtaaaaaggagattttaaaagtccgttgttgcctaggactgctgtgaagattaacttagataatggattgtacagggtacatttaatcatcagtcagtgaatattaatattacacaagttatagcattcaacaactaaaaagtccttatctgaaaatattggcatctctaagttctaaactgggtagaaatcctagatgtaaaataaaagggagtttaatacagagtaacagtaagataaatattcatgagaagattcattctaaatagctgactgctattgatttggctcttggccctcccatatgcccccccaaaatatctttaaaacttaatattggttgggttaccctataataaagtttcc

SEQ ID NO: 245443 - DNA, 239 bp, Homo sapiens
ggtcagggtgggctccctggaggaggtgatgggttaggttggccctaaaagcttttctgggttaggaagaatgatccaggcagaggcacctgtatgtaagagatgtgaaggagccaggtccacagagaaatgagggagttaagggcaccctccttgacccccttgtccatgtaatatgtatatcctgcctagggcttcttcagtagtaataatttgtcctcagcaaatgatatattaac

SEQ ID NO: 245444 - DNA, 1579 bp, Homo sapiens
cttaaaagcaacactgtttttttaacagggggtttctgaaaacataacagacacatcaccagcagtcactaacatttattgaattctaggcacagtaactagcatgtgcaacacttaataaattttagtgtctattaaaattcacacaatgaatatacatgtgctattctaaacatgcggaatacagcagtgaacagaatggacaaacatcctggcttgtggtgcctgtgttctagtgaaagaggcagacaatacacaggtaaagaaataagtaaaatatagagcatgttagataagtgctaaagggtaaaactaagtgagagtctcattgggggaagggaggttagaattgggggctaagttggtcagagaaggtctacctctgtatgatgggtcaacaaggaggttatctgtgggagaaaattccagaggcttgtgtgtgtcggtgtttgttgatcatcaagggagtacagggcatgaggtctgggaggacctcgtaggtcaccatatgaggacactggctttaatgccatatgaggtggaagaagagaaatgtactaaaagcccactaaaaggaagcaagaccaggtaataacctaggtaaaagatgaaggtggttagacctatgccagcaatagatgtggtgaggaaggtcagaggatcacttgagtccaggagttccacactacagtgagctgtgagctatgatcatgccactacactccaccctggaggatgaagtgagatctcatctcaaaaacaaaacaaaacccaacacatttgggctgagcactgggaggaatggaaatgccactggtgggcttgggaaccaggaggatgccaagtactctgtcaagtgctttatgcatatcatctcgttcaatcctcaagacagcattatagaaactataattttcattttgtaggtaaggaaacaatgctactacaatagtcaagtaacttggccaaagtcactcagtcagcaggcagctgtagggatctaaatcaagaatgatcttccagtgtaagactgagtataaccacatgcttcaccaccacagtcatggcaccgacaggctggtgggacacagatgtggtgacttctaaatcagatcatgagtaattagacatccatgatggtttgttgagaggagggaaatagacaatccctgggcatgctgtaaaagagaaggccaaaatgataccatttagaaatacacatgtacacagagtactcatttatgagcacatgcagaaaaatatcaaaagttatatgaacccaaatatgagcatcatttatctctggtgagatgataatttggtttgtctttttgtttatccttatcttctaatctgcctacaagtcaaattgctgggattactaactttagagaaaaatctacaatttccctataattcctatggctcagtccattatttaggtcatgagacctaaaattgtaaattagaaaaggtagaagcaaagaagaccaccagttcaccaacatgagaatgaaaggtgaggcacaatctgggactgaatccatcatctagcctttagagtgcccttccccactcc

SEQ ID NO: 245445 - DNA, 274 bp, Homo sapiens
acaaggcattcttcagtcatttttgtataatgatgagtataattgttctggtccttgggagctatcttaggagatagctgaaaaaaaaaatttttgatttttgtaataacttaccttaaatcactcaatctcttttttagttaaattaataattcttttaaattatctctgaagctactagctgtttatagtaaatccagtttctcccagtcttttgctacacagaaactggaaaagtataagggaaaggagccataatcctttttttaatgta

SEQ ID NO: 245446 - DNA, 585 bp, Homo sapiens
tgatatatttgtttattctcatgatcagagtgaagtatgggtccactttttgctttcactttttttccagttagctttccatttgtcttaacagcatttactgaaaagtccattattttccccagtgctctgagctgccaactttatcacatgaatttccatatgcacacgggtttccttctagatttttctcttctttcccattggcctttttattcataagcctgaacccttgaaggatgtttgactatagaggatttatagtctgtctagtagggccagtcccatttcattgctctacttgttcagaagttgcctcgctactcttgcatgtttatttttcataaatttcagaacaaatttgtgtagctccagaaaacaacttgttggtatttttattggaataacattaaaattacaagttaactcagggagagctaacatctttatgatgttgtttttaattcttatgcttctaatggttttctcttgtctaattgcattggccaataccaccaatacgatgctaaatagcagtggaaacacagcatccttgctgtgtttctgacttactggagttttccc

SEQ ID NO: 245447 - DNA, 548 bp, Homo sapiens
agactcaaaggctaggggtgactcaggggctgggggctgaaatcatctgaagataattaaactatctcaatcctttttctttcccctggaaaatatgctgggtattcaaatgtgacaacaaattgtcatgatttgccttgcagttgatgttggctaagggctggatctgagctggggttgttggccagaacacctacatgtggcctctccatgtagcttgggcttcctcataacgtggtggctgggttccaagggaaagtgttctgagaaagagagagccaatagagagaggtccatattcttttccaacctagtcttggaagttgagcagtgcctcttccaccatattcgattcatggagatagccataaaggcctgcccaggaccaggggagggaacctagactccacctcttcatgtaggaggggcaaggctctggaagaggacatgggaatgaattggatgtggtggccatttttggcaaaaataatctgccacagaaattgtatctggggttgaaatttaaggatatagaggggctaggcaga

SEQ ID NO: 245448 - DNA, 366 bp, Homo sapiens
gagaatagacagagtagatcagacgacatcacagagtaggactgagtactgtaaaactaatttctgagggacgtgtgtgtgtgtgtgcgtgttgggtcatggtataaattttttttttcttactttggatcataaaaagttacaagtttggaaaacactgctcaaatgcaagccctatttattgcagatgaagtagctgagatccagagaagggaagtgggtagcccaagagagtcccatgaagtctatagctgtccctattcctctggattcagggatctctccactccagcacaattgaaaatctaaatataaagagaatcttcacactcttgtttgttctagaaaaggtgatttgaggaaaga

SEQ ID NO: 245449 - DNA, 1247 bp, Homo sapiens
  misc_feature (736)..(736): n is a, c, g, or t
cggccaacctgcaaatgcccctgcgtccttgcctctcctgggaacggggagggcccgaaatgcagtggcagtccggggtggagagggaaccatcttttcatggatgatctgaggttgcctcgctaaggtaaaggctccacctgccccctgagtcggacccaggagatgatgcagctctccatctcagctgcgtagacatctgccttcgtcaacacacatctttctgagaggacaccctgccactggggtgatgccgcctcatgttccacatgattagagcctcctccagaagggcagggtgggagaggagactgttgggaggatccctcggtggccccaccctcactccccacacccaaagggcgccctgcctgcggggcctttcactagttctgtgagttatttgtctgtgaattttttccttccttatcctctttttaatgagggtggcttctccacctgtctttgtcgcggtgaacccagcagtctcttcagcatggttgccaccttgtcagcacgcctgcctgtcagtcccccttgagggcttctgttgcctgcagagggactggcaggaagaggtgcacctaggtggatctagactttgactccgggtgactcaggaggctgaggtgggaggattgcttgagcccaggaggtcggggctgcagtgagctatgatgatgccgctgcactccagcctgggtgccagcaaggccctgtctcttaaattaactcnagtagttaagtattaacaaaatcaccaacatcacaaaacaaaacagtgcggcccgctctggccaacgattttagacttggcaaagcttaaccttcgggccgctattgagcttacattggcaaatccgcctatagggggcgatctacaattaacggcccggctttaacaagtggggctgggaaaaccctgtgggtcccaatttaaaggctgtgggacaaccctttttccgcctgtgggaatacacaaggccccccgtagcgctttaccaagtgtgccaccttgtgcgacggccatttcgcgccctatcttgtgaaaacgcccacaacttttcaaacgtcctctttctcacgagggaccgtgcggacctcttttatcacgcccatcacgtcgggggtgcctctctgcaagagcctttctcacagctccgctcctctctgtgacgacctttctgccgggccggctcgtcgtccctacatctcttcgctctccggcgccatccctaccccgccct

SEQ ID NO: 245450 - DNA, 772 bp, Homo sapiens
cggccaacctgcaaatgcccctgcgtccttgcctctcctgggaacggggagggcccgaaatgcagtggcagtccggggtggagagggaaccatcttttcatggatgatctgaggttgcctcgctaaggtaaaggctccacctgccccctgagtcggacccaggagatgatgcagctctccatctcagctgcgtagacatctgccttcgtcaacacacatctttctgagaggacaccctgccactggggtgatgccgcctcatgttccacatgattagagcctcctccagaagggcagggtgggagaggagactgttgggaggatccctcggtggccccaccctcactccccacacccaaagggcgccctgcctgcggggcctttcactagttctgtgagttatttgtctgtgaattttttccttccttatcctctttttaatgagggtggcttctccacctgtctttgtcgcggtgaacccagcagtctcttcagcatggttgccaccttgtcagcacgcctgcctgtcagtcccccttgagggcttctgttgcctgcagagggactggcaggaagaggtgcacctaggtggatctagactttgactccgggtgactcaggaggctgaggtgggaggattgcttgagcccaggaggtcggggctgcagtgagctatgatgatgccgctgcactccagcctgggtgccagcaaggccctgtctcttaaataaataaataaataaataaataaataaataaataaataaaattt

SEQ ID NO: 245451 - DNA, 410 bp, Homo sapiens
acatagcaagaccccatctttatttaaaagtagaaaaggaagtaagatcatccataatccttcccaccagaggggaacatttttctttttttaggattaatatatttttatattaaaaattattcatacaggctgggtgcagtggctcactcctgtaatcccagcactttgggaggccaagtggatcagctgaagtcaggagtttgagaccagcctggccaacatggtgaaaccccatctctactaaaaatacaaaattagccgggtctgttggtgcatacctgtagtcccagctactcgggaggctgaggcaggagaatcacttgaacctgggaggcggaggctgtagtgagccgagatcatgccattgcactccagcctggacaacaagagcaaaaactccgtctaaa

SEQ ID NO: 245452 - DNA, 495 bp, Homo sapiens
agcgaaactccgtctaagaaaaaacaaacaaacaaaaaacaatcaacagagtgaaaaggcaattctttcaatacattggagactgttcaattttttattgccccttgattcagttttggaatacactagttttaaagtaatttgtctctttcacctaaactgttaaacttatcaggctgaagttgattgcaatatgtccttatgataatattcctcattatttcttactattattattgcttcttattattctttaaaatatgcatatattttaaattcttctaaatatgtattaacattctacaggatatgtattaatatccccacttgcacctctaatactgtttatttgttttctttattttttcattaatttgtcttcctagagatttactaattttattaagtttgttttcaaagaaccaacttacggctttgttaattttccccatgtgaatgtttaccattcattgatgtttgttcttatttatatta

SEQ ID NO: 245453 - DNA, 374 bp, Homo sapiens
tattcattcattcctccatccattctacaaatgattttctttatcttactccatctcagccccatgttataaactgagagtaagaagataatcctggccatagaggaactaacactctattcacaagtgtggacatagttgagcttatgtatacaacacatatgcacacatgaaaactaactcagccctttagagcgtgatcctatatcaagttcattttcataccccaccctgactgtctaacatatcttgtctatctggtctgttacggactgtgttttctgaattaatgagatactataaaacacaaagtcagagaggaaagaaaagatgaagaaagagagaaaataaattacctcttccaatttcccatg

SEQ ID NO: 245454 - DNA, 364 bp, Homo sapiens
ggaaatgacacgctaagtttcctatttctagcagctgccaaggccaccagcaagcatgggaacctctgggagtcacagctcctccgtctccagaggcctggcagtggccaagtctagaaggacgcgggtgccacctggtacagggtgagggtgtgaataacagaccccgaagggttgccacctcgagccccgtgccttgtccaggaatacacaggctcttttgatgtcaggtaactttgccatatgatctttgtggtgtacctggtaggtcacaccctgtgagtgtgtagatgcctcctcccgtgctggctgcttaatttcttctgcactcataatcctgaccatcttgaagatcatcactgaa

SEQ ID NO: 245455 - DNA, 502 bp, Homo sapiens
catgtggtcatgagaacttagtcaccctgggaataataatcaggggttctcctttgagcttttgcttattagcattctgtctcatgtacttaaacagattattacaaacaggacatttgtatagagctgtggctacagccagagttttcctacacaaatctcccttagattagaggttatgagctgcttacataatataatcaaacatgtaactatcttatggtcacagacctttaatatttcttttatgtgcctatcccagtagaaaagaaatgtgtttgtactgagtaagaactttgtacatgtgtagtttgttttttaaaatcagctttattgaggtataatttacatatattaaaacacattttatgtgtacagaccaatgacttttggcaagtgtatatatttgtgtaaccatacatgtataggttttacaaactgcactggattcagagattattagtttacaatagttgaataaatgttgattctgaaacaacag

SEQ ID NO: 245456 - DNA, 481 bp, Homo sapiens
tggagagtttgcttggtcacagtgcacagatgaagttggaaaggcgtgaagtggaggcggctgcaatcttacatagtagtaattgtaattgtacagtgactgaaagagagatgataggggtataaggtaggaggtggagaggaagggagcaactcaaaagacattttagacatagacaagcagtatttgattaagtgctgagaaaggttattagttttggcagttaagaggtatctttcatgtcatttttcttgtgtgttgaatcgttctgtaattccaatttacaaagagcttttcatctcacctgagcctcacaacaaccctgtgagtagatccccaggcttttgtctctgatgagcacaatagtcaaactgagactaggacacaagcatgtcagtgttgtttctgtatacaggctgcgtgctccatacagaaaaatgcttgtctccgtgtatacatcagtgaagcaaaagcctataaa

SEQ ID NO: 245457 - DNA, 536 bp, Homo sapiens
ggggcctgatcaaaaacaggaaaagctgttggatctcacttgtcatccatagtttcttgcccagaaatgccaaactacacaaccatgggttacacattgctttcctaccacattgtcagagatgtttaaaatagtaacactcagtgtgggctaggatgtggaacaatagagagcttcgtatataatggataggaatttaagctgttaaactttttgagggaaagctaatatatcaaacacctgcaaatggtacccatggattggtccaattattctacttctgatgatgtgtactgtgaagagcaaagatttgagcagaaggtttgtgaacaaagttatccatcacaaaattatttctaagagtgaaacacagaaagcagtccagacatctcacaataggggttggttaaataaatagaatggcataccatgcaagtattagaaatgagaaatattttaaaatatttttggaacataaataaatgttaggccgggtgcggtggctcatgcccataatcccagcactttgggaggcc

SEQ ID NO: 245458 - DNA, 399 bp, Homo sapiens
ttcttttttttgctactccactcttccagacaaaaattagtccaacatagtgacaatcacacacatggcaacaatgatggaatctgaaggctgcattaaaaatccagggctgtttcatcactataataaatttcaatttgatcagacttcagatccagttcttagcttcaggaaggcttagttagaataaagattgacattaggcagctttttcaaaataataaatcacttctacttctgcctcagtgcctaggggaattctgcacagatgcagagtgacacctttaacaagatgaacagtggtgaggggtttctgatccagttgataattttatacgccttgagctctgtgagagacttccacaaagcaatgaatgtaaaagagtttttcttgctcta

SEQ ID NO: 245459 - DNA, 457 bp, Homo sapiens
gttttgctatattgcccaggctggtcttcaactagtgggctcaggtgatctgcctggccttggtctcccaaagtgctggcattccaggcatgagccactgcacccggcctggatattgagttttgcttagaatagaagccctgtgagaccagagatgtatctgtctgtttactgttatagtcccagtgtctagagcagtgtgcaggttattgcaggtgctcaataaatatctgtaaaatgagtgaaatgaatgaatgagtatgagggacccccttgtgatgtgcagaactaagtcattatattataatacttttcctacagttattactttatccttgaatgtatttaaattgcaaagtatgtagacaggagttttgaaataaaatcaaggaggaactggcatttatatgcataaacctgaggtacttctttttttggttttatctctagccagaga

SEQ ID NO: 245460 - DNA, 387 bp, Homo sapiens
ataaaggagaggcttgaaaatgaatgaagatgttgagtggaaaaagtcacagaaaaacacctacagtacgattccatttatataaagatatctatcaaacagataaaaccaaacaatatactttgtgggagagcaatacacaaacgcttaaaacaaaactgtaaagaaaggagtgataatagaattcaggatagtggtccctttttgggggaggagagggttgtgatcagaaaggggcatattggaggtgtggtaatattttgtttcttaacctgggtgtaggaacatgagcatttactttgtttttaaatggtatattttcacatgttcttgaacatatgctaaatttctaacaaaaaggaactatgtaataaacatgtaatatat

SEQ ID NO: 245461 - DNA, 459 bp, Homo sapiens
agggagagaggaacaaattaagtgcttccatttctggtgctaccgtggactaaatattacggaaacttctgatatactgcaactaaaaatgctggatataatatttaacaaccacacacactctttcaccatagggattcccagtccacccccttaactttctgagtcactctgtgaccctgccagctacaggtttttcccagcaagcttgaacccaaactggggccttgaacatttccaggcactgttaaaggtatctaggttgcccaaaatattgaaataaactggccccagccctgagccaaatttcttaaacccccatttaaactccataccctgacccctccttgtggacaaacctaggtaagacatcctgtttttctctctgtccatcttgaaaatatgctgcagcactctatatgtaagttcttcaaataaatcctttgaactgatacccca

SEQ ID NO: 245462 - DNA, 466 bp, Homo sapiens
ggaaggaaggaaggagagagggagggagggagggaggaaaggcgggagggaggaacaaagaaagatgtacccagtaacatgagtatatacattcttttcaagtgtacataaaacatttaccaatacagacaatagcctggaccataaaacaaatctcaatacatgtcaaaggactgaaatcttacaaagtatgttttgtgaactcactgggattaaactagaactcaataccataaagataactgaattactaaataattagaaattaatcaatatactttcaaataatttatgaggcaaagaacaaattaaaatataatttagaaaatattttgaactacatttaactcaaagaaaaccgtacataccaaaatttgtgagacatagtaaaatcgtcaaaggaaatttatccattaaatatctatgttggaaaattaggtctcaaatcaaaatctaagcttccact

SEQ ID NO: 245463 - DNA, 346 bp, Homo sapiens
ctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagc

SEQ ID NO: 245464 - DNA, 485 bp, Homo sapiens
tttgaatggacacataattatacaatttatggggcacagtgtgatattttgatgcatgtatatcatgaatagtgatcaaatcagggtaactagcatatccatcacctcaaccatttatcatttctttgtacatggataaagaaaatgtggtgtatccatttgtctgttgacaaacacttaggtttggccattgtgaatagtactgcaataaccatgggagtgctttcatattgctttcctttcaatatgatatatatctatatatctatatatctatatctatatatatatacactcacatacacacatatgggggatatagaaatggaagaaagaaagaagatcacatttttacctaacgctttcttcttttctattggtactttctttatatttttatctttgaagctcagatttatcataaatgttgtatacaattttaaatattttccttttcctaattgtttgtggtagcaaagtaacat

SEQ ID NO: 245465 - DNA, 696 bp, Homo sapiens
gctcagcctccatgctctgtaactcattccttccttcccagggtatgacagctccaactggggttggatccttgcatccttggatcctaccggcagaggccgttgagaaagcagttgacaaggagcaccaaaaagacttcagagacttcaatgccctcagatacctcaccatcacattggtccctaagcttcactacttaaagaaggacttgtacatggagacctgagtttaggggtgccacattccaaatgttttccagtgatgctttaacacctcttaaaaaatggtgcccatctttctatgtctggttggtctgtccccttaatatggctctcactgggtggcacctcactgtgctgtctacatactaactacagacatgatataataatttaaagatgattttaaaagctaatagtgatataaatgtacattgttcccatcattctccttttatctcaaatgttgcctccttagaggagtcttctttaaccaccccaatctaaattcatcatcccccactccaagtgcctctctggtgtgcagccctcaccagacaactgaacctgcagattccttggtcatggactttccagcctctagaactgtaagaaaatacatttctagtttttacaaatcacccagtctcaagtattctgtttcagcagcacaaaataaagtaagacactgttaaa

SEQ ID NO: 245466 - DNA, 701 bp, Homo sapiens
tatacagataggttgtattatctataaatttcaaatcatagatgatgtaacttattatgtctatgataatgaaagaggcattaaattatgtacgagtgcaataaggagttgcgtttgatagggccaaaaagccctgaaataaggggcaatatactatttatcgattgttatatagtaatatcgccacaaactgagtggcacacatttatcatcttagagtttctgtggttcaggagtctgagtatggtttagctgcaacatctgcaaggctacaatcaagatggtggccagagctgcagtctaatttgtaagattggctgggaaaggatctatttcatgagtcatgcagttcatgtaggaatcgaggtccttgaggcctgttggactacagacctcaacttgttgctgtctgctggataaaggcttcgcttacttcctcaccgtgcagctctcttcagtatggccacttacttcattgaagccacaaagggagaaagtctgaaatcaagacagaacatataatcttatgtaatgtcatcatgaaagtggcatcctgttgtccggtgctttgtgagactccgcccctccgcccttgactaactcctttctgctagatcttcatctcttctagcaccattaccctatttctctatcaagtattttgatctctttttttttttttatttaatatttaatataat

SEQ ID NO: 245467 - DNA, 470 bp, Homo sapiens
cactcatttcttcagttattcaattctttgtgtcactatagacctaagtatattgattttatattttagattatagtctgatgacttaaattgcctaaattgtttcagctttagccactggtgctctttcaggtttacctttttttatttcagattggcctcttttttgttctcagcactttctgacagtataaaatgctctgtgctcatcttgtattaatattttcccttccctagccctagaatcaggaatttcttcaatagaaaaatggtattaaccagccggcacggtggctcacacctgtaatcccagtactttgggaggccgaggtgggcaaatcatgaggtcaggagttcgagaccagcctgaccaacatggtgaaaccccgtctctcccaaaaatacaaaaattagctgggtgtggtggcatgtgcctgtcgtcccagctactcaggaggctgaagcaggag

SEQ ID NO: 245468 - DNA, 989 bp, Homo sapiens
gattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgc

SEQ ID NO: 245469 - DNA, 471 bp, Homo sapiens
cctttgtcttttgattgactttaaaatggaatattttaagtcattaaatgtgatgtaccccagctttgagctacttccaatatattaggttaggaagtttctatttgcttatatttttaagtcctgagtggatgatgagttttataaaatgcttttcctacttctattaagatggcaagtgtttcccccctcccctcctctctattacggtggattacataattttgaaccacccttgcattctgggataaacccaaattggtcatgatcagtagtattactaataatatacttgtagatttaaaatattttatttttcaaattttgaatcttcatttacaaataaactataatttttcttgttctgtatattcataagtgagattaattttcaattatattcataattttttgttttttgtcattttgtttttattttttgaaataaatgtctacatgtacttcatgtgg

SEQ ID NO: 245470 - DNA, 337 bp, Homo sapiens
tccctaggtggcttctggacactcttaagacatgaacacactttgggggctcaccctgtcaggctttgctctctgagcttagatgagaaaaacacaaaaataaaaccaaaaggtgacatttaggtgcccatcaagaaagatgtgttgggaactggacaggtcagggctttaagtactgtatcttactgtatgtttaagtactgtatgttactgtggaaacttacccattttcccctcagaacaactctgtctcaggaggtgagtctgagagctactgtttctttgtaaaggttttatctgatcaggcccacggtcaccacgtcagccccaccccaga

SEQ ID NO: 245471 - DNA, 474 bp, Homo sapiens
tagctttgttttccgttttcattcattcatccaaagtaattctttccctgctgacattggacacatcacccttgtatcatacagtgagtggccctgaatcctggggccatttctgtcttgttcccactaaaacatcaggctctgcttaaaagcacacacctaaatgtttgttgaataaactatggaaatcccttctacctagagcctaagacatagacaatgccctgacactttctgtctttatgtcagtcagtgtggattctgggcctctggtcgcactccctctagtgaaattcaaggctgtatagacacacacaaaacaagaaacttccaaattttaaagaaatgtgaataattggcatacatttagtataaagggattttgtgagtgattagattctttaccttttctctaattcccaatccatctaaacttgtcctgcagaaaagtacacctataaaacaaatttgacc

SEQ ID NO: 245472 - DNA, 505 bp, Homo sapiens
ctatttctcggctgagctcatccttttggatttgatgaaggccatgccgtgtatccgcatggaatcattagagaattaagaaacaagatgaaggagataagcccaagaatcaacaaagatatggacaaacagaaacttgaccacaagcaaatcatttgtactaactattggagatactgcaaggtttagagggcttggaaagaaagggagaggcagtattgaaactccagagtgacagatgagagagatgaccacggctaatggaaacatagaacataaagagatgcaacctggaaccacagataaagcagattaaatatattcacacaattggcttgctgaaggtagtaagcaccttggaagcaacacattgaaggacacaaagccaaagatggaaggagcctaagttcctgaatcaccacttagagaaaagccactttccaatcaagaaaactcatctcaaactttatctgagcaagaaataaacgtctattttataaactca

SEQ ID NO: 245473 - DNA, 667 bp, Homo sapiens
ttaatacctctctttattatttttcgagtgccaatgtcaatgtttggaaagtttctttcattttgttgcttgtactaacccagctatagccagaagcttgactggaaagtaaatgtttaggagatttgttttataaactgcattaaagcactgccatttatcaccacagatcttttattttccctaaatgtggccttgtttgaagcctcatctataaaagttcattgttggggataaactcaggataaaggtgtctttactctgcctcttatcaaactacagtttatcatagatccaccctgaaattatgtggtgaagatactgtgtacattttgtttttaaagataagaaaaaataaacatgactgcgaggatgtttggagtcctgattttttaaaaagcatttattgcttatggcacatgaagctgtgccgtcttattttgctttgttttgtatgttttttgtctttcatgagactatacacagcctgaaaaattccatgattgggaaacagaaggttgtcttgtctttggggatcatttttaggtgtttgaagttggtgataaacccaaggatctgtgctctgcctggggaatcttgagatggtgtctggtggggtttgagataaatgaaatctgaaacaataaaagtcaattcagaaaaccca

SEQ ID NO: 245474 - DNA, 390 bp, Homo sapiens
atgaagcgattacaacctgggcgcagtatactggctggctttgctgctcactcccttacgaatagctgtgatgggatatgaaatccaagggaactgttagccccccagagcagctgctcccaccgaccctgctccaagagtgctgggatgtccgctggcctcgaggcaagacaagagctccaatcactctgctgcaagcgccaccattaaagtcaagatcactgtggtggggggagttgaagtgtgcattccagcatgctcatgatcttactgaccttctccactgatgaattagaacacccctcttcccaggcacaggacgagttcagtgcctctctgtttcttgatggaccccaataaaaaaacgcctgcactgtttttcacctaagg

SEQ ID NO: 245475 - DNA, 695 bp, Homo sapiens
ctgcaataaacaaatggatgacattcatgtggccaacagagaataatgggtgttcccacattttgaaactgcttttttttttaaagtggcaatcttgagaagtatttacaagtttgtaattctataccatgcactagcaatgatcactttaaacaggctactacacagataatataaaactatgcataatttctacagtaattccacttccctttcttctgctcaagaaattactggatttcaagtgaccgaaattatagtgataactttgactttgtcaagtttcacacatcgtggggccatgatttgagccagggcagtctgactctgaatttgaacagtgtttaattgccaggaacaaaccacagggaaaacttctaaacagaagaatacagagcaaaaggaaatgcctaggattgttctttctaaattctcaacatttcccaatacaaaaagtattatggtataattacagttctataaaacaatgtgctctatgtataataaaaataccagcaaaataaagagattacctgaaaattgtaaatcgaaggacacattcacataactgagatacaactggatttttccctaaatttgttagataattccacaattgccaatttcgctctgtttgttgagatctgatcttggtttcaaattttaaaatttcactgtataataaaatgagttcc

SEQ ID NO: 245476 - DNA, 696 bp, Homo sapiens
ctgcaataaacaaatggatgacattcatgtggccaacagagaataatgggtgttcccacattttgaaacaagaacaaatttcctgttggaaataaaaaaaaaaatagggctacagagctctttttgcttttttttttaaagtggcaatcttgagaagtatttacaagtttgtaattctataccatgcactagcaatgatcactttaaacaggctactacacagataatataaaactatgcataatttctacagtaattccacttccctttcttctgctcaagaaattactggatttcaagtgaccgaaattatagtgataactttgactttgtcaagtttcacacatcgtggggccatgatttgagccagggcagtctgactctgaatttgaacagtgtttaattgccaggaacaaaccacagggaaaacttctaaacagaagaatacagagcaaaaggaaatgcctaggattgttctttctaaattctcaacatttcccaatacaaaaagtattatggtataattacagttctataaaacaatgtgctctatgtataataaaaataccagcaaaataaagagattacttccctaaatttgttagataattccacaattgccaatttcgctctgtttgttgagatctgatcttggtttcaaattttaaaatttcactgtataataaaatgagttcc

SEQ ID NO: 245477 - DNA, 750 bp, Homo sapiens
ctgcaataaacaaatggatgacattcatgtggccaacagagaataatgggtgttcccacattttgaaacaagaacaaatttcctgttggaaataaaaaaaaaaatagggctacagagctctttttgcttttttttttaaagtggcaatcttgagaagtatttacaagtttgtaattctataccatgcactagcaatgatcactttaaacaggctactacacagataatataaaactatgcataatttctacagtaattccacttccctttcttctgctcaagaaattactggatttcaagtgaccgaaattatagtgataactttgactttgtcaagtttcacacatcgtggggccatgatttgagccagggcagtctgactctgaatttgaacagtgtttaattgccaggaacaaaccacagggaaaacttctaaacagaagaatacagagcaaaaggaaatgcctaggattgttctttctaaattctcaacatttcccaatacaaaaagtattatggtataattacagttctataaaacaatgtgctctatgtataataaaaataccagcaaaataaagagattacctgaaaattgtaaatcgaaggacacattcacataactgagatacaactggatttttccctaaatttgttagataattccacaattgccaatttcgctctgtttgttgagatctgatcttggtttcaaattttaaaatttcactgtataataaaatgagttcc

SEQ ID NO: 245478 - DNA, 357 bp, Homo sapiens
gagataagccatcaggtaacctgagtgggaggaaggggcatcctaagcaggaccccagggctgggtttgacgttgcccctaacctatgtggagggactgacatatatatgcaactgactcatagcaaggtgctcttagctttgggaaatcagtcctccatggtggaattccaacgtagatactctctgtctcccagttcagacccaacacacagcccattgtccttctctgtaaattcgtatgtatcaaattgaaccatattaaatttctgttttattagttaaaatggtcaagtattggcaattttgcatggctcaacttattgaataaagtatcttggataggtattaatctcca

SEQ ID NO: 245479 - DNA, 373 bp, Homo sapiens
gtctcaagcaatcctcccagctcaatctcccaattgttgggtttctgactgttagccaccacacatggccttattattgtcacttctaggccaggttggttgagtattcactttcctgggacccatctcccaatttaccaggtggataatgcctgggtcaccttgaagtccaaaattggagacaccataaccacgctggagacaccaggagcaacccaagtccctgagtcactagctagaggacagccacagagcattacccaacctggaacatccaaagtggacgttgatgaggaaaatgtaaactcttagtgtgtaaagtcactgagatttgggggttgtttgttatagcatgagcctaatacaagaagta

SEQ ID NO: 245480 - DNA, 413 bp, Homo sapiens
actatctaggagagctccactaacaagtcccaacagatgattttgctggtccttaatgaaccagctaagattggctagatttatttatgaaatttgattaaaaattagttctggtaggccgggcgcagtggctcacgcctgtaatcccagtactttgggaggcagaggcgggcagatcacctgaggtcaggagtttgagatcagcctaggcaacactatgaaaccccgtctctactaaaaaagtacaaaattagccgggcgtggtggcacatgcctgtaatcccagatactcaggaggctgaggcaggagaatcacttgaacctgggaggcggaggatgtggaggatgcggtgagctgagatcatgccattgcactccagcctgggcaacaagagtaaatctctgtctcacca

SEQ ID NO: 245481 - DNA, 302 bp, Homo sapiens
aggctctagggggccccccagggtcctgtttcccgcggcccgcaacttatctgtgcacagagcacccccacgctgcgctaggaacttccgctgctcccccaccacctcactccttcgtgcctttgagcatgctgcctgcagtgcctgccctgatctccggctgggtgattcctgctgcacgtcaaaacccactggaggcaacacctcctccaggaagccttccctgatgccactataatggcccctcttgagtttccacagccccctgtgtctgcctcatcattgcagtgactgccaacatg

SEQ ID NO: 245482 - DNA, 421 bp, Homo sapiens
aactttttagcactatgtttatcccatcccataagctttggtttattatatttttattgcctaattccccctgtgatttctttagcccattggctatttgagaacttattattttccatatatttgtggattttgcagctttcatttattgatttatagtttcattccatcctaatcagaaaaaatatttcatatggctttaatatttttaaatttattcagacttgtttgaatattggagactgttccatatgcattgagaagaatgtgtatgctgctaagtggggtgttccatatgtgtttgttaggactaattggtttatagtgttgttcatggcctctattttcttattgatcttctatctggttctatccatgattaaaaatggggtattgaaatgtccaaccattactgtagaac

SEQ ID NO: 245483 - DNA, 208 bp, Homo sapiens
agaactatgcgtgcagcatagtcagtaactatttgttgaatcaatgaatgagaaaacaatatcagggaactctaagttgaaatacactttctcagttcacaatgttatccattctgacctttatcagacacaggcacagaggacctcagagatattcccagcagtctcaatatccatggtaatgctaataaactactattctggcatt

SEQ ID NO: 245484 - DNA, 413 bp, Homo sapiens
agagagcctaagtatagtaaaatagaggaaattacaccattgtactcatcccttaactgtttactgtggacaagaaagagcctatttgcaatctttagtgcatcatgatcattctaagaaaggatagaacctactaattgcatgaagttatttaattaactggttactgcatcagtctgatagatcagccttacagggtaacataatctaaaattttgatatatggccatgtttacaagtaataaaaataaaagaaaaatcataagatacctgggcccacaatgatttattctgggttgatagtgaacaaggctgatttgattcatttttctgccagaaggaaggaatcgcccataaaaacacaaatgagagtagttctctcctcgtgccgaatcctgcagcccgggggatcc

SEQ ID NO: 245485 - DNA, 630 bp, Homo sapiens
aaaatccagcatcttttgttatttctcctggtattcttttttgtatataaatgtctgtaatttgcaatcattttttattctgattaacttcatctatagctttacaccaaaaggaaaaagtaacacaggaaaagtaatcccatagatctataaattttactgcttaaacatacaaatatatattaaaccacaggtattagagacatgaattgcacccaacacaagcttgaagaattttaaacttagaaatttactttccagccagggcaacatggagagaatttgtctctacaaataataataataaaaaaaagtagccaggcatgttggtatgtgtgcctgctgtctcagctactctggaggctgaggtgggaggattccttgagcccaggaggccaaggctacagtgagctgtgttcctgctactgcattccagcctgggtgacagagggagaacctgtctcaaaaaaaaaaaaaagaaaaagaaaatgattttattctctaaataagcacatgtagttgagtttgtgtgtatgagagtccactgtgcaaatgggaattctccaaattaacttccgtgtaaaaatactgtatttatcaaaggacagctaataaaaaatcctaatatga

SEQ ID NO: 245486 - DNA, 896 bp, Homo sapiens
agaagacgcaaactcatccgaagtgacggaaagcaggtcactggttgtctgagtgggatgggccagaggagagaggagtcaggattacgaagggggcacaacaaggaaacttggtggggaggatatgaatatccttttttttttgcttttttagagacagggtcatgctctgtcacccagctcatagctcactgcatcctcaaactccagggcccacgggatcttcctgccaagcaactgggactacaggctcagcccaccatgcctggctgttttttttcttttggtggagatgaggtctcactatgttgcctggggctggtcttgaactcctggtctcaaggaaatcctcccacttatgactcccaaagcactgggattacaggcgtgagccaccttgcccagccatgttcattatcttgattgtgtcagttgcctctttggtgtaaaataggtcgaaatttactatgttgtacactttaaaaatctattaataggttaaataacatgaaataattgttttttaattcctaatatttgcctagggaatacaaccaacctcttcatcacatgaagacatttttttcatgcttttccatgttcctgaaatgccctcccctaggagcttcctccaatttatctactctttcacattcaagaaggtaatggagttccatcttcctccattaactcccccatactgaaatctgctatatctttcattcatttgaatcttattgttacagtacatacgatggaaatctataatatttttattgctatagttatcatttcagttgttatgttttctgcttatttttgtatcagagttgaatcaagatgtttaagtctctggagagttaagtattttgtaggaggaagaatatcaaggttgt

SEQ ID NO: 245487 - DNA, 451 bp, Homo sapiens
tggagccacagcctctggagcagccgcaacagcccatggttgtggtgtattgagggtggagcaggtagaggagcaggtgagagggaggtgcaggtgtggagctccctgagcctggaccctttatatccctgcccagggtcatgtgtgaggctgggcacacatttcctggttcctgtttgtgccatttttagggcccctttttcttgtttcctctagaaatccgccccttggtgtatgggctgctcagtgggctgctgctctcttgctgaatctgtgtccagacttaatggaggcccccaagggtctagcctctccctgttgactccagagtcacactggatttacaaaagcatctattttaggctgggcatggtggctcacacctgtaatctcagcactttgggaggcctaggcaggtggatcacttgaggtgaggggttggagaccagcc

SEQ ID NO: 245488 - DNA, 395 bp, Homo sapiens
gggcaagacgcctttgttctgccttctagggtataaccagctctgctcctgcttcattaatgtctataagtttgttacaaagacagaaactgacaggaaatgaatttagggtagggggcactgacacccaaagggaagtcactgtggacaagaccctctgggaggctggcagagattgctgccacgtggccatggcagtgtgcgctgtgagatgatcccagatgtctgcacagaatcccttcctggaggtggagagggttgacacccttgtaaaacacagggaacagacctgctaacctcatttaatgccttcacactctgtaaggccagaaactaatattaatatcaaaatacaagttttaaagtgtgtcagagatgatgttcatgcagaatgt

SEQ ID NO: 245489 - DNA, 1716 bp, Homo sapiens
ggcacgagggaagatggcttcgtttcggaagctaacgctttctgaaaaagtgccgccaaatcatcccagtcggaaaaaggttaacttcctagatatgtctctagacgacattataatctataaagagttagaagggacaaatgctgaagaagaaaagaataaaagacagaaccatagtaaaaaggaatcgccttcaagacagcaatcaaaagctcatagacatcgccatcggagaggctactcaagatgcagaagcaactctgaggaaggaaatcatgataaaaaaccatcccaaaaaccttctggattcaagtctggacaacaccctttaaatgggcagcctttaattgagcaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcaatctgagagatctcatggccactcagagagatctcatggtcactcagagagatctcatggtcactcagagagatctcatggtcactcaaagagatctcgtagccagggagatcttgtggacactcagagtgatctcatagccactcagagagatctcatagccactcagaaagatctcatagccactcagagagatctcatagccactcagagagatctcatagtcactcagagagatctcgtggccactgagagagatctcataaatcagtcagggagatctcatggccaatcagaaagacatcagagatactcaacaggtaaaaatacaataactacttaatcatcagaacaatgtgttgaattctgtggaaatagaaaagcatatatctatattctaatggctaaatatgtatttgttgaaacatgtatattgggacaaagacataaatattagaatggaggtaatacatacatagtatcaatattgtttcaacttgatgtcctctaagctatcatccagttacccaagatgtcccattaagttgttcccggtaggtctgctttccctggaagagccgtatgtactcagcctttcctattgggccttccccacaattagaatattttgacttagtgtcctgtcccccttggacgttccaacttgacttagtgtccagtgccccttggacattccaacctggtaggtaagctaatctaacaactaactgccaaattgataatatataatctatgataatgaatatctcttttgtgtctccttcctaagccatcctcagagagtccttagcagacaaatggtagatgtatctttgggcagctgaacttttctgctttcctcaaatcagaccatatgagaggatatattctatgcatagatgtaatgctaaccttctgaatatattttgaatacatttatatattcactgttgccttataaaactgttagggtaggtctgtctaccctagcaaaagaaacacagaaatttaaatgtactgggagttatgttgttaaaaacacaagatatgttaactgcagtttgtttggttattcaataaaagttttagttttaatttctcagt

SEQ ID NO: 245490 - DNA, 1372 bp, Homo sapiens
gaagtgtggtggagggtccaggtcttctgaccattcagtgcaagccaaattgtgctaatttccaatttttctccctttctcttggtgagctatttggtgctacttctactcctcatgaccaaagctggctttcatggtttactcatgtacttactgatgaaaccctcgtcagggcagtaccagttgcacccatagtccggcctgaatactcagcttaggactattgtgtccaatgtcccaaacattttgaagctacatcttaaagaagtgtcctgctcagatgcagttctccttgtgaaatccgcaggccccaaggaaagtgactttaatccagtttgctcatgcaagaacagactggcatttcacatccaggaaaacaatggatttgtactgttcagcttttgccatgcaaggagttcctggtgtggtttattaatttacatctcaggctccagcttcactatcaatcagatttggaagaaaaaagttacaaagaaaggcagcttgctgagaaacagcggaagcatgacggtacagactgggttttgaaatggagacacattctcatggcttgtgggctgagagacactgagaaaggattttgttcttgaaagatgattgttttaatgctggagatggagagttttgacaattttaagtgcatgttctgtgtgtaagaaagagtcattacgttttttttttctttcagatgttgccatgccttaaaattgctgatgattaaaatagaacatcctgagttacagaaattcagccctagtgtatcctggcctaaaaatacagaacaatcaagttgattgttggaaatgagaggctaggcagggttggaaacatgctaatgtttactgagtgaaatctttccttctcagtagagttgcccttgcagctgaaagtcactgaaagactcaacaaaataagcagatcccacttgtctcactctgttctcctatgcatgccctggaaagagaatgaatgagccctttttaatttatcaactggttttcttccatctctttactagtgagccatgggggttttttgccgttaactgggtagccagtctcttcatggagacttattttcaggaaactagcctcttgctttatgtgaaaacaaggacccaactcaagatgtcttatcacagtgtgttctgttgcgtaacagttgcatctgtagtccagcctcaatactcaggttgggactgttttgtcctgatgtctcgaacatttcaaagctacgttcttaaagaaatgtcctgctcagatagagctctccttgtgaaatcctcaaaccccaggggaagtgaccttaagccagtttgctggcttttcatgtcacagaaaacaatcgactg

SEQ ID NO: 245491 - DNA, 404 bp, Homo sapiens
taagaaatgcattcattaaaaaccaggtaatcactttggagctggtcctggcagtgtctgaataaattggacaagttagagaaaatcttgaacctgaaagctactttgtctttcagcttggtttgggcaaggtaggaagagatgaatcagttataatttgatgggatctaatgttacttttataagatacatcactttaatatgatgcttcatcattaatgttttagtaatctgacagcattagacagaattgatattccccttattttattatttcttggcttcatgacagaactgtgcattaaaaggcacttaagattttaaaagggatatctaagaaagtggttaaaactaattgcagatagattttattattcacagtattgtgtcaagtctcctgtgca

SEQ ID NO: 245492 - DNA, 562 bp, Homo sapiens
catatcaattttaggattgctttttctatatctgtgaaaatgccatggtattttgatagggattgcattgaatctgtaaaattgctttggataatattatcattttagctatattaattcttccaatccatgagcattaattatttttatatttaattctttcccttttttggtgttctctacaatttctttcatcagtgttttatagttttctttgtatagatctttcacttctttgattaaattgattcctaagtattttatattctttgtagctattatagatgggattacattcatgaattttttcagattattcactgctggtatatataaatgctgataatttttatgtgttgattttttatcctacaactttacggaatttgtttatcagttctaacagttttttggtagaatcttaaggttttcctaagtacaagatcatgtcgtctgtatataggaaatcctaaatcaaaaacctaaacctgaacaaggctaatttgacttttttctttccagtttggagcctgggcaacatatggaaaccctcatctctgca

SEQ ID NO: 245493 - DNA, 437 bp, Homo sapiens
tcaaagtgctgggattataagtgtgagctaccacaaccatccgattgtcagtgatactctaataagagacataggttacaaagcaaaggttaataatggtgctgtttaatttaccaagtagagatatttcatagagatgtttcaaactagttttaagttctgaaagtgatatcagaggctgtccaacacagagaataagaaaccagggtaaaacaggaggaaacaggtgagaaagtttttagtgggttaaaaatgattgatctttgaaaggccagttagacatactttggaaaacaaaaactacttttggtgtgaaggaggacataatcttcaaaactgcatgcttataagcttctgtagtctataaaccttcaggaaacatcacaaaatgtatttgcaaattccataaagtttaagaaaaaggcacggggaaacaa

SEQ ID NO: 245494 - DNA, 828 bp, Homo sapiens
gtgacatgatcttggctcactgcaacctccgcctcctgggttcaagtgattgtcctgcctcagcctcccaagtagctgggattacaggggtcctccaccatgcccagctaatttttgtatttttagtagagatgggttttcaccatgttggccaggctggcgttggactcctgacctcaggtgatctgcctgcctcggcctttcacagtgctgggattacaggcatgagccaccatgcccagccaagaaattgatttcattggtccagggtggataccactatattttaaaactcctcagctgattgtaactagcagccattgttgagaacctatagcatcacactacatgaatgcttgttataaatggagaatctcaaatcctatcccagtcctactgaatcagaatccgtattttaataagatcccaagatgctctgggctttgtatgcacagtataattggagaagcactgtctagactaattaaatatctaccagtggccacagagtctactaggactgtatttctcaaaatgtgattccaggaccagtggcatcacctgggaatttgttaaaaatgcaaatatttgagctccaccctagaccttctgaatagaacactgtgggagtggagcccagtagtctgtggtttaacaagttctccaggtgattctcatacataatatagtttagaagcattgcgccaggagtctctcatgaggtttgaaactgctgaattgaggaaattgattcagcaagtccttttttaaaacacatactcctgaagtgaagtgtcattgatgtctgcaactttcaaatggtttagc

SEQ ID NO: 245495 - DNA, 344 bp, Homo sapiens
acattagatcttatctttaagaggtggcatttcttagcagaccatattctttcttagattaaaagaatctccaacttgtttttcaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgtaagtcattttacagttttgatatcaaatggcatgtcatgggcagagaaaaattacttaatagtttccaaacttccattt

SEQ ID NO: 245496 - DNA, 480 bp, Homo sapiens
gccactgccttctcccagcaggacctgctggatggggccgttctctatagccacaatagcagcctcagcccccgtgacaccatggccttctctgtggaaatggggccagtgcacacggatgccaccctacaagtgaccattgccctagagggcccactggccccgctgaagctggtccggcacaagaagatctacgtcttccagggagaggcagctgagatcagaagggaccagttggaggcagcccaggaggcagtgccgccagcagacatcatattctcagtgaagagcccgccgagtgccagctacctggtgatggtgtcacgtggcgccttggcagatgagccacccagcctggaccccgtgcagagcttctcccaggaggcagtggacacaggcagggtcctgtacctgcactcccgccctgaggcctggagcgatgccttctcgctggatgtggcctcaggcctggatgctccc

SEQ ID NO: 245497 - DNA, 587 bp, Homo sapiens
attgataaaagggctctactttctggcatctaacaataaaagggaaactcagctataatattattcataattcatatatgcatattattactattcacaagtacaacaattctatgtcatgacatgaagtaggaatttatgctactgtgcagaggaaggagaggaaaaggagtagtaattataaagagaatgcttcagaaagcctatgaaacaagagcactagcgggcattaatttagactgcaggcaggaaaacaaagtgcaaagcaatagaagcaattctctttgttaaaaaaaaaaaatcaaatatttacctcaaccaaaataaaattttaacaaagctcctaaacatgctgtttcatgctatatcctccacaacactatgaaagggacactaaaataagtaaatgaaacattttgttgaataagattattattcataattctaccaaagactgtttgaattttaaaatactggctatgtggcccctttttcatggttgcaaaggaccatgtgccccactagctgcacccagagacaaccatcttgtttccttcttgcagaagctgtttctactttggaatttc

SEQ ID NO: 245498 - DNA, 597 bp, Homo sapiens
tgttggatagcaggattggagaggcagagattctaaggccagcagattagaacaagattacagtaagcaattctcaaaactctcagtctctggggaggcaaggagaggactggttgtcccgagccggcaggctttgctcatttctcagaatcactgggacaacagctctggttggcagagggccacgtcgtccttcagccaaagtacacatagcatgtggtcctccccatctgtaactctagagtctagatcaactgaacaaaaggtgattttgtaatgtcacccttcatcaatcagaacattagaaaatgtgattatcagtgggagtttttggctgacgttttcttgtaggcaaaccaagagaaggaaaccatttctgcacatggataagaatatgttgttgaagcactttcatcgaaatcagcactaattagaaattcttaggacagaacatcacatcagtttatagtcatccaacatatagatgaggaaaccgaggcccagagttgttaaataactcggctgtggtgtagtgagataatgtagaactggttctagttctacattagaaccagctgagttatttagaactcagct

SEQ ID NO: 245499 - DNA, 585 bp, Homo sapiens
ttcctttcatatttttttcctgttatatttcatttttatcttctccttggtttttaaatatactcttaaaatttaaggggtgtggttttcctagagattaaaatatcctttgtttaagcatattacagccaaccatgaattaacattatgcatccttacatataatatgaaaaacttggaacagtttacttccattttccattttcattcttattgaagttattataaattttattttttatacattataaaccagagtacattgtgattcatttttcttcaatcactttttaaataaattaataaatgtgtaaatgaaactgtttttatttatttacatattttggggtatttttcatttcttcttaccaatttgagtttccatctagtatgattttcttccagcttgatgtacttcttttactattttgtatagtacggatgaacttatactaaactaactcagctggatttggttgaaaatatcttcatttggccttaatttttgcaacataattttactgtgtatagagttctaatttgaaaaagttgttttcatctttaacacaaagatagtattcaacc

SEQ ID NO: 245500 - DNA, 546 bp, Homo sapiens
agataaatctagtttgtctttgaatttcaaaagttggcatctcccagctggaatccttgagtgggcctgcattcatatatattcagtacaagcataaacagcatcctaattaatgaatttgttaattcattttgccagctgagaacaaaaaacattgtttggtctctagccattgtgtgtgtgtatatgtgtgtgtgaatttggaatccccagatttcaaatcactaaatcagcagattacatagtctcttcagtccttcaagacttctaaaaggcttggagattatttcttataacggttaattgttaggaactacttttcgttttaaactgcatactatatagcctatataatggatacatagattgatacagaatgttggttatgtctttgtattttcttttcttttttttcctttttttttttttgagactgagtctcattctgtctggagtgcagtgagccgagatcgcgccactgcactccagcctggtgacagagcgagactccttctcaaaaaaaaacaaaacaaaacaaaacaaaac

SEQ ID NO: 245501 - DNA, 541 bp, Homo sapiens
gatggagtctcactctgttgtccaggagtgcagtggcgtgatctcggctcactgcaacctccacctcccaggttcaagcaattctcctgcctcagcctcccgagtagctgggactacaggcaccagccaccatgcctggctaatttttgtatttttagtagagacggggtttcaccatgttggccaggctggtcttaaactcctgacttcaagtgatccacccacctcgtcctcccaaagtgtaggattacaggcatgagtcactcattttgagtgaatgaattaatacattctattccaggtccctgctggaacaacttgagaaaattttcatgaagacatatttgcattttgaacaaactggtagtggagactgtaataattgactcaaatgattgaatccctatgaaacttcaagacattagaaccccatgcagataactattctataagtctgtaagggtggccctggctgtataatatgtaaaatgatagtttatagtaatttttagaatgaatatttttgctttttcttcactta

SEQ ID NO: 245502 - DNA, 255 bp, Homo sapiens
cgccgccgccgccgccgccgccaccccggctggagagcgctgggcgcgagctgcgcgcgcggaccgggccactcggtcgcggctttcgggggaggaggaggaggaggttttttttttaccctcggcggggagggggtaggcaggaaacggccaaggcgaagccagggccccctccctggccgagcgagggaccgccgagaccctggcggccggacggcggcgtgggggaggggcacgtgggggaggggcggccgc

SEQ ID NO: 245503 - DNA, 541 bp, Homo sapiens
tttcttaagtacagataaggcatggggaaagatatatattcttgagcccttaaactcataaaaatacaggtccttaaaaactaccagtgtttttaggttctgaacccttcatgctttttaagttcctaagaatcaatcactttatcatgggtagcaccttctatagcagggatcagctgactttctacagaggaccaaatagtaagtaaaggctttgccaagccacatataatctctgtcatatattcttattgttgtttaacaacccttaaaaaatgtaaaacaatcttaccttgggcaagatttggccttcgggccatggtttgtttacctctcttgtagagggctttcaagtgacccaagtgatgaaagggtcatgagtaaatgttccttgaataaatagtgtatcatagcaacttgagaatgtagtggtggcttctacttttaaacattatttaaactggagcactaagaaagaaccaagaaggaagtgaatgtagctgattatatattcaagtaactcatttagccccttccccca

SEQ ID NO: 245504 - DNA, 140 bp, Homo sapiens
cagaaatacatacatgtatggtcaattgattttcaacaagggtgtcaaatgggagagaaatttctcaataaatgttgccaggacaattggatagccacctgcaaaagaataatgttggacccttacctcatactatgtac

SEQ ID NO: 245505 - DNA, 677 bp, Homo sapiens
taaaaataaaaatgttttatggccaggtgcagtggctcatgcctgtaattccaacactttgggaggttgaggcaggaggagtatttgagttcaggagtttgagatcagccagggcaacatagcaagaccctgtctctattttttgtataaaaattatttaggctgggcacagtggcttacgcctgtaatctcagcactttgggaggctgaggcaggtggatcacctgaggtcgggagtttgagaccagcctgaccaacatggagaaactccgtctctactaaaaatacaaaattaactgggcatgatggtgcatgcctgtaatctcagctactcaggaggctgatgcaggagaatcgcttgaacccgggtggaggttgtggtgagccaagatcgcatcattgcactccagcctgggcagcaagagagaaactctgtctcaaaaaaaaattatttaaaaaattaaatttaaaaaaagtgttttgtttctctactacctttgtggaggggatttctgggttggacaagatcttggtttttttattttctcaatttttgtgaatgaaggtaagatgactggcagtttctgaataaagtggacaactgaaggtctgtgtccacacagagtcaggtaagagaccctgatttttaaattccagctgttgctactgaataacat

SEQ ID NO: 245506 - DNA, 1033 bp, Homo sapiens
taaaaataaaaatgttttatggccaggtgcagtggctcatgcctgtaattccaacactttgggaggttgaggcaggaggagtatttgagttcaggagtttgagatcagccagggcaacatagcaagaccctgtctctattttttgtataaaaattatttaggctgggcacagtggcttacgcctgtaatctcagcactttgggaggctgaggcaggtggatcacctgaggtcgggagtttgagaccagcctgaccaacatggagaaactccgtctctactaaaaatacaaaattaactgggcatgatggtgcatgcctgtaatctcagctactcaggaggctgatgcaggagaatcgcttgaacccgggtggaggttgtggtgagccaagatcgcatcattgcactccagcctgggcagcaagagagaaactctgtctcaaaaaaaaattatttaaaaaattaaatttaaaaaaagtgttttgtttctctactacctttgtggaggggatttctgggttggacaagatcttggtttttttattttctcaatttttgtgaatgaaggtaagatgactggcagtttctgaataaagtggacaactgaaggtctgtgtccacacagagtcaggtaagagaccctgatttttaaaaagtctcccatctacctctctacttgtttggaatactaactggatgataccaaattcaagctgttgctactgaataaacatgggaagtacaggctctaaaatctcatcaagatcaccattaggttcatggtagaaaaatatgggatgccaggaatgttgcctgtaggtctctcttgaatggctaacatatctctcacacatttggaatggatatacacatcagatcctagtcctgcagtggcctagggatagctcttttgatttggataaattaccgcatttgcagaagttctcggaagggctttatgtcaagcaaatgagttactggtatttgtgggatgaatattattctaagaggaaacttaaaagtgatttagataac

SEQ ID NO: 245507 - DNA, 503 bp, Homo sapiens
aatgttggttttctattttgcctgttactaaaagttcatgcaaataataatgtccagaagtttaggggaaagaatatttccacaagaacgaagagagagatttcactaattgtaactaagctttgttcttcccgaccctctatttctgcttccagaagctgagactcaggttagcatctcactgtatttctgtgaggaggagatattggtgcaagctctcaagcagacaagcaaaatccatccctatccaacaactcctacctattgagcaaatgatttaaaaagtggttactgtgccatcagaaaaactgttggggattgatgtgtctctttttgttgaactggctgagtagataagtacacagaataacttataccatcactttatatttacgcttacctaatatgatattgttatagctgtcttgtgaaatcaagttgttttcagcttgcttctgtcattcttccttcttctttgtgattaaatagaaacaaatgatgta

SEQ ID NO: 245508 - DNA, 374 bp, Homo sapiens
accttgggcaaagcactaaaagtaagctttaccgtctttaaaagggggaagtgttgttgaatgtgcctgggacaatgtctggcatataataaatgttcaggctggactcacgcctgtaatcctagcactttgggaagccgaggcgggtggattgcctgagctcaggagttcaagaccagcctgggcaacacggtgaaaccctgtctctactaaaatacaaaaaaattagccgggcatggccacgtacacctgtaatcccagctacttgggaggctgaggcaggagaaacacttgaacccacggggtggaggttgcagtgagcagagactgtgccattgcactccagcctgagcgacagagtgagactccatctt

SEQ ID NO: 245509 - DNA, 476 bp, Homo sapiens
cagctgctatatccagttcacacacagcgcttccagtgaatacctgtgggctgtttgggattctcttgttctcagattgctcagatgctctgtggcttctctctgctttcttcaacagatactgataatatctagtgcttgaggttggatgctacttggagtggttcatagagaatacttttccacctagttatgttgtaaatgtttcccatgggtttttggatttgctatctgcttgctgtgtttgtgtgtgttgggggcagagggaatcaggaaggtctagaactgctgcttctatcctcccagaaaatccagatgcactaaattgataacctgatgagtggtggcaaaaagtcagacagtcatgtttgaataggtttacaaattatatttaagaaaaatattattttttctataaaggtagggaaaaggctaagcagtcattcactgcttcttaataaaaattctttaccaga

SEQ ID NO: 245510 - DNA, 437 bp, Homo sapiens
ggcatttcatattgttgaaagcctcataggtgactcacgtgctacatgcatgatgaagagagatttgggaggataagttgagacctactttttgattattttaactgagaataatcaagttaaaatagagattgcgttgagctagtttgtgtcagacagtgtgcagagtccccaaaatttgcaaaacagcactattttatattccattttgggttttttagtattttgaattctgaattgcttatttctttagcacttgttagattttataatacagtataatattaaatcctcaaattgtacttttaaaatttaagctaaaataccccaggactggtaactaatactttcacataaaagtcctccttaaaggatctaaggaacatctaatcttgttttagctattctccacatccctaaccctggactttgctcag

SEQ ID NO: 245511 - DNA, 589 bp, Homo sapiens
tttttttgtaccacactcatctctgtatgaaactccactggcacaaatgttagatatttcttggtattatctcaggggatcccaaggctctgtccattttcttacagtcttcttcttttagtctgattagataatttccattcatgtaatttctgtctccaaatccactgactcttttctttgtcacaagcactctgcttttgaacatatccagtgattttcttcaaatttctaattattgtattttccagttataaaatttccatttggttcttttttatagcttctttttcttaactgagattattatttcttaaagcatggttataacagctgttttaaaatcactgcctaatataaaacatctgggtaatctcagggttggtatcttgtctcttcccttgagacttaatcagactttcctggttctttttgtgtcaagtaattttgtatcatatcatgaacatttgggatataagatgctatgagactctgggtcttgctccaattctatgaagaacaggatgtatttgaatctgtcctagatgtgcatcagccaggagccagcctgatatctgggtgggctatc

SEQ ID NO: 245512 - DNA, 687 bp, Homo sapiens
cactctaagaaggaattcattaagataaagacacagatacagcatttagagttacactttgccataaaagagcctcccttacctcctgacttgaatctataacatctgctgaactgtcgacatcaggaagactcgaaatatgttttgaggccaattatgtcatttcagattgaacctgctaacatcagattctttggtcagtagtctcactagttttgttctcacaatggaattattattttgatttttaaatgttgctccatggagactggtatgatgagctcatgctctgcagttccattttaacaaataacataatagatcgctgtcaaatgaatgccatcacagacatcatgttgggtcacagaagccacaccctaggagtgcttactagatgatccatttccatgaagctcaagaatggaccgaacttactaaaggtgatagaagtcagaataatgtcttccgggtgggaggggtttgaggctgtgaactgagcagtggcacgagggagccttctggagtgctgaaaatgtttcctagatcttgacctcggtgctggttacatgagtgaatccatatttttaaaagttatcaagctgtaaatttcaggttagtatactttatccatttcctgtgttttatatctcaaaaattcttttaaaaactaaaagacatttagaaatg

SEQ ID NO: 245513 - DNA, 234 bp, Homo sapiens
tatctgtaaaagacaccctgaatcctttagatgtgggtggggtgcagaacaattatttattagttgtggtattcaccagtgtaagtaggctgctccaaatctgatccactaagatgttttgaaatgactttatccaagaaagggaactatggagagactatcctggaattcttaaggcttatctcaggctcaagtgctagtctcatatcttgagaagcctaagatacatgaata

SEQ ID NO: 245514 - DNA, 1020 bp, Homo sapiens
atggtagtttaaagactagcagcaaggtaggatgtttcctttttaaactttcctgacattctttctataatgtttacatctatcatgagcctttcgtcttatttttatactctttctccttatcacttaatctttcccctcccttctgctcagcatttaaataggattcagttcatccattattcctgttgtcttcttatagcaatataaacacttaggccgttttttttttcatttgctatgaaattgtcaaattaacaggtgccctgcctattcaaagggttatgatgataagacaaaacaatctctatgaaagcacttgttaaccaaaaaatgcaacgtaagtgctaagatgtgatcattatttttgaaggaactgtgagatttgctcctaatattataggtattttttaaacaaaatctttaaacaaaatctagagttatcatctacattttgatggagcaaaaggagatttggctgagtgctcagagaaaatgtctattttgaactgttacgatacgtaaaggtgagcaacgtgtgccccaccctatgttgttagtttatataaaatagtgttttatttctataacgtgtttcgttttaagcagaagttatttcagattatagatattttgcctgttactgctgttttgcagtttttatggttctacatgtttgttcctgacattgattttgctaaataaaagttacagttctataaaaatttctgtaaagaatgttaaaactttctcagtgtttagtgtttctctgagaaaacaattaatatacagcacacatctttagagcaaaataagaaaagaatgcctttgccagctgcagtggcccatcctggtagtcccagctactcagaaggttgagacaggaggattgcctgagtccaggagttcaaggctatagttaatgtgctatgatcgcacctgtgagtgccccactgcacttcagtctgggctacacaggagaccctgtctcaaaaagaaaaagattggcaagatgatgta

SEQ ID NO: 245515 - DNA, 546 bp, Homo sapiens
tcttcctcccctttgggcccgtttctcaccagggtctccacagtggtcagagcaactccagctcctggctgcttggaactctccctgctggtgaccccactgacatcctccatggatcagatgggggcagcagagactgtgtccacaggaagtggacagctgtgactgcaggtggccccagcattttccaagacctgtaggagcccatcggtcctcattcgatctggaagtgattttcctagaagaattgggtattagcttctggaattatgagcaggaaaagcttgctttagaaactccaaaatctgatattccatctgaatttagaaaagcagacctgatcaaattcactatgtaagtaaaactacttatttagaaaaagaaataatagtcaactaataagttcaactacttctcctgcctctaaatttatgatggaaagttagagttgctggagacagtggctcccgcctgtaatcccagcactttgagaggcaaggcgggagaatcacttgaggtcaggagtttgagaccagtctggccaac

SEQ ID NO: 245516 - DNA, 325 bp, Homo sapiens
tgactgggactccctggagttttaatctcaaacttcttcacactgagcctctgacaagtcatcaagtacagtttaggttttcctgccctagcactagttccagagacttcggcttattcacctgtctgtctcttcaaatttgagggctaatagtttgccctgagaccttacttctctgacagatgtaaggattgttgacttttcagcttattcagctttttactggttgttaggatggagtggcaacttccaaactccttatgtgccagacctttctctgaatttttttaataacctccaattctaatttaatggatctagtaaa

SEQ ID NO: 245517 - DNA, 486 bp, Homo sapiens
atctgctccctgaagcccagttacccattcccatcattttcacctttttgtagacttccccctttcagagcggcagacgctggcatacacaggtcctgggcatcgccgtcaaggctgcccgccaggcagcttccacaaatcccaaaatgagcctttccttcttccttctaaaacagcatctccaccttctgtattatttatttcagtgaatgcctgaatctcaaacttgtacttcatcatggactccagtcttcctttcacatccaatttcaatgatcatcaatacagtcattttgctccttagcccactcggactatttctctccatacctgctgcaactgccttgacactggtgtgacagccttttaaaaactggtgtttggggctggtatcactccagtggattctcagacagctgccagaataactttgttcaagtagaaatccaaagcattgcctggtctatagtgggaaatcggtaaatg

SEQ ID NO: 245518 - DNA, 739 bp, Homo sapiens
gccatctctgatgggagcctctttagatctttcgtccatttactaattgggttgttcgatttcttattgttgagttgtaagtggtttttaatggtctggatgccagacaggtgttttgcaaatattttctccgtctgtggcttgtttctccattctcttatttcctttcccagagcaaaagtttttaattgtaacgacttcataccaatatcttctttcatggtagaaatttgtcttttatgtactttactgttgtatctacaaagtaattgccaaacccaaagttacctaaatatcccttttgttattttacagaagttttacagcttttggatttaaatttaggtctaaaaattgaattcataaaagtagagagtataatgatgcttaccagaggctgtgttgctggggagaaaaatgggaagttgttcacagatgcaaagattcagttaaaccggagaaatgcgttttgaaatctattgcacagcaggatgactatagtcaataataatgtactgtatatttaaataacaaaaagtaaatttcaaatatctaaccacaaaaaatatttttttgagacagagtctcgctctttcgcccaggccggactgcagtggcagggtctcggctcactgcaagctccgcctcctgggttcacgccatgaggtgatggatattttatcctcgatgtagtcattcctcattttatacacatatccaagcatcacattgtacccca

SEQ ID NO: 245519 - DNA, 793 bp, Homo sapiens
gccatctctgatgggagcctctttagatctttcgtccatttactaattgggttgttcgatttcttattgttgagttgtaagtggtttttaatggtctggatgccagacaggtgttttgcaaatattttctccgtctgtggcttgtttctccattctcttatttcctttcccagagcaaaagtttttaattgtaacgacttcataccaatatcttctttcatggtagaaatttgtcttttatgtactttactgttgtatctacaaagtaattgccaaacccaaagttacctaaatatcccttttgttattttacagaagttttacagcttttggatttaaatttaggtctaaaaattgaattcataaaagtagagagtataatgatgcttaccagaggctgtgttgctggggagaaaaatgggaagttgttcacagatgcaaagattcagttaaaccggagaaatgcgttttgaaatctattgcacagcaggatgactatagtcaataataatgtactgtatatttaaataacaaaaagtaaatttcaaatatctaaccacaaaaaataaaattgaggtgatgggtattttttattttatttatttatttgtttatttatttatttttttgagacagagtctcgctctttcgcccaggccggactgcagtggcagggtctcggctcactgcaagctccgcctcctgggttcacgccatgaggtgatggatattttatcctcgatgtagtcattcctcattttatacacatatccaagcatcacattgtacccca

SEQ ID NO: 245520 - DNA, 695 bp, Homo sapiens
gacggggtctgtgtggcgagggaggggacccggggttggagactggcggcgagcgactgctagatgcggagcaggtgcttgggaggggaagaacggcagcctacataaccatcgccgtaatgctctcgcaagcgtccacctgggcagggctcggtgccgggcaggcgcagctgccagttagctgcgaggcatggtcaggagccttcacccgtcctgggcgaaggaggctgtcccgtcgactaaaactctgatattaagacttggcgctgggggtggggagttgaattacgttaaaaagtcacttaagtgccttccaactctaaggagaagtacttatctgagctttggggcacacacaactactacttggcatggagagtttctcagcttcatgtgttccgtctgttattgaagctgtattggaaagtcggttcttgtttttatctgagcccgccgttttcatcccattcttttcgtcaaaaatatgttacatctgaaagaggcagatgaaaagattattctatgctaagagggttttgcagcccgataatgtcaccgttttttgttgttgttgttgtaggatcggggttcatttgcagtcttttttgtgggtgagcagaggcaggggccaataaataaattaaggcgggatatttggagttatttggttgtaataaaatatgtggttcaaccca

SEQ ID NO: 245521 - DNA, 452 bp, Homo sapiens
gtattatcctcttagatacgcacccgagagggttgaagacatgtattcacaaaaacttctacaaaggtgaggtagaaggcaggcctccattcagagatggggctgagatacctgaccaaattgaggactagctaaaacagggcctggacggaagctgtcttccctaagactcgctcaccagccagccaagtcagtttaccgttgccatggcaacactcgtgagttaccgcccctttccatggcagtggcaccataaaccaaaagttactaccccttccctagaaatgcctgcataaaccaccccttaatctgcatgtaattaaaagtgtgtataaatatgacagcaaaactgccctgacactctgcctaagagggtaaccctgctctgcaggagcagtcatggagctgtaacgccgccacttcaataaagccgttttcttctgcctctaact

SEQ ID NO: 245522 - DNA, 326 bp, Homo sapiens
atagaactacataaatattatgtttacgtatatattaatatgtttatttatataaatattacaaatatttatttgaggaagagaaaaaactcttccactcagtttgtggtgacaggtgagtgtgtgtgaagacagcctgctgggagcactgggcttcccacagctccgctcagaaccttcatgagggctagagccctggtcttgggcctctctcccctctcccagacactgtgagacctggcccaccttcctgtgagggccagtggttgtgcccctctggcttccactgctatgatgggggcccaaagggacatgatggtgagaca

SEQ ID NO: 245523 - DNA, 697 bp, Homo sapiens
actcaaacaagagaggagtttgcccctcatgcaaaagatgttcagggccattttctgctttaccaccatcagtatattgctttcattctcaaggtcacctcattgtccaagatggcagttggaacattacatcattgttccaggctggcaacaggaaggaggaggataggactctaccacttttcattacttagatctttttcattttaccacagtcaggtgcaaggaggataggaaacgcagtcttttagctaggttcattgctgtctcaaataattgaggcttctattacaatgagagaagggggaaatgtttatgagattgtattcagcagcctctgccccagagagctagagttctctttcctctccccagaaatgtctttatctagaattacttgtcttttccttttaccatgagaattcctgggaatgacaaggacacctacttttttatttggaaggctcttacctggcaacttgaaagttccataacacagtctgagaactgagaataaataaatccctgggacgtctcatttcttctttttctgagctactataatcatctttttaattgcttgtcccatttatttgcatttttttttactccaattcaacctacacagtgtggcaggattaatttttctgaagtaaatttcaagtcatgttatttcatttgtcaagaatcttaatta

SEQ ID NO: 245524 - DNA, 364 bp, Homo sapiens
gtttcaaaatttttcgaagtttttttggtcccatctcttttttttttggtcccatctcttttttttctgttcttttaaaaatgttttacattctcattcatggtcatccagttattcctcaggggaaaagggattttttggtattgaaatggagtgccctgaaattgttgaagattatttatagtattccatttacatattctcagtgatttaaaaactgctctttaaattaaggccactttgggccaggcacagtggctcacgcctataatcccagcactttgggaggctgaggcgggcgaatcacttgaggtcaggagttccagaccagcctggccaatatagtgaaagcccgtctctacta

SEQ ID NO: 245525 - DNA, 639 bp, Homo sapiens
gagcccagtccacgtgggggcgggccgcgcggcggctgtgtgacagctcggcggcgggggaggggccggaggggagcccctgagcgcggggccctcgagtactcggtcctgtcggaggaggccgacagacgcataaacaagtgcgactgtaacttgggactctgctggacgccgagctgaggagttagtcctcccgaaggtctgctaggggcgtggaccgaatctttgtacatgttttgggaaagccagtttctcctatcaccatcaacccctggagaccttgtgtgaactcaggtgtctgtcactgattatctaaggacagttcagggtacagacttcaggcaggagaaacctgggctctgctccttgccttgtcaatagccagctgtgtggctttgagcaagtcacctaatctctctagacctgtttccccatctataaaggactggacaaatgcaactctgaagatccccgtctgactccaaaattctaaggctctatgatttaacatttatttatagactacacacggtggaatcttgtgctggttgctatggggaggtggaggggcagtaagaatacaaaggaacgagtttctgtccaggtggaggtaaaatataaacacgacattttaaaatt

SEQ ID NO: 245526 - DNA, 404 bp, Homo sapiens
aacaagtgtactgctcagcccagagatactggtaatggggtaggttatgtatgtgtggagacgggatatatggaaactctgcttaccacttaattttgctgtgaacctaaaacttctctaaatataaagtcaatttaaaaattgcttcaaacttcttgtacttttaaactttatattacaacctcagtgttagttttgatctgcataatcaaaaagaaaagtaaaagcaactcatgggttggtagttttttcagtagctgtcaaagaatcctagcttaagtacagaggtgtttcttgggagctgtttgtactaaatgcaccaacaagggaaaaccaataaagctgtttaaatggtttcccagggaccttcgtgatgatggaatactacttgtcttataagacca

SEQ ID NO: 245527 - DNA, 152 bp, Homo sapiens
acggaagcatttttcatgacagctatatggtgaaaacagcccaaatatccaccagcagccctcccggagcagcacagtctaggattgggagctgtttcccccgaacaggctggaatggcaggctcagctggacgccctgctgtccttttccc

SEQ ID NO: 245528 - DNA, 373 bp, Homo sapiens
tcctgttccattggtcagtgtacctacacctttcttgcttctctcttcttgatagttacagttgctgtccagagaacatttgatatcttacaagtgaaacaaagatttaaaaaaatcagtaacaggacataaatgtgatagcaataagtccaggaaggaggtgtggaagtgatggtttcatgggaggttcattgcttcccttaaaagggccggttagtctggggtcagtaaaaggtgtgggtgtgagttagaatgccctaacactcgactgcggcaggtgcaatctgtcaccgagtagggaggagctgaagcgagtggaccgtgtctctaaggagtgccgtgtttatgctgcagccaagctcctcagagaaca

SEQ ID NO: 245529 - DNA, 426 bp, Homo sapiens
gccctgcttccagagaggctcctgccccatactctggaggaaggaatgctgcacagagagaccaagaagaatctgaacaggtctggcctccctggctttcctcatcagtgtatgaactcacatatgagatcacaccctttttgtccaatcacctttctacgtggttgtcaattttgcctataatgaaggttccattaaaaaccccaaaggatagggtttggggagcttccagagagctgaacacctagaggccaatagaaaggtgaagaactcatccatgtgctgagagggtggtgcaccccaactccacggggacaaaacctcctacattcagggcccttccagacctcgccctttgtatctcttcctctagctgtttatttaaatactttaaaatattctttgtaataaactggtaaacatacg

SEQ ID NO: 245530 - DNA, 242 bp, Homo sapiens
ggatgagcaccagatccagtttgctgtgccacagtggtaagtcacctaatctttatgtgcttggattcctcatatgtaatacaggatcacaactattgttctcactcatgcaatactactattgtgagaacctcatgaattagagaaactctgaatttgcaatttagctttagaacactgacaagtagctcattgattcttgcctcattcctctggaataaagtagctttttatcaaacaag

SEQ ID NO: 245531 - DNA, 818 bp, Homo sapiens
gttttcacatttttgagctttgccagtggcaccctctctaattaatcatcccgcgggcttagaaaacttctgcccaatcctttctgatttgttaaaagaaagagagaaggttttagtctgaaaaaggccttatctgataaacatcacattatatggatttttacatttaagtacattttctttttaaatccggtggctttcccaaactagaaagatggagtgtttgcatacatccaccaaccaccaacatcagcagaaagaaagcttgatacagtaaaggaaagaaatggcaatttaacagttcttttattttccattcagatcacatacacattaaccaaatgaggcctcacagcgtggaatctgatatcatagcaatgttttcaggaagcaataattgaatactcctcattaaaaaggttcataaaagaatcctattaaaaccaatacgaataataaaccttgaaaatgctgctttaaattccaagaggatggcgaagatctgcgtcagtaacagtcttcctgttcatagagtgattttgaaaatctcgtgggctgaatttttccaagccaagcaggcatctcactatccagtgaaagacccagggactattttgaatgcattcaatccaagcctgtgcctttcacagtcagttttctccaagaatttatccctaatcctgacaggatacccaaccaaaaggctaattatttttagtcacttaattaatagataattcttacaaagagcccaacacctgaacccaccaagtcctctttgcatgggcaaatccagctggtttgatgcactaatttca

SEQ ID NO: 245532 - DNA, 279 bp, Homo sapiens
aagggttaaatgagttaatgtgaaatgcttagaatagtgcatatagtacctttatgcacaggaagctctcaaaatgtgtcccatgtcatcttaatatctctggaaactctgtgctgagcatgactccggggggctgcagcgccgttagtgcccacggctgtctatttgaccgcaggctctgctctcacctggaagcctgacagcccaaggctgctgtgagctatgatcgcaccactgcactccagcctgggtgagagagtaagaccctgtctcaaaaaa

SEQ ID NO: 245533 - DNA, 433 bp, Homo sapiens
acattactggttgggtgtggtggctcacacctataatcccagcaatttgtgaggccgaggcggatggatcacctgaggttgggagttctagaccattctggccaacatggtgaaaccccgtctctgctgaaaatacaaaaaattagccgggtgtggtggtatgcgcctgtaatcccagctacttgggaggctgaggcagaagaattgtttgaatccgggaagtagaggctgcagtgagccaagatcgtgccactgcactctagcctaggcgacagagccaaaaaaaaataaaaataaaaaaataaaaaataaaaattctattttggagattccaaggattttaggagttgtatgccaggagacagggtggaagaccaaatacatagtcacagtattacaaaagtaatgcaaaagacaatctaaagaaaccatg

SEQ ID NO: 245534 - DNA, 549 bp, Homo sapiens
aaacagaggccttggtggcatagcggggccgagagtgcaggatgcagccactccagaaactgggaaagccaagaaagcggcttctccccttcccagaagtctccagaaggaaccagccccaccgactgtttctagacttttgactccagaattgtgagacaatgcatgtgcgttgtgttcagctcctgagtctgtggtcatttgtcaccgcagcccctggaggtttctttaatggctaaacactcgtggcctctgacaggtgtggaggttggaagtccaaagtgagcctccctggctacagccaaggtgtccgcagcgctggctcctcccggaggctccagggcaggactggctggcccttcccagctccttgactgcccgcccgtgcccctgctcacaccatggccccttcctcgagccacttggagccctcacccttctgcccccgtcacctttcccccatggccaacctccacggtggcagagacgacatttgagccatcactgacttcagggatttgcacacaagcccacgggtggttactgagt

SEQ ID NO: 245535 - DNA, 401 bp, Homo sapiens
tctctccatggattcagcagcagcgtctaaaagaaaaaaaatcatcaatcaatcatttatatatgttttaatataaagatataaaacagtggaaccagtggaactggatagaaagtaattcagttttacagaacacatctgtttttcaggctcttacttttcttaaacataaaagagccatatatatttctatggaattccccttttacttaagaattcattatcagcgaattagtgtaacgaggctgttttgttagaggctgtggttgcattcaaaaattagaataggaacaacgacttgtaaaaattcaacactttattttatttttgagacagtttcactgtgttgtccaggctggagtgcagtggcttgatctcagctcactgcaacctccccctcc

SEQ ID NO: 245536 - DNA, 458 bp, Homo sapiens
tgaagtatctcagtgccctggtgaagcagaggttctcattctcaaagtattgtatttttaattgcatatatgtgttcattggctataaattcaatcactcctagtttatcagagtaggagcaaataaatgagatgagttaatgttgagtttgaagtcatggctaaccttagtattgatatcatacatggaatgtgtttggttgatgaaccttcttagacctaattatcagcttcaatgcactccagccggggtgacagagtgagagtgcatctaaaaaaaaaaaaagaagaatgattttgcccttcacacttagtgcacacaagatagatgtatatgaatcccacaaatatttattgaccatcacctgctgtatgtcaggtgctttgctagatgctggagattataagacagcaggattctgcactccagccggggtgacagagtgagagtgaatcta

SEQ ID NO: 245537 - DNA, 587 bp, Homo sapiens
tgaagtatctcagtgccctggtgaagcagaggttctcattctcaaagtattgtatttttaattgcatatatgtgttcattggctataaattcaatcactcctagtttatcagagtaggagcaaataaatgagatgagttaatgttgagtttgaagtcatggctaaccttagtattgatatcatacatggaatgtgtttggttgatgaaccttcttagacctaattatcagcttcaactacactaacccagtaaccatagctattcagaacacagtgaacaaccaggcattaagatttttggggcctggcatggtggcttgtgcctgtaatcccaacactttgggaggctgaggtgggtggaactcctgaggtcaggagttcgagaccagcctgaccaacatagtgaaaccccatctttactaaaaatacaaaattagccaggcatggtggtacatacctgtaatcccagctactagggaggctgaggcaggagagtcgcttgaacccgggaggaggagattgcaatgagctgagatcatcgtgccactgcactctagcctgggcaacaagagcgaaactccatctca

SEQ ID NO: 245538 - DNA, 481 bp, Homo sapiens
tgaagtatctcagtgccctggtgaagcagaggttctcattctcaaagtattgtatttttaattgcatatatgtgttcattggctataaattcaatcactcctagtttatcagagtaggagcaaataaatgagatgagttaatgttgagtttgaagtcatggctaaccttagtattgatatcatacatggaatgtgtttggttgatgaaccttcttagacctaattatcagcttcaatgcactccagccggggtgacagagtgagagtgcatctaaaaaaaaaaaaagaagaatgattttgcccttcacacttagtgcacacaagatagatgtatatgaatcccacaaatatttattgaccatcacctgctgtatgtcaggtgctttgctagatgctggagattataagacagcaggattctgcctttttggagcttacagactagtggggtgcgggggagaaaacaagtgagtaaatacat

SEQ ID NO: 245539 - DNA, 696 bp, Homo sapiens
atctataagatgagtgatttgaagcagatatttatttagtttactatgtattgtctgttggagcatattactatatagtctatattactaataaatatcattaactagtaataataatggtaacatcgagaggtacttgatattctgtcaggttggacaagtgtgcctcttgaagccttgaatttcttacctgtaattgaggctgtcttacttgtaatttatcactaagattgtttctcggctttaccatcctgtaattctctgtgtcttaaacatatttgtactataccataatcataaatatttgtgctatgatttcaaagagaaaattctggacatcttttgttgaaatatcaaaatgaaaaatttatgttaaattgttcttgagaacaataattctatagattatagtagaaaccttaaaatgagtaaaatattaagtccatgggagcacaattttatagagtggatttttagagcaacttgacttttgaaagtatgggtttaactatatgttaaaacaccctgctgaggaaactaagaataaagaaagaaatgttttgtaatatagttgctgacatattaattgcttcactcacttttgctctggaaatagcttcatagcacagttcaacatgattgaaatattgataatttttttttttttacagttcccggttttcagcctaacttact

SEQ ID NO: 245540 - DNA, 244 bp, Homo sapiens
gatgcaattgagatatttgccaggcggcttccctttcttagcttggggacctcttgcatgctcactggttgttggcagaattgacccggttgtggttatgagacaaagactgccattctcttgctagccatcagccaggacttctcagctcctgggaactacccacagtccttgccacgtggcccccttggcagttcactgcatggctatttgtttttttccaggccaacaggaacatctctga

SEQ ID NO: 245541 - DNA, 383 bp, Homo sapiens
tatagtattctagccaacattttatttttacaaatagaactctttagctagatcaacagaaagattcaatatctatttcattaaaattatttaacccctgctgggtgcggtggttcacacctgtaatctcagcactttaggagactgaggcaggcagattgcttgagctcaggaatttgaaaccagcctgggcaacatgacaagacccctgtctctactaaaaacacaaaaagttaacctggcatggtggcaccacccgcctgtggtcccggctacttgagaggctggggtgggagaaccacttgagcccagaagttgaggctgcagtgagccatgatcatccactgcactccagcctgggcgacaggagtgagactgtatct

SEQ ID NO: 245542 - DNA, 492 bp, Homo sapiens
gcagtcagcacagtgggtggtcaccatatgtttgctgtaagaggaactcagtgtccacagcaagtgcggtcagtgctgcattctggatccttccctgtgccaggccctgagctaagggctgtgaaatggctgtgtccctggcctcatggagcttccaccctcgaggcaaagatggatttcaaagaaatcactcaaatgattacatctggaatgtacctaacccccctgggcaagaggctcctgctggcatcttagatcccatctcccggccccttcctgtgacctgcttctcccgccacatctcctttctcttctttgaattggccaaggagggtgtgaccacctgcattgaatgccactgagagatgcaataagatgggggctgagaactgaccactgggatttagaaaatatatttgatttcttaaaaaacaatgttcatgtgtgtggcttttgagattaaaagatgaaaatatttcataaagggtgaaa

SEQ ID NO: 245543 - DNA, 624 bp, Homo sapiens
atttttgtgaacaactcttttcctctcctaagttaataaacttagtgaatgcttcactacattcaaagattcagaatattcttttagaagctataatgtaggcaatgggcgaatcaatgctgacgttttataaagagctgatttcattgcacaggacttgcaagtctctttggaaaagggatccacatttttgtgatttattaaatatacaaactatagccgttatagtttgtttcaggtgtttatcatatactcaaggaagtctctacataaggccaaaatattcagatgagaagtgaaaaaatgtaatcacctacattaagtcaagcattggaatgttttggaaaaatctagaagagcaaatttttgtatagagaatttggcaacacttagatacaacgaacaatgtctggcagaaaacgtgttttatttggagagctggcttaccagcagatggctatatattatagaactaattttgtgacatcacattcatatgcaactcatatatttaaaatatgagaatataactaaaagaaaagaataatattaaattctccatgaaacaagctttttaaaggtaattgaccaaaacgactttgaaaattttactgaacaacaaac

SEQ ID NO: 245544 - DNA, 377 bp, Homo sapiens
tcatcatatgatcattgtggcgtgtttcagtttggactccctcaagagcagatttggagacaaggatttgagggcaaatagtttcttagggaggtgaaggaggttaagggagtgggtaacagaaagagggaaaggaaggcagcccaaacggaatgcatgatttagccaactaccaagttgaacaattggggctgaccaaatgaaactgttagacttctggcctgcactccgtttcactgtgttaaacataaaaacttctattggtcatgaaaaatgacagaattaaattaattccgattctatttcttcatatttataatcactgtgctatcattgttaatttataacctaatgtttacattttttaaaaaaagatg

SEQ ID NO: 245545 - DNA, 406 bp, Homo sapiens
agagaaaaatattcccagcattgaaatatccccatctttatcccaggagcatagtttgggaaacagtcatttgggaaataatgcttgaattgtccctgtatctaaattcatgtttccttcgtcattgtcttcatgctgatttgaaactggaactctgaactgaactggaagattagaacattttaattatagcctaaaaggacattagtgcgactgtgaatcatgaagtgggtggggaagaaaggagataaagacaatacatattcttcaagcacatgctgcaggtttacaaaccctcagctgccttaaaattcgcaatgtttttcagacccttagctatccttttggctgtttgcctagcttttgttaaccaatacctaagtgttatttgaacttcagcttgtta

SEQ ID NO: 245546 - DNA, 135 bp, Homo sapiens
ataagtgtctctgtttctttattcgcagagtttttgactgtacacaatgtttgcaacagaaaaatctcaacaataacaacaaaaaagttaacttcagaaaaataaacaagtatttactccattaaaagttattac

SEQ ID NO: 245547 - DNA, 291 bp, Homo sapiens
tttgctgttcccttgtgcaatttgctagctgtgccaccttaagcaagtgatatcaccttgttagactttttaccttcaatatggggcaccctactcacaagctggggcgcagggatttttaaacaaataagatgaacagaagaagcatcctctcaggaagaacctgaggctggaggtgccactggagaagatttatagtttttccagactaaaagaattgttcaagttatttgttgtttgtttgcttgtttttgtttctgcagcctaaaataaaactttcaaatacaataa

SEQ ID NO: 245548 - DNA, 507 bp, Homo sapiens
aacaatgtggatgaacctgaaagacattgtgctaattgaaggaagtaaaacacagcaagctacatattctataatgccatctgtacagaattctagaataggtaaagccagtgatttaaaatgcaccattggtgtcctggggctaagggaaaggattgactgctcaggggcaaggaggaactttttggggataatgggaagttctatatcttgattgtggtggtggttatatgactctgcaatttccaaaactcaaatttcacacttaaaatgggttagttactgtatgtaaatttatacttcagtaaagctgagaatagaaggagagaaaatgcatacaggagaaaacttagaagaaattaccatagtattttatcgttgactgcattttggtgctttatatatattttttatttttctaaattgtctataggattaattataagcatttaaagcttgagatttgtaagtaatgtgacttacagctaaaaaataatggttttattc

SEQ ID NO: 245549 - DNA, 659 bp, Homo sapiens
ggggttgcaatccttgtctctggtaaaacagacttttaaccaacaaagctccaaagagacaaagaagggcattacataatggtaaagggatcaatgcaacaagaagagctaacaatcctaaatatgtatgcatccaatacaggagaatacaagattcataaagcaagttcttagagaccgacaaacagacttagactcccacacaataataatgggagactttaacaccccacagtcaatattagatcaacaagacagaaaattcacaaggatatccaggacttgaactcagctctggaccaagtaggcctaatacacatctacagaactctccaccctaaatctacagaatatacattcttctcagcaccacatcacactttttctaaaattgaccacataatttgaagtaatgcactcctcagcaaatgcaaaaaatggaaatcataacagtctctcagaccacagtgcaatcaagttagaactcaggattaacgaactcactcaaaaccacacaactacatggaaactgaacaacctgcttctgaacgactactgggtaaataacgaaattattagctaggtaaataacagaaatgactaagtttttaaaatgaatgagaacaaagacacagcctaccagaatcactgggacacag

SEQ ID NO: 245550 - DNA, 490 bp, Homo sapiens
tcttatgtttagtaaggtgtgaaaactggttaaaacctttcccacattctttacgtttgtagggtttctctccagtatgaattctcttacagttggtaagggttgagaactggttaaaggctttgtgacattcatcacctttgaagggtttgtctccagtatgaattatcttaagtttactaaggattgagaatacactaaaacctttgccacataataacatttgtaggatttctctttagtatgaattttcttatgtctaataagggttgaagattggttaaaggctttgccacattcttctcatttgtagggtttctcttctgtatgaattcttttacgtttaataagctgtgataaccagttaaaaactttagcacacacctcacatttgtaggaattatctctagtatgaatgcttttatgtcatgttaggtgtgaaaacatgcaaaatgatttgccacattctttacatttgaagggtttcttg

SEQ ID NO: 245551 - DNA, 557 bp, Homo sapiens
ggcccataagtcttttatgtgaactgcttatggttggaaacttaaacactgtcactttagctcagcacttgtttattgacatactttcctatgtgtatgtactgtgctaggaactgagtgagccctaggtaaatgctggagccaggggagataaaaagagagtttaattcttgtgttctctagctagttattgattacttgtagctaatttcataagaaactcttggaggaaactgaagagtagttgtaggttctacctggatgtgacaggattctatgtgtatgcctggatatgaggacagcttgttgaatactgcctgttaatttgcttttgggtggatcacgaggtcaggagttcgagaccagcctggccaacatggtaaaaccccgtctgtactgtacaaaaaattagctgggcatggtggcaggtgcctgtaatcccagctactcgggaagctgaggcaggataatcacttgaacccgagaggcggatgttgcagtgagctgagatgatgccactgcactccagcctgggcaacagagcaagactccatctc

SEQ ID NO: 245552 - DNA, 659 bp, Homo sapiens
agagaagtgaggactgcctgcttttctggtctacgcgtgtgtgtgtgctgcactgtgcctggcactgaggctggtggtgactgtgcactcacaggccaccctcaccagacaaccagggagtggaagatcctgcccatttgagatcagttcatacctcggcatcgacgaggctgacaggcagctgactcgatgctgacgatgctgaccagacctgcattttcctggctgaccagccctgcattttcccggcctctagagctctgaatcctggagctagagggcaacctaggtcttctctgtcaccttcccaggctgaggtccccaacaggcactatcagcttgacctgaacattcagtgctggggctggtcctgcctccctgtgtacacaatagcgtcatagcgtgcaggcaggctgggcttccctctccacccatgcactgatgagaagcctcggccagcggccgtcctgcccacctggcgtggcctcacaggcatgctctgggggtaggtcttattgcgaacaatgcctacgttgggtcccgggtctttgggcacagcataaccagtgccttggtgagctctgggtagacacggattttcacccttcctcctagggggtgcttcctggctctctggtggttgatagagatcttctcag

SEQ ID NO: 245553 - DNA, 568 bp, Homo sapiens
ttttttttgtagacagtctcaccatgttgcccaggctggtcttgagctcctgggctcaagagaatctcctgcctctgcctccctagtagctaggactacaggtgaataccaccatgattttctgtagatatggagtcttgctacattgcccaggtcggtcttgaactcctagcctcaagtgatacttctgcttcagctttccagagtgctgggattacaggtgtgagccattgcatcagcccagtttttttcctttttaagagacagggtcttgctatgttgctcaggctggactcaaactcctggctcaagtgatcctcccacctcagcttctgagtggctgagactacaggcacctggcttcaactgattcttaacaagagtttgagaaagaaaaagcctccccaacgtctggaaactgcttgaacacttacagctggacctcagtgctgtttgaagctggcctagggatcatagggaggccatattattctcctgtgggacataaacaatctcgcaaaatatcaacatgagacaaggtcactctgagactgtgttcaagtgagac

SEQ ID NO: 245554 - DNA, 236 bp, Homo sapiens
tggggaccaggtaacacatctcaacggtaaacttgtcaaatttcatgttgaatttacacagtgaatttttaatttacatacattttaggtaacaaattttgatacatttatttgtatcagaattagacattttagaaaccaagaaaaaattaagcaaaaactggatacctacatttcagtgactatcaacctgcgatctcaacactccatgtgcccatgctgttcccctcaagatg

SEQ ID NO: 245555 - DNA, 484 bp, Homo sapiens
gaccaggccatttttcattcttttaattgcaatgtgatgggaatttcagaacacaggagaacagatcctgatcaaaagatttcttgtgctttttattccttgtcaattctagtagcaggcaatttctagataagatctatgctctctccagtcctatgcctaagagtattccacctttttattaccttccctggtacaagtttcgtgggctgatactgaaatccagttgcataatttttctgccttatttaggatacaaaggaaaaaggtgtcctcttaatctgtagaaggaagcccatcaagaaagcagcaagcatgatccctaagccaaggacattggcagagtcttctcattcttctttaatgcagatttcagcctttgttccaggaaaggtcccatctcataatctttcctcttgaaaaggaagaaaaaaaaaccaaacaaacagtggtctgaggagctcccattaaagacactgagagt

SEQ ID NO: 245556 - DNA, 326 bp, Homo sapiens
ccgagaggaaaacgttgcctttcttagactgtcacaggaaggtcagagggtctctggatggctaggtgggacggtgacacaaactcatttggaagcagtgagttccctttgatttttgtttgttttcactgagaaaaaagtaagtacatcagaagggcaagggaaagtttacatgcagctcagcagggtagcgatgtcgcccagcgtgaaaacttttatttgctggcagctccggtgtagggcaagctggggaaggttacccaagaagacccagtgcccacaggacaggtaatgatgggagctcctggaagttttggtttcaacct

SEQ ID NO: 245557 - DNA, 829 bp, Homo sapiens
gcgcccagcttgcatcagatgccctgtgtgtctagaattccctcccaggctgttagagccactcagcaggcctggcgccttgctccggcaaagggcctcgggtgctcgcctttgcgatggacacaggcagccttgagacaggcctgcccggaggccctgtgccctccacaccgctggcatcggctcccactgcccctcccacccagactggccctcggatggctgagtgtggggcacctgataggctctctgccccaggccagctggagaggctgaacccctagaaagtgtggccccaaccaagaccggctcatgccttccctgccccatttccccagaaggcagtgccctgcagtggcaggactaggccttgagccggttgccaccccagctgctcagggtgctgccaggtggtccccagaagacagcacctgatgcagtgtccccaggggagcagggtcagccatggagcgggggcgcatgtgtgggttcctggggccggagtgctgtcagctcccgagagactccgagagaggcctagaagccacaccgggccttgctggccagcctttgccttggcccttcaacgccccatagtgtagggtcaacctggcaggcacccaggaggggaaggtgcagccggaagcagggaggaggcaggaagggctgcttccctgtgacctccagtctccctgtgggaaccagcctgccttcctgggagtcctcctggccagggagccagcccagcctctcccgggtctccgagtgctgatctcctcgtcttgggaggggagcagaggctcagagcagtcagactcctcaaaccagg

SEQ ID NO: 245558 - DNA, 429 bp, Homo sapiens
ccactgctcatgcttgtgcagcctattacagtaatggaggtgaggcagatgagagtttccgaggaaccgatctccccggagtagattcagtgcctagaatttctacggaagccacctgagaagaaaacaggtctatctgaagtcgaatgtgattaacaaaacaaacaaaacaacaacaacaacaaaaacacaggcagagctatataacactcaaaaaagacagaaaaaaaaccctaattctttcgtatcactttgggaaatactccatttcccactaaaaatcagtgatgaaaacaatcccctaaggtggctgaaaactaagggaactccaaatttagctgaattgtcacagtgtctcaggattgctttgaattattttttaagtgtaagtttatttatatataatttaaacttagaggaaaaacatga

SEQ ID NO: 245559 - DNA, 460 bp, Homo sapiens
tatgaggtaagtattataatccaaattttataggagtgatcagcctcaaatctttacacagcagtaaatgttggaggctgaattcaagtcctaatccaaatccgggtttctttctgctacacagtgtctcagaagtattaatctttaaccaattgttttgtacttgtctacaatttatagtagttctttccagcttcacttagttctcccattcatttgctgtacaattgtggacgagttgtagatgtctttgtgcttcagtgcccctcctttgcaaaagacaaataatgagcctattgcctagggttgctgtgaggattaaatgagctaatatgtataaaacacttaaaacagtgcttggctgtgcttaattagtgggagttttattgtaaaaatgtctattttttttctatgtggatctgcagaaaagtttcataggaaatacaaaacaatagccaaa

SEQ ID NO: 245560 - DNA, 461 bp, Homo sapiens
tgagctggagttttgctcttgttgcctaggctggagtgcaatggcgcgatctcagctcaccgcgacctctgccttccagttcaagcaattctcctgcctcagcctcccgagtagctgggattacaggcatgcgtcaccacacctggctaattctgtatttttagtagagatggggtttctccatgttggtcaggctggtctcgaacttccgacctcaggtgatccgcctgccttggcctgccaaagtgctgggattacaggagtgagtcaccgcgcccggcccctattggttttttaaaggcaactgggcaatcttatgggcacccccaagcatttcttttcaccttcttgacatgttcttcttctgagtccatctctgctcccctcaaatttttggcttcacaaccctgactttaactctgatctttggacttcgtcttgaagattcggaatcttggctt

SEQ ID NO: 245561 - DNA, 524 bp, Homo sapiens
gaccaacagtgattagacaaaatgttacaagggcagcaaagcaaactgacaatcatctctcatttgaaatctttcaatactagagctaggggtgtctcagggtgaaaatctcaaacctattctccaaggaacattcaggcagccacatcacaacacagtctcgggcaccgacggcacctccaccacgcaggagccaactctgctgtcagtgaagtaacaaatccaactaaagacaaaggtagtaaaactgcagctaattggcatgaagcacaaaagagatttggaactcccatacagattctgcacccacctttaaagagtctacaaaagaggagaacatcttaaagtcggctaactttgcagaaagcaacaagtttggagcacactgcctcaacagtttcagtgcacagtgaaaatcagaaatattataaacaagaattgagacattctaaagtaagactagtgaaatgaatgtagaagaacagagaaagcgtattactcctaagactaatgaggtctttaaa

SEQ ID NO: 245562 - DNA, 515 bp, Homo sapiens
gcttttgaagttgtgggaaggcaggcggattgtccccaaaggaggtgcccttagttgatgtctgtcatcctacacaggtggggtcttttatttcatggccagggctctcaaaggcttccttttggccacaatgagagaaatctgggggtgagtgagtgtcctcccaggtaaattaatggtgggtctgtaaataaccaggggccccagactgaaatcgggcaggttgtaatttgtcagatacctggatgcctgttacctgtttctttttattctgttatcctctagcatttggtaaactttgatataaatattgtggccgtttctgagctactttattgtaagagaatagttgggaatctgtgattaggctagagttataaggggaaacaaggtctccctgagtgcaggtggggcatagaggttttaaatgggaaggaataggtgataagaatatgtaagaggttcactctacctccatttgaagacagaggtttaacgttatgaagactgtcaac

SEQ ID NO: 245563 - DNA, 791 bp, Homo sapiens
tttggaatttccttaagaagttctcatagcagtacctgaagtattaatttctagtagctgtgggtttctgtggacgcctagagaaaaaaaagaccacaaaaaaagtctgtttcgaaaatcgactggccaggagtttgtttgtttttttttcctgcttagaggcaccaccggaggactgtgtaaaggaaactgaaaactacaggttgaagagatgaacaatggagtttagatttttcgcaagaatttcgagattttaaaaatagagtcggggaacaggagtttgaagcttggggagttggaatgtcactagagaacaaaaggccggaaatgtttccatgataaaaaatggttaaagaaaaatcccaggagttctgttgtcttgaaagtcatagaaacaacttaaaagtagaaaatggttaggtgttacggctttctcgtcgttttgcttccgtatgttaaacatacagcactcaccaacgttgaaatgggcattttccgctgttggaacagcaaatctgttaatttcaagttgctccagagaaaacctgagctgtccctttaaggggttctgcttttcctatttgtgttggcatttgaaagattgtggaggcagaaaactttctggaatgtcaaaaaaaaaaaaaaatgctggaactcttaaattgagtatttccaaatgtgagcgctaaggggcgccagttattttttaaccatggaaatggttggaacaaaatgtgtaacatactcaatctgactgacctatattaaatttagttgaaacttaagttata

SEQ ID NO: 245564 - DNA, 439 bp, Homo sapiens
agggtggaggtgcttgataaggatggtcatggcattttttgcagactgaaatgatatttgaaaactaaatctaaatgctagcctgtgttacagctacttacccgctgaggatcaaacgtacatttatttgccctattgcccaacttatggctatgccagtaatgtcctctttttttccttatcatttcttttcagcttgttttcccaaactgtggtgttgccttgcccttgagaacccagctgaggtctagactgtttcatggatcacctaagcttggagctacagttgggctgcaaagttgttcctctagtgctgatacaagaacatagctggtcctcttgttcatagtggtaaaatatttttaaaatctgacataaacacaacatattaattacagaaatgatggagagagaataaagctgggaccccacaaagtca

SEQ ID NO: 245565 - DNA, 419 bp, Homo sapiens
gaaggtcctagggctggcagactacacttccatcacccaagctgcttattacagttatttctgattaccacccccctttcaaaaagctctggaatgcaataaaaataaggactggggggtgggggtggcgcaggctcataaaattaagaaatccttccatctgaaatcgtgattccaggcccatgaagtaactcatttctggcctgggtgcctataagcaagaagcagggatgtcaggatgcctgaattatccaaattatttgggtcaaattaatttagactgtttgagaaaaggcattaatttggttttagatttcctggattagccctggtattaatttcacagggagtactttagaggacttttctaaactggaaaataaagccttttcctgtggctgtcaaggtcttccaaaaaa

SEQ ID NO: 245566 - DNA, 379 bp, Homo sapiens
tcgggggaggccaggcatctgcctttacccaagggctggaggcttttgtcctgcagaggtaggcccagccaagagggagctgcctcctgtgtcttcagagatcccgacactcaactctggacatcacccaaggccgaggccttgcacttctgctcccagctagaatgaactagcttgtatcagagcagttcttctgctgagaacaactggacaatttggatgaagcataagaaacatctgtgtgcagttgagactgaggcagacaggacaggtgtccatatctagggcccgatttcagcacgtgcagtagccctgggaaaatggcatgctgtttctgcatctctgtgctcctagtaaaacagcaaaactcctggaaaga

SEQ ID NO: 245567 - DNA, 515 bp, Homo sapiens
ccaccagaatctgaccctgctggacgtcgacttgagatttcttgaatctagaactgtgagcaagtaaatttatgttgtttaagtcattcagtctacagtattttgttacagcagcctgagctaatacagtaaggaatatgtataattgcatgcattttaattcctgcctttaaacaatacttttatctctttttaaaaattattattttatttttatgagacagggtcttgctctgttgcccacgctggagtgcagtggtacaatcatggctcactgcagccttgacctcctgtgctcaagcaatcctcccaggagtttgagactggcttgggcaacatagcaagaccccatctctacaaaagattaagaaaattaggcctggtgatgcatgcctgcaagcccagcggctcaggaggccgaggcaggaggattgcctgagcctagaaggtgaggctacagtgagctgtgatcacgccactgtgctccagcctcggtgcaagccctgcctcaaaaa

SEQ ID NO: 245568 - DNA, 412 bp, Homo sapiens
ccgcatgttctcactcataggtgggaattgaacaatgagaacacatggacacaggaaggggaacatcacactctggggactgttgtggggtggggggaggagggagggatagcattaggagatatacctaatgctaaatgatgagttaatgggtacagcacaccagcatggcacatgtatacatatgtaactaacctgcacattgtgcacatgtaccctaaaactttttgttttataataataaaataaaataaataaaataaaataaaacactgtgttagcaaaacaaaataattcaatcagtaaataaatattcctctttcctggcactgatttagtaaatatgaaatgcatatactttctctattatattgaaaagcatattttattaagctagcctgcgttagacaaa

SEQ ID NO: 245569 - DNA, 547 bp, Homo sapiens
gagattatagagctggatttgtggttaaaagagattatttaatggatttaaattccattcaacctagttgataacctgtaatagtaatatgtaaatccctctgagtttttcttcaaaaactctgggataatattcacctaagaaaattaaatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttggttttgg

SEQ ID NO: 245570 - DNA, 711 bp, Homo sapiens
aggaagagagggtttgcacacttataatactgagatgtaagttccacaaggacaaagacaatgttttgtctacttcatttttcctaatatctacaacagcacttggcacattgcagacatgcaataaatagctattgaaaaaaatatgtttttatatcagtcacaagtacaatggatatagtataactgattatgtaatgttcaacatttgtacatgggattgagtcctgaaaatttcctcagtcagtgagactggaaacaattttggagaaagtattcttaaaggaggtatatacaaagacaaaaactagaaagtgagaaaacttagttgatcagaaagtgatctttacttttcacagatatcttgtcttcatagttaaactacaaatttcatgagaacagtaaatatgcttttgactattctcctttgcacagcacagaagggtaatactgaacccttatcatttaatatcccaaatgggcttgacaacttgtatctctcatgaaaggctctgagttttcccctcactctcccacgtagtcattgagacatctgttttgcccaagagctgcagagagccactccaggaggctggaggacccattaactttgtgcttcttgctcatcatactttacttcccattgacagaagaacagaggaacccactgagaatgtgggctctcactttgcttttcctgggataaatctt

SEQ ID NO: 245571 - DNA, 247 bp, Homo sapiens
ggagggaagtactgtgttggtttctaggtttgcaccattgaggagcagggttgaggcaggaggagaaagaagaatagagctaagagagtgtggtaagaaagaaatgccaagatggaatgggtggttgggagcacgtgaagatcaagagttgaagaataagaataggtcattggattttgaccttagtaactgaagagagcaatttcactagtgtgtagaggtaggcatgagactaggtgattaagaa

SEQ ID NO: 245572 - DNA, 389 bp, Homo sapiens
gctttacggatgtgtacatcaatgtttttcacccaatttgggaagcttttactccctttggcttcaagtattctttctgcccctttctttcctctttccttctaggataactcttttgcgtatgttgctatgattgttttctcacaggtttctgatgcttagttcatttttccccattttttttctcagttattcagatgggataaactcagttgatccgtctttaagttccttctttcttccacctgttcgaatcctttattgaaactcattagttaatatttcattttcattattggaatttttaactccagaatcaaattttttatgtctatgcatctttactggcattatttatttggtgagatattcttatactttcctttagt

SEQ ID NO: 245573 - DNA, 401 bp, Homo sapiens
gcagtggctcatgcctgtaatcccagcacttggggaggggaaagcaggtggatcacttgttggccaggctcgtctccaactcctgatctcagctggtccacccgcctcggcctcccaaagtactgagattacaggcgtgagccaacatgcctggccctcaggtagtcctttatagcagtgtgaaaacggactaatacagtctccctggtttctcacagttttcttccatttcattgctctgtccttgtctcacctgagttgggtatttcctcagagaatattaaatatttttgctgtcaatctagaattgtaattagataagttggcagccaaaagaaaagaaacttcatgaattataaagcccgatattaaatgaattttttgaacatttggtaaagttt

SEQ ID NO: 245574 - DNA, 193 bp, Homo sapiens
ccatttctactgcgggattgaatccctgttgctaagcttcaattatcagtttgttgtattgctgcaactcacggatctgaaaaactcataaatgaaaagagagagagacatcagcctgtcaaatgtatgtaataattttaacgtaatttaaggtagcataacaagttattttcaacctgatcacatttcttta

SEQ ID NO: 245575 - DNA, 535 bp, Homo sapiens
agccatggttttgcagatccccaaggttaatgtgctcaatggaggatcaggatctagccctatgagcatgttattaacaagcatagaagtgaattcccaaaagcatcactaagtgcactggtggtcgtaatctcatggctatgagcagcgtggggtaggcagagccaggggctagttgtttccattataagccttgtgatattttagaccatgtgtatctaatgctgtgataaagagtaaaatgtccagtcaggtgcagtggctcaagcctgtaatcccaccactttgggagcccaaggcgggagaaccacttgtgtacaggagttcctggccagcctcggcaacatagttagaccctgtctctatgagaaatagaagatgagccaagcgtgatggtgtgcctatagtcccaccgacttgtggggctgaggtaggagattgcttgagcccaggtagttgagactgcagtgaaccatgattgtgccactgcactcagcctgggtgacagttaagaccctgtctcaaaaaaaaaaaa

SEQ ID NO: 245576 - DNA, 347 bp, Homo sapiens
ttgtaataccctttattaataaactagtgaatgtaagtaaagtatttccctgagttctgtaagccactctagcaaattaaccaaatccaaggagtgagtcatgggggcccccggtttacagccagtcagtcagaggcataggtgacaacctactgcctacttgccattggcgtctgaagtggcgagcagtcttgtagaactgagcctcagcttgtggggccccacactatctccaggtagatagtatcagaattgaattataggacactcagctggtgtccactgaagaattgcttggtgttagaagttttgtgttgaatgagagtagagaatagtttgttttttcc

SEQ ID NO: 245577 - DNA, 271 bp, Homo sapiens
ctgagtatgatgctcactttatgtgcttaaagcggggactcagcaaataattgtggaaggagggaatgagtgaaatgagtgcataaataataagtacaaagaaagtggcgtaagtgtttaattcaaaacgaagtttagaccgggcatggtggctcttgcctgtaatctcagcactttgggaggccgaggaggaaggattgtttgagcccacgagttcgagaccagcctgagcaacatagcgagattctgtcttggcaaaaaacaaacaaac

SEQ ID NO: 245578 - DNA, 387 bp, Homo sapiens
agaggcaaagggattcattgtgctaaaatgtgttgactaaagagactcggacgaagaagaaaaggagccacggtgagacagtgaattcaaatcttcgagaatgtggatgaggaataaagttcactaagcaacctgtcttgagaaaaatgactctcatctgggtcttggaacttctgtgaagggcaggaacacagggatgaggcagaactgagaaagcacattgccaagagtgagatcaaccttctcttggggacttgttttacaccagagcctgcaataatctcaccataccagcttgtcacactgcttaaaaccctctcactgttagtggttatttaaggttatcttaaagtctttgggtgctttaaaactttatgttacagctac

SEQ ID NO: 245579 - DNA, 341 bp, Homo sapiens
cgaatttagcagaagcttttgcagacctcaacaaattccttgaaagtttgaaaacatggatcccaacatcaaaatgttttcattaatagagaacattcatggtgcattatctgcttacaggcgaatgtatgacagaaaaaaagagaagccaatcaaacaaaccaccatggacatatttccggaaagagtgactgttcacaaaaagagcttcaggcgggtctcttaggagatcttccagaagaagaaagcactgttataacagatggcagctccacgctgtgtgtttgtgtcttaatttttaacaaaatgtttaaaaaataaaatattttaaaaatggcaaa

SEQ ID NO: 245580 - DNA, 533 bp, Homo sapiens
gccagattccaccagggaggggggaaaaaagccctctccaagaggggtagaaaaagtgaacttcaagaatttttgagaaaaactgatttgcattggaggggaaactacaaatgctgactgcttcaatcatgcacaattgtggaaagaaagcaagatctgcagtgcaaattaatatattaaaagtcaagagaagtctactaggaaacaaatcattaacctgtattaatcctagtatatcccaaatgtttttagccctcaatttccctttttataatacatactgaacactctttgttacactgttgcaacgcattttctaaattccaaaagtaaaattattatttttgttgttgttgttgatttctcttctgttttttgatatttctattagccagatcacaaatctgtatgctggaatatcatatctggagagaaattctggtttgtgctgtaatagaaatttctaatctccattttgaacttctgtgatggaagaaagatctatcactaagcaataaacatgttttcatttt

SEQ ID NO: 245581 - DNA, 361 bp, Homo sapiens
agcggcagagcagtgtttccctgaacacaggtcatgtcatccggagcaaggaatgagtgctgactgttttatttggcagctcatgttgtttctcctagaacaaaaggttttcagaaaccctaaacctaggcactccgatttttaaaaaatcacctcagttgggtatttgaggaaataaaaattttttaaagactggagagtgatagaagggtcattgttggataacagtgccaagatgctttgtgctctagaagcagttttttctgttttgcctgtagactgctgtaactgagaataaggagacaatggtgttacagaaagctagccttttgttgtgaagaaaataaagtaaatggcatga

SEQ ID NO: 245582 - DNA, 426 bp, Homo sapiens
ctcactgctgtagtttatctgactcctccatttgatcctcagttttggaggtagggcctaatgagaggtgtttgggtcatggggtggatccctcatgaatggttggtgcaatctttgcagtaatgagttagtacttgctctatattagttcccataagagctgcttatttaaaagagtctggcactcccctctttatgtcatgtgcttcttccttcacctgttatttctgcacaactggttcctcttcctcttccaccatgagtgggaacagcttgaagctctcaccagaagcagatgctggtgtcatgcttcttgggcaacctgcagaaccatgagccaaacaaaccttttttctttaattacccagtctttattattcctttatagcaatacaaatgaactaagacactgaaaaatatcacaaa

SEQ ID NO: 245583 - DNA, 393 bp, Homo sapiens
tgttttctgtaacaaatcctagttgattcatgaatgctctatttcagcaaactagggatgcaatggaagccaggcaagaaatgagagaaaaatacatggatgagtcatcatcattcattcattcacgcatgcattcattacatgattcacacatataattatttattgaacatgtactatgtgccaggcactgtgttactgccaaaaagctctaaccttttatgaaaccagggtagtgatgggagtaaaacagagaaccgggaacattcactaatgctaatccctctggctgaggttcctctattgtttaccacgtttgaaatctctgataactgcctgaagggccttcatctctgtatcttttgcccattctctctgtttctcctgtgtgac

SEQ ID NO: 245584 - DNA, 563 bp, Homo sapiens
ttcccagcccatttccaactctacttgaactagctgcatttttttcagctttgcccagcagccctggtgagtgcaggcaaagaaggcagcggcctcttgcctcagaagcccgaggcacttcccagccagtccagggctcgctctcctgcccgcagctcgtgggcctgggtctgcagcgctttcagtggtctctgatgtctttgtccacctgcccactagggtctggccagatggggcccgtagccaaggccaatggacagacatggcttccaccccctcccagggacctgagctccagggaaggcaagcagccttttcctcacagacaccccttctgttgaagaccaggtgatagcggggacgggaggcacggacccctcaagtctgctcatcatttgcattgttgtgcatgaatttgcgtggagggttcaggaggctctgcccccaagtcctccccaggtgcaggcgcagggtacaagatgttctaaaaaatagaaacctggtggggggttgtcactgtgtgtacatttaaaagtaaactgtttaaaggtgtctagaaacta

SEQ ID NO: 245585 - DNA, 523 bp, Homo sapiens
acttggacgctggccctttgtgctccataagatggacttgcggaagctcttctctgccttctttcccagctcctgccctgaagtgagtgcccagcccctgcctgcgcactggatattagtggccatcctaggcccgagacaagatggtggaactcaggatgccagctgcctgggaggctgggagcccactactgtcctccaagacccaacgctctcagcaccctggactttcatttttccatttggaaaacgggcattccagcacccatcctcaaaaggccaatgcttcttgagaagggggatccagggttttgaagttcggccaactcggtgtatgtgccttcctgcgccttgcatggctctgggcaccattggaagactgcagatataaatgacaagtgatttattttgttttcagcctccagagctttagctttagagtcagataggcagagctgggtttatatatcatcctgagtaactaacctcagcatctgaacctcagtttattaattggtaaaaa

SEQ ID NO: 245586 - DNA, 788 bp, Homo sapiens
ggtgatgctgacactgctggttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcatag

SEQ ID NO: 245587 - DNA, 917 bp, Homo sapiens
ggtgatgctgacactgctggttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcatag

SEQ ID NO: 245588 - DNA, 210 bp, Homo sapiens
agagaggggactcttgctgtgttgcccaggccaatcttgaagtcctggcctcaagtgaccctcctacctcagcctcccaaagcaatgggattactggtacaagccacctcacctagctataattatattttgattcaaattaccactatgtttaactctgttgatttttaatattgaagaaaatgaaaattactgttgtagaaattcatg

SEQ ID NO: 245589 - DNA, 363 bp, Homo sapiens
gaccaatttccattaaggaaggaggaagatttgcaatactgtgacctccaaccccacagatttcccatctctgttcttacccaggaagtcctggtcatgtcatggccacatatgtttagtggaaaaaaacaccactgatacaactgtcattgtggaggtgtggaggtctggagtctctcataagcctggggttttgggtcatcagggcctgtggccaccttacctgggctgagcttgtggacaaggtgccgtgccagcctacacccctcagccagctgttctcggaagtcctgcccctgggagttgtcatgcttatccggagtgagaagagcctggagatgctgattcagtgagtgggaggca

SEQ ID NO: 245590 - DNA, 473 bp, Homo sapiens
gagtcttgctgtgtcatccagagtggagtgtaggggcgcaatctcggctcactgcaacctctgcctcccacgttcaagtaattctcctgcctcagcctcctgcatagctgggattaccaccacacctggctaatttttgtatttttagtagagatggggtttcaccatgttggccaggctggtctcgaactcctgacctcaggtgatccgcccacctcggcctcccaaagtgctgtgattacaggcgtgagccaccacacctcgtcggtttcataaaatactaaaggaaaaataatttattgattcattaatgacataagaacaaaaaattttgataaatgagagactagtgtgggacaaaattctcagagaatggcagcttttacatggtatgtcacaacaaagaaagaacaatttcagatgacagtggagatagaaaactctgtagcaagacggtctcaaataagagggga

SEQ ID NO: 245591 - DNA, 637 bp, Homo sapiens
acagagaaagaagttaaataatattgtatctggctccctgtaaaatgttggaatcatcctagaatgtttaattgtaacgctggttatttttctgtatgttgaattgaacaatgataaatactgagtttcaacagcagtacttattataacatactaaagctaatgtttgtgtttttattagggaagataggtatttggttatgcttccataaacagtgaagaaatttgtagatacaagttcctgggcttatgttatagatatacttacactgtattctaagtgttactctcgtttttcttcatggttcccgctacattcttttgcttggcctgctgcattttagcagtaaaaatgtcctttcagcctggcacacctgtaatcccagcactttgggaggccaaggcgggtggatcacctgaggtcaggagttcaagactagccaggccaacatggagaaaccccgtctctactaaaactgcaaaaattagccaggcgtgttggcaggcacctgtaatcccagctactcgggaggctgaggcaggagaatcgcttgagcctgggaggcggaggctgcagtgagctgagatcatgctactgcactccagcctgggtgacagagtgagactccgtctcaaa

SEQ ID NO: 245592 - DNA, 428 bp, Homo sapiens
aacatttctcttattctctgatgtgggtattgacaagcaatgatgccgatgcccaacatgtcagatttgtcaaggatgctccctccctctgccatgaatcaatggccagctcacctccttggaaagccacaggctctctcttagagagtcaggacaaattcaacattctccccaaatcccaagccaccagaggagaggagatgaaatctctgcaaactttacactttgctggtgaaaatctccaagtctgccctaggatactgactttggtgcatttagcagagctacatggagagaagacagctgtaaatggtgaattcagaggaatgggcttcagtctcctttaacatgatgggatgtatccatttctttggtacaggttgttttctagctgtcaataaatactagcatacgtttttgaaagtctt

SEQ ID NO: 245593 - DNA, 391 bp, Homo sapiens
tcctgctatgccaaatgcaattccattattcagagtgacacattttctataaagcaggccatctgaatgcaagccacctacttctggtgctcaacaacaaccaaaagtgtgtttcaaatgctatagggaaaaccacctgtgttaggttcactgtgggctcttaggctaggattttaatccccttcaatttcactttcctactttgtaaaaaggggaaaatgtatataaagtacttaggataatgcttggcacatggtaagtactcagcacattttagttaattatcatcatcatcctcattttcagtcacagttaaagatttttcacaaactgatcagggcaaaagaagccttccttcagtatgattttcctttaaaagttctaaatgctc

SEQ ID NO: 245594 - DNA, 754 bp, Homo sapiens
ctgctgcatagtaatccatggaagacgtggtgcagggggcttccatgagctatctgagcagtggcaccagcataactgcactgctttggccctctaggtcaggggatagcagctactgacatcaccctggcctcactaggtaaccacaggcccagccaaaaatccacagtggcccctaaggcacaatagcccccatgcattttatcctaagtatacttgttttgggtgccttttaggtaagccttgggataaaggccctcaaagcattgaagtttttactaatcaggggacttgcagagctaactcttaatgatttatcctctaaatatccaggcactaaacacttcttcctccctacctttggttctgttggccacttatccataccttccatgggagggaaggtaaaaggatgtcagaccgagcaaaagagagcagattgaaatacaaatgggtcattttgatttcttgtcagccgctcttgcaaaagagttgggggtgtgtgtggaggggagcagtggactgaaaaaggttgtcagcatttaccagtggaggacactcagcacaccctccccaaggcctgccataaccacaggggtcagagttggttgtgatgcctacaggataaacgtcactgaaaccctgtgtccacatcagtccctgggcttgcaaccaagagatggaagctccccaaaccatgatgacgagttcttctgggaagaatatgaacccgcctctggtatgaccgaccgcg

SEQ ID NO: 245595 - DNA, 505 bp, Homo sapiens
caaactccaaaccaggggtagcagtcatctgaaaaatgcagagactattttaaaggacagacaagtgcctcagatagcatcagagaacaatgcctaaggtgcatggatggaagccagtctgcacaaaatgctgaaaataggtcgttctgagcaagggggtcatggagaagaaagtaccagccctccattccttacgcccactagggcttatgtctgggatcctcacagagactagaagtgtctcccatccccatcgcagtccctggcacttcctggattgtcgagcggctccctgcctctgcccttttgtattcggagctacagccttgcctcccctgttcccaccaccctgaccacccctcaacaccatcccgctgtcagctccgccgccaactgaggcgacacctgttcatggaaaccctgtgagcctcttctgtatccatacacaataggtaatgttgttttacgtgtttcaaaacatcagtgttgtccaacagaactctct

SEQ ID NO: 245596 - DNA, 532 bp, Homo sapiens
ctatttcaaacaagaaaatcagagagccagcgtaggcaatatagtgagaccctgtctctacaaaaaatatttaaaattaaaataagaaaaaattagcaaggcatggttataatcccagctactcaggagagtgaggtgagatgattatttgagcctggagttggagaccagccttgacaatatagcaagatctcatctcttaaagaaaaaaaagccaattaaaagtcaccttttttcttcagatagaaaatacatcttctggccaggtgtggtggcccacgcctgtaatcccagcactttgggtggctgagatgagtggatcaccagaagtcgggagtttgagaccagcctggccaacatggtggaaccctgtctctactaaaaatacaaaaaattagccaggtgtggtggcgggcgcctgtaatcccagctacttgggaggctgaggcaggagaatcacttgaatccgggaggtggaggttgcagtgagccgagatcgcaccactgcactccagcctgggcaataagagtg

SEQ ID NO: 245597 - DNA, 451 bp, Homo sapiens
tggcttcctcccacccccattcatccaaaagaggctctagagtgattcagttctccctcagagagccctggctggagctggggccctcggactcaccctccatcaaaggggttctccccggggattatgtgcgtgctgtccctgcccacgaggaacttgatgcggtcatagaaggagtgtaggttctgctgtgacacagggacctgtgtctcctggatgatgtccagagggttaggggagccaaggcacagcgggttgatatggcacaggggctggaggcagcagtcagggtccatgcagtccaccaggccatctgcaggagtgacagagcatgtggtttatattgctatgttcaatcagccatgtttatccagaatgccttaattcatttcttctctatttttcactcattcaaaaactttattaaatgctgatataagccaaagtcatt

SEQ ID NO: 245598 - DNA, 387 bp, Homo sapiens
caagacagtgtggtactgacataaggacaggcatagatcaatggaatgtaattgaaagttcagaaataaacctatacctatagtcaattgatttatgacaatattcttaagaacattcaatggagaaagaataatcttttccttatatagtgcaggaacaacttgatatccacatacaaaagagtgagctggacccttacatcacactgcacacgaaaattcacccaaaatggatcaaaaacctaaatatgcaaggtaaaataataaaacttctagaagaaaacatactggtaaatcttcataacctcggatttggcaatggtttcttagatacaacaccaaaaatataaccaacaaaagaaaagataatttggactggactgcatc

SEQ ID NO: 245599 - DNA, 628 bp, Homo sapiens
atgaatctgtactgatctaatttgactatccccatgacatcatctcaagttcaagttttagacaaggtggagacagaatgtgcttttgctttgactttaaatagatgaagggaatgagacaagctttcagacagctcttggggcataaattcatcaggcagagtgatgcagcagagaaagcaatggtttttgtagtgagaatgacccaggttctaatcttgccttgtccatttctacacttgcctccttggaaaatgttaactgttcagcgtctgtttttgcatttgtacaacgagggaaataataatatgtgtctttctgaaatgctgtgatcatacattgtcataatttatgtcatgctacagcatgctgtttgggtatttagtaagtgttatgcaaatgttagcacctctaacccctagaccatgtaaaagaaatcattctctcttaaacccctatctgtatctgatgtcctacagcttaatatctttaaggtgttttgtgcatatcaaaggctattaggtaaattaatgataacatccatgatattgtctaatgtggatgtgaaagtgattaaatcaactaggctaggctgcgagtgagggttgaattcagcatagtggtggga

SEQ ID NO: 245600 - DNA, 524 bp, Homo sapiens
agtggccaacctcatcatctagggaactctgagcccagctcccgtttaagtaggcacctaaaagtctgttgaaaaatacaagggagtgacctgagaaaactgccttcccaggccagctgctcaatagaagcgtctgcgtcccttgtcccgtcttcggagctccccgtgggtgctgtagccccactcacttccctgacatcaccagagcacatgctcagtatgttgccacctcccaaatccagaagggtgtggtcttagatgccatggaagcgattctgtacaatgccgagtcagtcacaggctgatgtggcagctggtggcttgtgtcactgtgtcacccacctccgcagcaggcctgctccctccctgggaaagagctacttcagggtagggccacattgccaaggtatcttgagatccattcatgccaactttcattttcatggaaactcgtgaactcgtgctggaacatctttaaccccaaatcaggaatttacgtctttgttattagcagggacacttaa

SEQ ID NO: 245601 - DNA, 201 bp, Homo sapiens
ggattacaggcatgagctatcatacctaccctttttttcaatgttttctgtttaacaaaatcatatatatatgcgcttatatatatttatatagagagatactgtggaaattttgctgtattaaaaaggttaatgcaaaatatgattgcacaacctatataactgtaaattaataaaatttggaatgtctggtgtatagca

SEQ ID NO: 245602 - DNA, 589 bp, Homo sapiens
ccattccttgccctgtgcatgtcttttatttttctgctcctgagttgtatcctttataataaaccaacaatagtaagtaaattgttttcctgagttcagtgagccatcctagcaaatggtcaaacctgagaaagggattgtggaaacccctaactttgtagctgatgagtcagaagtacgggtgacctggacttgataccggcacctgaaatagaggcaatctcatgagacctagcccttaacatgcagggcctgtgacacctttgggtaatagtgtcagaattgaattgatgaacatctaattattattggaaaattggttattgacatggaaaaaacccacacatttggtgtcagaagtgttaagagtagaaacagatcatagaaatatgtgtaatttatgttaatgtataatgagtttattttaaaatgaataaatatttttcatattcacagtttcaatgtctaatatggtaaatatcaggaagtataatctatataaacaaatgccctttggggtcctcaacaagagtcctgaactaaaagtttgaaaactacttctctggacactgtggacattattttctgt

SEQ ID NO: 245603 - DNA, 160 bp, Homo sapiens
tggaggacagagcaagacccccgtctcaaaaaaaaaaaaaaaaaaagaactcattcccacaactaatttcacaccatcctctctttgaacataccctcttatgttccaaatccactccctccagtcccacaactctacaatccttcaatctcaccagaac

SEQ ID NO: 245604 - DNA, 405 bp, Homo sapiens
cagcctgggtaacagagtgagactctgtctctacaaacaaaacaaaacattacctgggtgtggtgacatgtttctgtagtctcaattactcaggaggctgaggcaagaagctcacttgagcccaggagtttgaggctgcagtgagccatgattgtgctattacacaccagcctgggtgacagggtgagatcctgtctctaaaaaatttttttttaaatagacaatcaaaactaaaaactgcttttcaaaagacgtcataaaaaaatgaaaaggcaagccacagttagaaacttttgctctaaaaagcaaaaagaggatgaaaagacgagctacagactggaagaaaatgtttgtaatccatacgtccaaaaatagacagtatctagaatatataaagaactctca

SEQ ID NO: 245605 - DNA, 400 bp, Homo sapiens
tctttgttagacccttattagtaattctgttttttgccctttgaagcatgtgatctttgtacctactccttgttcttacactccctgcccttttgaaacccttaataaaaacttgctggtctgagactcaggagggcatcacaggcctaccgatatgtgatgtcacccctggcagcccaactgtaaaactcttctctttgtactgtctctctttatttctcagtcagccgacacttatggaaaatagaaagaacctacactgaaatattgggggtgggttcccccaatattttatctgttctaagagctttctggaggagtccttagggttttaaaggtaaacaatcatatcgtcagcaatcagtaatagttagacttcctctttaccgatttggatgcc

SEQ ID NO: 245606 - DNA, 235 bp, Homo sapiens
taaaaaacactgtatcacaggcatgacaaatgcctgtgatgggctcatttggagactgaaaatagcaaaggcaataatcagtgagcttgatgatatgtcaataaaaactttgtgaaattaaatgcaaagacaaaaagaatgaaaaataaaacccagaacaaaaaaccaggacattcaagaattgtgggataatctcaaaaggtataacatatgtataatgggaatggtagaaaaa

SEQ ID NO: 245607 - DNA, 454 bp, Homo sapiens
agtaggtttcctttcaactccatccacttggcaataggaatgtggaagggaaggctgcctatggggttagtaattttagagccttaacttcaaagattctgctggcttaaagatatataaaatgatggccaattcaagagatatttaaaactgatcggtgaagtggtgctgtaaggggaatttatgaattaagtcattatgtataagcacaaggacttgggatatgactttaaaaggaaatataaagtctactgctatctgacctagtcagaaataaaggattccattttagccttcccagatgtgtcagtaatgaccaagagagtactgacttctaatcactggggcaagcagttgggctggtataggacggaacagcccctgctaatgtgagaacccaactcatcaaaggctaaagcagaaggcaacagaggaaagtaccctgctagtgtcc

SEQ ID NO: 245608 - DNA, 1234 bp, Homo sapiens
agactttccccccttctttacagcattctatcaaaatacagtgttttgggcgtccggcttccacgttccctccacaaaatgcctggcgaagccacagaaaccgtccctgctatagagcagcagttgctgcagccccaggctgagacagggtctggaacagaatctgacagtgatgagtcagtaccagagcttgaagaacaggattccacccaggtaaccgcacaagtccagttggtggtagcagctgaaattgatgaagaaccagtcagtaaagcaaaacagaggcggagtgaaaagaaggcacggaaggctaggttcaaactgggtcttcaacaggttacaggagttactagagtcaccatccggaaatctaagaatatcctctttgtcatcacaaaaccagatgtctacaagagcccggcttcggatacctacatggtttttggggaagccaagattgaagatttatctcaggaagcacaactagcagctgctgagaaattcaaagttcaaggtgaagctgtctcaaacattcaagaaaacacacagactccaactgtacaagagggcagtgaagacgaagaggtcgatgaaacaggtgtagaaattaaggatatagaattggtcctgtcacaagcaaatgtgtggggagcaaaggcagtccgagccctgaagaacagtaatgatattgtaaatgctattatggaattaacaatgtaaccatctgaaagcaacttttttggtgtctcagatgagtaactgcagcttggtttgaaatttgtactgtttctatcataaataaagttatggcttcttgttggatgaaaaaaaaaagacagtattttgccaaattaaacagaaaagagagttcagtggaagatggctctgatttcagggtaataataatggtaggtaacaattaaatggcatttaaaaatttgctgaatgcttgctacgagcggtggctcatgcctgaatctcagcactttgggaggccaaggcaggcagatcatctgaggtcatgagttcgagaccagcctggccaacatgatgaaaccctgtctctactaaaaatacaaaaattagctgggcatggtggtgcacacctgtaatcccagttactcaggaggctgaggcaggagaatcacttgaatccagaaggcggaggttgcagtgagctgagattgcaccacggcactccagcctgggtgacagagtgagactctgtctcaaa

SEQ ID NO: 245609 - DNA, 1561 bp, Homo sapiens
agactttccccccttctttacagcattctatcaaaatacagtgttttgggcgtccggcttccacgttccctccacaaaatgcctggcgaagccacagaaaccgtccctgctatagagcagcagttgctgcagccccaggctgagacagggtctggaacagaatctgacagtgatgagtcagtaccagagcttgaagaacaggattccacccaggtaaccgcacaagtccagttggtggtagcagctgaaattgatgaagaaccagtcagtaaagcaaaacagaggcggagtgaaaagaaggcacggaaggctaggttcaaactgggtcttcaacaggttacaggagttactagagtcaccatccggaaatctaagaatatcctctttgtcatcacaaaaccagatgtctacaagagcccggcttcggatacctacatggtttttggggaagccaagattgaagatttatctcaggaagcacaactagcagctgctgagaaattcaaagttcaaggtgaagctgtctcaaacattcaagaaaacacacagactccaactgtacaagagggcagtgaagacgaagaggtcgatgaaacaggtgtagaaattaaggatatagaattggtcctgtcacaagcaaatgtgtggggagcaaaggcagtccgagccctgaagaacagtaatgatattgtaaatgctattatggaattaacaatgtaaccatctgaaagcaacttttttggtgtctcagatgagtaactgcagcttggtttgaaatttgtactgtttctatcataaataaagttatggcttcttgttggatgaaaaaaaaaagacagtattttgccaaattaaacagaaaagagagttcagtggaagatggctctgatttcagggtaataataatgattcccacaaaggctgtcctggaaattcaccaacatcaccgctaaaatgtctaaccacattgtcaactgtgctgcctggtcaaggactgaggacctgtctcagagtgatcttccttaatcacagatctagtcatgacctggttttgctcaaaatgtttcaatggctcccgattgcctggagaatgaatttcaaatttctaagtagactcttccagctcttcaaacctatcctcatcagcctctctagcaccatctctggtgactcctcttgtggccctgggagagccacaccaggctgctgttctcatctccttcaaatgggcagcctgttgtcctagccctgtggctctgcctttgctgatcctgtcacttgaatgatcctctctctcttctgggtctggtaaaatctctcttctgtaaagctgttgagaatgcctcctccatatccagctgtaagtaatcactctttctgaatgctttgtttatactgttatagtagcacttagcaaactttactgcacttcactgcatgcaaatctgataggtcactctgatagaatgtaaactccgtgaaggccagcctgggctcctccatgtcagcagagctccataaatactttaatgttttaaatgagtaatgaataaaccgtttt

SEQ ID NO: 245610 - DNA, 437 bp, Homo sapiens
taaatgatgagtgggcacatgtggtccctgaacttttatggctattttccaattcaggaatgcatagttggaatacatatgctcaataacttgtagactacaaatattgttttcctacacagtttattttcctggtagggaaggacaatggaaacccttagaacttcctctacttaccaaaagactaaaccaaaaacaatactactttcctggaaaaattgcacagattaatgtaaccatcacttatgatttctgcaacatattcattcatctcacctgcttggccaatgcagaaaatgatattggcttaacattaacttaatgaaagcctgaatccaattagagccaataagcatgtacccttctacctgcaatgcagctgttgattcaaagtatttttctcttgacttgttaataaaatacaccagaaacagttt

SEQ ID NO: 245611 - DNA, 434 bp, Homo sapiens
ccacacccagctaatttaagtctgactaatcttaagcctctgaagaagttgaaagtaaggataacagagttgttaattacaggaatatttgaggcatgtctaaaaactataccaaatccttggcagtggctgggagaattactggttcatggcatttaaggacacctctgtcttgctaatcactaacctaaccaaggagacactttagtggctacatatgtcaaagaaaacagactttacagtatcagtccaagaaagtcagcaaacgaggaacaataacaatataaacaacaacaacaaaacagctaacagcaagaccaacaaaccctgggagaagaagttctgatttcaagatttacaatgttatattaaaatgtcaagtattttaaagaaaaagtagacatacaaagaaacaggaatgaatggcccataca

SEQ ID NO: 245612 - DNA, 373 bp, Homo sapiens
gacgagaaacttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttctt

SEQ ID NO: 245613 - DNA, 170 bp, Homo sapiens
ttcaccctctcctgtttgttaaatccagtttaactatttttttttcttttatggctcaggcattttgtatcctatctaagaaatccttgtttgtcacaaagatttttcccctatgttttctcctataagttttaatttttgtttttttttttttttttttttttgggttt

SEQ ID NO: 245614 - DNA, 466 bp, Homo sapiens
tcttaattagattatctttatttcaatccaatttgcatggctatgtgagctatgattcttagaggagtgaacataaacagcaaaaattcttacttagcagacttacccagtgcaagaaagagttcccttatctcactgtattatgatcttagtcaatatgacccggaatttaagaaaataatatgacaagagtatggttttaatcaaccggaaaccatgtgttcaacagaacaacaaaacaagaaggctttgtacttacttagggagtttacatcttgatgataaggccactgaggtaactaaagaggaaatggattcagcataggctttggaagttcacttctgttacctagtaactgtgtgactttgggcaagtctttccaagtttcttttctataaaataggatggtaacaggacctactttacagggagttgtaaggtttagataagttaacaggttatgca

SEQ ID NO: 245615 - DNA, 443 bp, Homo sapiens
gcagtgcagctgtgacctacgctgcaggtcagtgggtttccacaatagcgatcaaactaaagcagaaacaatttcttttcaggaaagccagccctcagacgtgagccaccatgcccggccaaatgttttcaattatcatgcctaaaatgtagaggtgtaattgttttctaacttataattttagttctctgaggaaagggactctccctcatataataactgagggtaccctgtatcttaggtgctccctggacaacctgattactcccctagcctgggcatcattgttaacacctgcccctttttactctcaagagggtctcagtttacatgtaagcaattaggtcagcttacttaaaaatccacaggactatcaatggacttgcattttggacctccagaaaaaatacattttcagaaacacactatgtgtaaaagaaacg

SEQ ID NO: 245616 - DNA, 411 bp, Homo sapiens
ctatcatggagcagtgtgagctaccttgacaactggtgccttcgtcatggtctaggaggtgcataccgaccatcttcacgtttagcacttggtttagtccttcctttgccaccacttagagtaagacagccatcatatcagcctctttttactccatcaataagaacaggagcatcttgtacttcctttctgagcagtggcctttgagcttttatactagatgtgcagtatatactgagcagagtagtatatcttaaaagaagggatagtgagttggataaaataacctcacaaaaggttcagaagaccagcagacagtggctagaagtagaggacctcaaagctaaacttctttcttccaaacatataataaatagttttattttttcataaataaaatacacttaaaat

SEQ ID NO: 245617 - DNA, 498 bp, Homo sapiens
aataatgattcacttcagctctagagaaatgtatgaaggaagggaggaaaagagttgaaattcagaataagagtgtgattccattacctgaagaggcaaaagagcaggaggaaattggacaatctaggctacataatgttgaagtgtacagaaaaggaagctgagattgaaatactggagtgtgatgaatgaaacccagagaccaatgtcccaaacatagcccagtctgcatctcccacatgaaggaacccaaggaatggtcacgtttccatatatccccacttaagtgacatgagatggatgggtttccacaaggatcagctggaggagtttcacatccatctggcaaagctgcatgaagataagcctcgtgttttccagggaactgcattgctctacagaggcaatgccgaattattcaattgctttatgaatatttcctcccattaacctctctctgaaaatttgctgatacgcattaagtgtctcttaaccaaa

SEQ ID NO: 245618 - DNA, 677 bp, Homo sapiens
tctgtcgaccaaagatctgcttttatcatgacagctgccagattcataccacatctccaggttctgttagacatcacagtaaagtaattctttactgcttgctttacttgagccatctttctaatgtgtattcttgaaagtatcctggctgtatgaatctcaaatttcagtcccttttttagaccaccatgcagcccagaggtttggagctttgtcttggaagctccttccatcaatcagaataccaaatttacattgttaggttccctggaggtgttggagctctggattcagcaattattgtgaataagaaccttgcagctagggtgagtgccaacattccaagtgctagcacaatggaaaagagaagtggtttatgttagaatatggtcacattcttctgattaaacccactcaaaaaagacaacattgtaatattttccaatgactgtttatcatgaattacgtcagccttcgtttaaattgctattatttctccttaatgcttcttggtgcctgcataatttacggcactggcagcctcgggactatgaaataacctttcacaaccaccgtacaatagtgaagaacatggcgtttttgttgttaattattataggactcctttaacttttacaaagtgacgtcgaccggccgcgaatttagtagtagtagtc

SEQ ID NO: 245619 - DNA, 489 bp, Homo sapiens
tccagacatagacctggtgtggggagctgagtctctcacttttcaaggaaaacctctttccctgctcaactccacttgggagagggtaaagccaaggccctgggtcaatatctgcaactcctgttgccttgaccttgaccaagggcactttgcctttcaccccctgagcctccattttttcccccaggtggctttctgggttactgaggaggctgtgggttttcaggatgtgttgctggctcggcagcttcaggcatacttggcactaagagcatcactgaaagatgagcgctttcctctgctcgcccaaggcttcccaaagagctggtgccttcttctcttgcctgtcttcctgtccaagccccgagatggtgcccaggcatgttacagagagaagtagcttgagaggggtgagaaactgtctgaaataattccatccttccctggagacttggcgtgaattttatctaatcaccatggcaacagaga

SEQ ID NO: 245620 - DNA, 574 bp, Homo sapiens
tttcttttaaatccagtcaaagtcgccttaaatttccaggagttgttcttccccctgttaaggaaaagattctagctgttaagccccctcatgagatccccaaagagaaatgattctgataggaagaaattaaggaaagtgaagtttcagtaattctgcccaaaaggcaaaagctttagtaattcaggatctgtcccctttggagaacatcgactccaaagtccttgaccgtgagagatgctactttagaattgattgagtacatcagtgactgcctggcttccacaggaaaatgtctctgtattcaggatgtttccttcagattctttctcatgaactttgtgtgttttcctgaatgtactacccaacaatattactggaagtgtaatgatagaggatttggacagtctttgatgatgtattccaataaatgatgatgatacataataataaggttcatgtttgatgacattggctgaaaatataattatgatgaggaattaataatgctgacagaaattattccctctaataactctctagaagttattaaaaatgttatttttggaaagcc

SEQ ID NO: 245621 - DNA, 336 bp, Homo sapiens
acataataggacacacagatcttaggtgtacagttcaaatcattttggcaaatgcatgcacccatgtggctcacacccccatcaaaatagagaacattgctattaccccagaaaactctgagagtaccctgcccctggactctagcagcccctatctgatgtccgtcatgacgtattactgtcacccgttctggaacattatgtaaatggcatcatccagtgtctgctcttgtgtgtctggtcttcagctaagcatgatgtttgtgagattcatgcaggtggatgcatgcagctcattccttttcattgttgaatagtaatcaattatttcaacat

SEQ ID NO: 245622 - DNA, 464 bp, Homo sapiens
cgggattttaccatgttggccaggtctcaatctcttgacctcgtgttccgcctgcctaggcctcccaaagtcctggcattatgatggtgtgaaagctgtaggcattcatagaaaccatactttgaattttgaattttgatcttttctagagctagcaaggactcttttacaatgctgggcagcagcagtgagccacagcacccatcagccatgccatcaggagggtgagcaaatgctactctaccagtgagttgccagataatttttgcccatctgtaggctaatataactgttctgtgcacacttaaggtagggtaggctaagctttgatgtttggtaggtaagatgtattaaatgcattttttatttgaggtattttcagcttattatatatttgtagggacacaagcccattgtaaattgagatctgtagtgtgatggaacctcaatgcaagatttcccgc

SEQ ID NO: 245623 - DNA, 394 bp, Homo sapiens
acagccttgcgccaaagcatccacaactggccagctccctgctccccaaaatatcccagcacatactttatttttatttttatttttatttttttttgagacggagtctcactctgttgccaggctggagtgcagtggcgcaatctcagctcactgcaacctccacctcccgggttcgagtgattctcctgcctcagcctcccgagtagctgggattacaggcacacgccaccacgcccagctaattttttgtatttttactagggactgggtttcaccatgttggccaggatggtctcgatctcttgaccttgtgatccacccacctcggcctcccaaagtgctgggattacaggcgtgagccaccacgcccagccccagcacatactttcat

SEQ ID NO: 245624 - DNA, 454 bp, Homo sapiens
gcaacgacatcgaccaataccccgtggttttcaggaatgccagcgaccagggctcctggatgcagctggagatgctactgcggaagctctctgacctggtgtggacttcagatgctctaagtgatgagattttggaagatggtctggttccctagtggagtggaagatagcaaagacacggtcaccctctttggatttggatcagaatagcaaggaaagtgtttctatcactggaaggaggataatcagaccaagggctccaaggaaatactgcccacgtctagtgcaggagcagaaatcgaagtcatccatcagctagcgtgtggacaagctcactattcacacaagctcagcctagctgagtccatacaaatcctatttctgggtgggtaaagggcaggaggaaattgtaagatcagtctggtactgaataaaatcctggcctgattgtcaa

SEQ ID NO: 245625 - DNA, 281 bp, Homo sapiens
gaggagatgcaaggatgaagcgaaggttggagtgatgtggtctgctgcggggaccctgaggcgtgcaggcggcctctggaagctgaaaagacaggaaggcagcttctcccctgagcctccagaagaacccggccctgctgacactggcccaggagccccttcccccatcagggcctggagagggaagaaatgactgttcacagattttaccccgcaagacccatttcagcattctgattttgagaaccataagacagtgtgtgttgtttaagcctccaagt

SEQ ID NO: 245626 - DNA, 375 bp, Homo sapiens
ctctggctgaaaagatgatttgtgagaactgaatttctggcattaatccaatagaaaggtgagaaattaaaggcatgttcttctaatcaaccctcctatgctttaggcagacccacttgtattatctacctgaatactggcctcaggtatgtttctgatttaagggaggtgaccacttgcagagctctgtcgaaaaatattcctaggacaggtctgaagtcagcagaaataaagtgacataagtcattaattgtggcattaattgtgtgacatggaggaggggaatgatcactgaattattttgaggaacagtgatatcatgtgcaaatttcttaagaaagttgaaaaatgtttaagaaaaagtgtgtgtgtgtg

SEQ ID NO: 245627 - DNA, 462 bp, Homo sapiens
gcgagcgggccgcacctcgcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaaggtgagaggcgcaggcttcctgccccgggccgggccagggggcctgacgtctccgaggaccgaactgccctccttcccgcccacatcgctcccacccctgcccggcccctcccgaccagcaaacctctcctgccccgcggctgtgtttttaattatttttacatataaatgtgctgcacgcctcatctgcctcgaatttctcactcagtcggtgattaaagatccctccatttccca

SEQ ID NO: 245628 - DNA, 897 bp, Homo sapiens
agaaggagtccagcccagatcgagtcgtcctgatcttttggccgagattaggccgcttcagccttcctggaagaagccagggggactgcgcgcgtgagcgtcacgcatgcggggtcaacggatgggtgcttggtgctctgggcactgcaggggtgctggctggactgcggttaccgtatgtgttcgatactgtgggcactcataatatgttattgctttgttgtagacagttcactcgtgtagcactgaaccggagttagcgatgactctgtttccagacttgcatgactccaccaataaccagccatatgatcttaagcaaattgctcatttatttaggccttagacctctggtgtgtaaagtcggattaataaaaggactcacttcttaatacttttttgagattaagtaaatgcacttaaagcgaatggcacagttccctgacccagagtaagtgatgtcggctttatagttaattttttcatttaggtgttgtgttgcaaatgctgatgcaaataaagttaccaagcccaagccctatcttgttcagcttggctagagttattcgtcatttctgtcctgctgagagcgcagtgcagttaactgcagaaaacatgctcgccgcagttgtggggcttggtaggggaggatggaaagcagacgaaacctaaagggaaatgcagttttaaattctgtgagtccttttcctcaagagttttgtcaaatcccagcccagttttcctggagttggaaagcaccatcgaaacctgcaggttgagtccagtgcaaatcccagtcaccatcctcagctgggcccttcagcaatctttctgggagtctgtagtcagcttctcccattccttattactgctgcgtcagaccaccaccacgacccc

SEQ ID NO: 245629 - DNA, 418 bp, Homo sapiens
ggtggacttctggcaggagccttctccagccatggctttagggctgatatggttaggtgctttgtgtccccacccaagtctcatcttaaattgtaatccccataatccccacgtgtcaaaggagagacctggtggaggtaattgaatcgtaggggtggtttccaccatgccgttctcatgatagtgtgtgagttctcaggaaatcagatggttttataaggggctcttcccccatcactccacacttctttctgctgctttgtgaaagaggtgccttgcttccacttctgccgtgattgtaagtttcctgagacctccctagtcatgcagaattgtgagttaattaaacctctttcctttctaacttacccagtcttgggtagttttttggttttgttttgttttgagatggagtctc

SEQ ID NO: 245630 - DNA, 166 bp, Homo sapiens
ctacccatatgtctatgcatgttttacatagttgcaatcatagtatgtgtacatattttggatcttaatttgtgcttttccactagtgctcttggtattacaagaagggagagagcacttccaataagtgcctttattcctgctcacagactgtttctcagattac

SEQ ID NO: 245631 - DNA, 394 bp, Homo sapiens
caagtattatttttttgtaatcctttccataaccctgtgaggtaagtactgttatcacagacaaggaaaccacaatgtggacctgttcatgaacttgctcgaggccacgtggctctggagttccagctcaggtctgcctgactctcaatcccatgatattaatatactggccagtcactattttggctgtattggggtcatatttatacccttggtccagttagctatgttgggtcactttagtactgatagccagggagatgctgggcttgataggttagtataattctatgtattacctacagaaactgtttttataaattgttttgttaatatttgtttgtcacctatttattcattttatttgcactggtgaaaataaactcatctttta

SEQ ID NO: 245632 - DNA, 315 bp, Homo sapiens
gcccagaagtactctgcaagccacagcgtctacaggaagtgcctgggtggccacggctctcaagaggaatccacactagttcctgccaccctgtttctgcacatgctgttctttccgcctgggatgccctttctccctgctctgcctggctaagttctcatcatggtcctctaaggcagttcaagaactccatgactacgaccccagccctgcacccagggccagggtgggtccttctgtggggcttccttggacatagcccagagcaaaaagagatgcagctcttactctgataaacattattaaatgaataaa

SEQ ID NO: 245633 - DNA, 267 bp, Homo sapiens
agccaaacaggatgggctctaggaagtatcagtgtttccatgggagcctctttgactaaataagtggatcatgcatccaagtacattcagttattctctgaagagaatcaaaatcacaaaaacaagtaccatgggcaccctcttatcttttcctaaaatcctcatgacctgtttcttcctgttaactggaatacgcatcactctgtgacccataatacatgcttgatgaatatttgttaaattaaaaaatatgtaaaagccagagaa

SEQ ID NO: 245634 - DNA, 565 bp, Homo sapiens
atgctcctaaacattctgcagtggagccccctcaacaaagaattatctggccccaaatgttggaagtgtccaggtttaggtataaagaatcagaagcttttctcaagtattgctgttaggttggtgcaaaagtacttgcggattttgctttacttttaatggcaaaaaccgcaattatttttgcttcaacctaatatgatgcaaaattggctacaactgtaatttgttgagtgctgcaaacaaggtacttgctaagcttaactttagtgaacaaattaggaagaattggaataaggtaaaactagctaaatgactcttccctgagaataaatactaatgactgccccttcagatggtgccccctcatctgctttactgactgtttcttagtagtagttggcaaaacacctcttaaaataccatacttgttttcatcgtctttggtgtatgaaatagttgaatatatcctttcagaatcgcttgaacctgggaggtggaggttgcaatgagctgtgatcgcaccactgcactccagcctgggggacagagtgagactctgtctcaa

SEQ ID NO: 245635 - DNA, 568 bp, Homo sapiens
atgctcctaaacattctgcagtggagccccctcaacaaagaattatctggccccaaatgttggaagtgtccaggtttaggtataaagaatcagaagcttttctcaagtattgctgttaggttggtgcaaaagtacttgcggattttgctttacttttaatggcaaaaaccgcaattatttttgcttcaacctaatatgatgcaaaattggctacaactgtaatttgttgagtgctgcaaacaaggtacttgctaagcttaactttagtgaacaaattaggaagaattggaataaggtaaaactagctaaatgactcttccctgagaataaatactaatgactgccccttcagatggtgccccctcatctgctttactgactgtttcttagtagtagttggcaaaacacctcttaaaataccatacttgttttcatcgtctttggtgtatgaaatagttgaatatatcctttcagaataatatttggccatttacatctctcttttgcacacactgaatttgccatcttgtcttcctgttcctacacctttaattgtcagcaaggagac

SEQ ID NO: 245636 - DNA, 1602 bp, Homo sapiens
ggctgagtcaggagaatcgcttgaacccaggaggcacaggttgcagtgagctgagattgcgccactgcactccagcctggtgacagagcgagactccgtctcaaataaaaaaaaaaagatttatattaggcagggcatggtggctcactgcctgtaatcccagcacttggagaggctgaggcgcgaagatcacctgaggtcaggagttcgagatcagcctgaccaacatggagaaaccccgtctctactaaaaatacaaaattagacgggcgtggtggcgcatgcctgtaatcccagctactcgggaggctgaagcaggacaatcgcttgaacccgggaaggcagaggttgcagtgagccagatcgcgccactgcactccagcctgggcaacaagagcaaaaccccgtctcaaaaagaaaaaaagatttatattagaaggaggcgccttctctaaaagtaatgaatcctttttttccctccccaagcaaaaaatccttctctaaaattaacaatcatttttctaagcgtggtttaatgcttttttggaagactacttatttcttttcctttcaaaagttatgcaagctcattaaaaaaaaaaaaaaaaaaggctgggtgtggtggctcacgcctgtaatcccagcactttgggaggccgaggcaggtggatgactaggtcaggagattgagaccatcctggctaacacagtgaaaccccgtctcttatactaaaagtacaaaaaaaaaattagctgggcatgctggcaggtgcctgtagtcccagctactcgggaggctgaggcaggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcag

SEQ ID NO: 245637 - DNA, 614 bp, Homo sapiens
tctgtttcacaaatgagcaaacaggcacacagaagttaagtaacacaaccactgtcacagttagtaagtagcaaaatcagaagtctgacctggacagtcaaagtgctcatttcctatctgtaaaacgtgggggtggggaagagttgtagcaaatttcttactacttaaataactgccagagagtaagagctttcaccccacacacccagccaaaacagaatagaaaatctttagttatggaaaattcagaaaccctccaatggacaaactgaggcacacctgtattcatttagtaagactctaagtcatatatacttgggctttcagcagggcttgctttaaattaataaaaaaaattaaagtgattggaaaaaacagtttaggataatcactattttaaagattcataatagttttcctagaacgagcaggaggaaaacatgttgctaaactatagctttctccctcccagcaattagcggctccatccaatagtgatggcaaattaaaatgggacttctcactgagatgaaagagtgggcaactttcctccattgaaaataaaataaaggaaatcatcttcaaaagttccaagagttcagtctagatcccag

SEQ ID NO: 245638 - DNA, 414 bp, Homo sapiens
atattcaactctgtgacctgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaaggaaggttcaactctgttacttgagtacacacatcacaaggaagtttctgagaatgcttctgtctggtttttagga

SEQ ID NO: 245639 - DNA, 457 bp, Homo sapiens
acaggctttttgccctggaattaaacccttagggcctccagactttcccagctgctcctgagtcttgtcagctgacctcacctacatagagtctttgacaaagtctctgttactgacaccccttgatcttgggaggtgaccaagtaccttcttgactttaggctcttgtggtacagacagctctgtgttctttggagagagtttccaggattactactttgtgttgtttttagcactcttgaaacaaacattagcactctttaaacaaacatagttctgaatttatgaaacttcccaccaaaaaagaaggtcttttgcctcagagcaatggggaatccttaggagcaagggagtgtgtttgcatccccaacttaagctttgctgctggtgagcactaagggtgcagacatattggggtctctggagcattctccgtgcccttcttggagatggcatc

SEQ ID NO: 245640 - DNA, 400 bp, Homo sapiens
ttccttcggttgcacaggtgactgcccctccttcagaatggcttcccttggcttctgcagtgagctttgtttctcactcctcgtaggaccctccacctgcatgcctcctgtcgcccattcccatggcctcaatcccccacatgacgaaagctgccggagctgtgcccatccttgccataattcctgttgtatacctagtggtcttccagggcactccacttgagtgtaccaaggcctttcaaatacagcatttccaagaccaaccatttcctccttaattaaactgtccctccccccatgtatcttcccagtgaaagagccatcaaatatcactcagctcaacacctacgtctaccacctagtcaccagtcaaggcaattcataaaatcaaaccagacaa

SEQ ID NO: 245641 - DNA, 706 bp, Homo sapiens
agtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaa

SEQ ID NO: 245642 - DNA, 380 bp, Homo sapiens
agacctgggaggaagctggagaaaagatgccctctgaatctttgtgtttggctgcccaggctcgccttgacaccgaatggttgaaaacagatatacagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaa

SEQ ID NO: 245643 - DNA, 352 bp, Homo sapiens
ttaattgaatatttaattagtataaatataaaactaatttttgaatgtgttcagtacatttagcaagaagacttggtgctgagctctgtagagaagcacttctgcagatgcagacagccaccgtgccctccgtgtcctcctcggtgtgctgatagaagtgagtgggtcatttggcattagcaaaggagtaagttcgcatttgcactgagctggatcttgccagactgtgcatattggaacccgcagacagaggctgctttcacgttgatgaatgggttttttcaagcgttctgctccctagttatgagaagggtgacccggccaggagacaactttatgaagctataaaaaa

SEQ ID NO: 245644 - DNA, 469 bp, Homo sapiens
tgagcctgcaggatcctggagtgccctccaagtatccctcctcacttctctccaggctactggctccatccttctgacgccaaatactctcagttcaccctgtgatattgttgcgatgtttgtcccctctaaatctcatgttgaaatgtgatccccaatattggaggtgaggtctgatgaaaggtgttttggtcatgggagcagatttctcatgaatggcttgatgccctcctcatgggaatgagtgagttctcactgtattagttgacatgagagctgtggtttaaaagagcctggcacctcctctcctctctcttgctttgtttcttaccatgtggcacccctgctccccctttgccttctgccatgaataaaagctttctgaggcctcaccagaagccaagcagatgctgcttccatgtttgtgcagccagtatagccatgagccaaaataaaccttttttcctta

SEQ ID NO: 245645 - DNA, 607 bp, Homo sapiens
taacttgtttctgaatgagattgtcagatctgtgttgacagagctctgtctagcagttctttttcccccacggagctaaaaatatcagagtagcacagcgagctgcctctctaccagcctcccagactggggaccctagctccgtgatccccttcctccagaataatgtggaggcacagggtcacccagttagacttcattttccaagtctaccctgcaactagaagtggcttgccagtgtattttcagaagtaatgtgtacaatttccatgtttcttgcttaagaggaaatggctatggggagaggttgatcaactggtacaaagttgcagttaggtgagaggaatcagttctggtgttccattgcacagcagggtgactgtggctaacaataatgcatcgtatatttcaaactaactagaagagaggattttgaatgctttaccacaaagaaatgataaatgtttgagatgatggatttgctaattactctgatttcatcattacacaatgcacacatgtgtcaaaacctttcatttttatcccatgaatatgtacacttaccatatgacaatcgaagttaaaataaaattttattttaaaaatg

SEQ ID NO: 245646 - DNA, 1172 bp, Homo sapiens
ccctccttaccgtcctccggacctcatttttaggccgaactggttttgctgcgtctctctctcctctttggtaaatcgcggagatgcacggcgcacttcgggagtctgggcagggatggggccccctgggctcggccggagagtaattcatggtctgattggaggcatcaggtgtacccttggcacagaagggcgaacatggctcaaggatcagttcccagtggccgaggggcacctgttagaacaccaacgtctcctacaaatgtgtccccaagaatgccagcaaggggaaccagcaggggcccaagtataacatcaatctgggcgagtcaccactgccccttgcagcaaccgatgcactggtccagccctcccgcaggcccgctccgtgagtaaatggctctcttctcttgcaggaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagaggtgaggcagggccggctgggagccctgtgtctctttacccacctgcggggcttcctccaggggctgctggctgtgccccaaggctataaggatgaacaaatacagccactttccatcaggagttcccagaaaactgaagtgtgttgcactggagtgagactgggagtagaaggcagaggagaaagtacctgggccggcagagctgggtgaggatggaactttccgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggaggcggagtttgtgtttcatccctgatgtctagagataaagg

SEQ ID NO: 245647 - DNA, 665 bp, Homo sapiens
caagatccccttagcgtttccatcaggcctgcttcaagctcagatgagcatcaagctgttgtaaggcattttgaggcccttccaatcacacatatttttactgacagctttctctgaccttgtaatgtgcctattttacaacagagtgcctgactcagtctctattgctctcttgagcctcattcactaagtgacaactaatcttaggcttggaggatagctgtgctgacattctacctggtgatctctctagtgatttagaagtctgcacagatgggacagggagagagcactcttaattagcataggagatgtaggaattcaagcagaacctgtataaaatgctggaatccccagttttatgtgatgaaggagagaatctcttcagttttcaagattttttaattgaaagtttttaaacacaaaaatcacataaaacttgattcttgaaacatagcatcttcacatatagacttaaactaccaggtaagtatttgtcattcactggttttcaccagaagatgaatttgtatcataaaaagttatcaacatgggccgggtacagtggtttatgcctgtaatcctggcagactttgagaccagcctgggcaacatagcatgaccctatctctaaaaaaacagtaaaaaaaaaaaaaaaaaccact

SEQ ID NO: 245648 - DNA, 472 bp, Homo sapiens
gatgaggaagctgcattgcttcttgtgctcctatcccattggccagaacatagtcatgtggccatccctagctagaaggcacttgatctctgttttgctccattttccccaaccctcatgtcacccagtctctgtcttctctgcctccagacttacctgtcccttaccacaagcttgatgagttacaagatgaacaccccaaacccctggtcaagaaatagaactttgccaggccctccccacccagaagtccctctgtgtgcatcatcccaatcacagccccaccccggccccactccaaaagtgactgttactaacctgacactttcaataatcactccttgtttctttatggttttatctcccatgtgcatttctatacactatagtttagtcttgcttattttaaaaattccgatactttttttttttttgcaacagagcaagactctgtctcaaaaaacaaaaaaaa

SEQ ID NO: 245649 - DNA, 500 bp, Homo sapiens
gaagcactgaggcgggagcccaggaggttgaggctgcagtgagccaagatcatgccactgcactgcagcctgggtgataacagtgagagcctgtctcaaaacaaacaaacaaacaaaaacaaaaaaggattattatgggttaactttactcataaacacatgcaaaaatcctaaacaatatcctaactacaacggaatcaagtaatatagaaaatgtaatataaaaattttaaatatatgaaaagttggatttattgtagtagtatgatactactacatacacataatataatgatactactacattataatgtagtagtctaatgtagtccattagaaatggactcagtgtaatgtgtcatatcaatgcaataaaaaagtctgataaaacctcaatacatgcagtaaaggcatttcataaaattcaacattctgtcacaataacaactcttagaaaacctggaatggaaggacacatgcttaatctcataaagtaccta

SEQ ID NO: 245650 - DNA, 576 bp, Homo sapiens
tatattaacttggatccagcagctttactgtattcatttattagttctaacagttttctgttgttgtggagttgtaaggtttttctacatatatatgatcatttgtaaaaagataatttttctttcctgttttctatttggagtccttttattccttaagtcttctctcttggaatttcagtattaaattgaataggagtggtaatactggggcatccttgcctttcctggatcttagaggaaaagctttcagtttttccttactgatttatgctattatttgtgtgctttatatatgaaaaaaagctggccaggcatcccagcattttgggaagctgaggcgggtggatcgtgaggtcaggagttcaagaccagcctggccaacatagtgaaacctcgtttctactaaaaatagaaaaattagcctggtgtggtggtgggcgcctgtagtcccagctacttggcaggctgagacaggagaattgcttgaacctgggaggcagaggttgcagtgagccgagatcacccagccgagcactttaggctgggtgacagagtgagactgtctcaaaaaaa

SEQ ID NO: 245651 - DNA, 302 bp, Homo sapiens
aatttgctctataaaatcatagttatatagaatctctttgacatatggttctattcagtaggatcaaattctgatggaacctccaccttgcctgctgtgctgtgcctgcagaaggccaactttcgagaacagaatgcttttacttattctactttattacccagctcttgcccttttgggctttagaggagaagagggggagattgacaggacaagtggaaatggtgggccctccaaatgtgataggttggttgagccacatgtaaagggcatgaaaagaaagaaagaaggaaagaaaagaa

SEQ ID NO: 245652 - DNA, 322 bp, Homo sapiens
gtgtcagcttgaccttgggaagggtggagacagagaaactaaggtcaaccaaatgggtgctcttgtccatgtgaccaaactccagtaaaatgctcaacaccaaggctcaggtaaggtttttgttggggagtatattctgtacttttcgtcacatatctctgggtgaattaagcactgtccacacgatgtcactgggagaggacaaccagaagcttgtgctttgtctctcctggactctgccctatgcacctttttctgctgctgattttagtctatatctttttgttgtaataaactatgagtataacagcttcactcagtt

SEQ ID NO: 245653 - DNA, 419 bp, Homo sapiens
cagtctctagaccagtctagaagagaacaatgagctgtctgttaagtaagacattcttcaatatcttcttcccagatattgcaactttttataatggaatgttggtattgttattttaaagatcctgatgatgttcttgtgcagtacactgttacgacttttatactgtgttttgggtaaaaaattaataagttgctttttagcagtgataatttttttcttttttgcatcatattttaaaaaagaaattctgacaaattactatgtaatgtgctaaaactgaaattatgagagaaaagaaaatacaagttagtttataattctgttactgcttcattgtcatctgtgcgatactgacatttagagcacatagcacttgttaccactttcccccaccctattccttttaaaatattttc

SEQ ID NO: 245654 - DNA, 567 bp, Homo sapiens
caagcccagaatgggaatgactttctgagtccatcagtagtggtcctgagacagtttggggcagagatagcctcatttggaattgaaattgaagaagtaggctgggcgtggtggctcatgactgtaatcccagcattttgaaaggctgaggtgggcggatcgcttgagcttagaagtttgagaccatccagggcaacatgatgaaaccccaaataccaaaagtagctgggtgtagtgggtgtagtggcatgtacctgtattcccagctactcaggaggctgaggtgggaggatcacttgagcctgcagtgagctatgtttgtgccattgcactccagcctgggtgacaaaacaagaccctatctcaaaaaaaaaaaaaaaaaagtaaaacactacaaagtttatgttctctgttttgtcatcttgttgagatagtttttatttaaagagttgaaaagtaacgtttattccagatgagtatgttacattggttaggttaatttattagcatgaattaatttgttttaagaaaaacacatgacacatgaatttcatacttgtctgtctt

SEQ ID NO: 245655 - DNA, 403 bp, Homo sapiens
attaaaatataatgtccttctttgtctctggaaatgacttaatttctccttcattcttgaagggtagttttgccagatttagaattcttagcagacaagattttttcctttcaggatttgagctgtgtcatcccactgcctcctagcctccatggtttctgatgaaaaacagctgttaatcttatttgaggataccttatacagtcagccctccatatccacaggttccatatctgcagattcagccaaccacagattcaaaattcagtattcacaggatgcagaacctgtagttatggagggacaactttttctatctataggttctacagggccgacagcagtacttgcatatccatggatctgggtatctgtgggaattcctggaaccaatcccccatgg

SEQ ID NO: 245656 - DNA, 428 bp, Homo sapiens
atgttaaggaaccaccaggatgccccttcctgatcacatgcctgtcacttctcacagcaggtgtaaccactatcttgaattttatgttaatccttccttggctttaaaacaaaaaaagctacctatacaattgtaactatagtttattttcattttttaaaaaactaaagtattttactgggtttatactacaatgtattaatcccactgttgatgggcatttaggttgctttcaggttttcttcctactatgaacaatgttacattgaaaacttaatctatttttcccttcattcactttttttgtttgttttttgttttttgttcttgacacgaagtcttgctgtgtcacccaggctggagtgcagtgagccgagatcacaccactgcactccagcctgggtgacagagtgagactctgtctcaaa

SEQ ID NO: 245657 - DNA, 769 bp, Homo sapiens
attcaagaatcaatgaattgaacaatatatttctaggaaaaaaagaaaacccagtaaggactgcatcatataatattctgcaaccatattctggaccacctcattatgctcaaaggacacatcacagtactctttcatcttttatgtttgtgagccaaaatttacctgatacaaagagatgtacaaggtaattcttattaaaatatctaataaagttgtttttcataatacttttattcatgtgtctataaattagtagtaaaatagcttataaatataaaaatacaaaaaggtctatttgacccaaatggttaatggtgatgcttatttctgttaaataccaagagttagtcaaaactttgcagatacaaaccgtaaggcaaaaaaaactggtgagactgattacaacaaatttagagagttcaatgtgctatgaattcacacaactccagttcaacagagaccatgaacaaagtaagagacatatgacaaagtgggagaagttacttacgatgtatgaagtcaacaagaaatcaacatgtagaatatacatgaaacatgagaaaatcagttcaaaaaagaaagtaatactaatataaaaacagacaaagaattaaaataatttctaagactcccaacaacctaacaagcatacaaagaaatgctcaaaataggccgaccgtggtggctcacgcctgtaatcccagcactttgggaggccgaggtgggtggatcacctgaggtcaggagttcgagaccagctggccag

SEQ ID NO: 245658 - DNA, 715 bp, Homo sapiens
attcaagaatcaatgaattgaacaatatatttctaggaaaaaaagaaaacccagtaaggactgcatcatataatattctgcaaccatatatgtttgtgagccaaaatttacctgatacaaagagatgtacaaggtaattcttattaaaatatctaataaagttgtttttcataatacttttattcatgtgtctataaattagtagtaaaatagcttataaatataaaaatacaaaaaggtctatttgacccaaatggttaatggtgatgcttatttctgttaaataccaagagttagtcaaaactttgcagatacaaaccgtaaggcaaaaaaaactggtgagactgattacaacaaatttagagagttcaatgtgctatgaattcacacaactccagttcaacagagaccatgaacaaagtaagagacatatgacaaagtgggagaagttacttacgatgtatgaagtcaacaagaaatcaacatgtagaatatacatgaaacatgagaaaatcagttcaaaaaagaaagtaatactaatataaaaacagacaaagaattaaaataatttctaagactcccaacaacctaacaagcatacaaagaaatgctcaaaataggccgaccgtggtggctcacgcctgtaatcccagcactttgggaggccgaggtgggtggatcacctgaggtcaggagttcgagaccagctggccag

SEQ ID NO: 245659 - DNA, 346 bp, Homo sapiens
cccttacttatcctctgtcatgctgttgttcatggtctgcttccaaaaacaaatttaaggcagctgggattacactttgctaatctctgtagattatttttacttaaattaaggaggttttccctggtgtgatacaatgtgaagcacacagcactacccaactaagaaggctgaacctgagtttaatcaagcctctagagttaatttccagtttcaggaaattcaggcgatagaggaaccagataatgacaacacaagaaaacagatatatccagaatgtgggacattctgcaggacaactgacccagtttctgcaacaagtcattggcatggaaaaaggggggag

SEQ ID NO: 245660 - DNA, 445 bp, Homo sapiens
ctttccagtctatttctatagatttgttttcaaatcacatcagaccctatgtaaaatagtgtaccgtctttactcattataacatggtgagcatttccccaagctattacacatatttttaaacattgttttaatgaccggcataataatccagtgcttggatatatcaaattcttcggccatctccttataggtgagattgtttccaaagtttcactaatgtaagtgcactgcagtgaacgcccttacgtaacaattgttcactcccgtgtacttttctcgtgcagagttctacagcatgaaacactatatttaactttgtcaggttgatgtttatcagtggtttattattgtttttatagtattccattgtcagtgaagtatgccattcacactgtcaagtgaattgtctatttgtattatttaaaaaaaagatcacaaacat

SEQ ID NO: 245661 - DNA, 393 bp, Homo sapiens
ggtatgcattcagtagaaaccataccttggattttgaattttcatttcccgggctagccactggcagtatgatactctagtgaggctaggcagcagcagtgagccatagctcctagcagtcatgcagttatgaaggtaaacaaccaatacttcatcgcgtactgtgctgccaccattttgacccactgtaggctaatgtaagtgttctgagcacatttaaggtaggctaggcaaagctatgatgttcagtacattaggtgtactaaaagcattttttatttacagtgtttttaacttatagtaggtttattaggaggtaactccttcataaatcaaggatcatctgtttaaaatttgaaagtgtgtgttttttagaattctcttagtattcac

SEQ ID NO: 245662 - DNA, 518 bp, Homo sapiens
actgccctgacgacactggaccctctcccaggatccccaacgtcttctcaaaccgaaaatgaagaatcttgtgagggagaaggaggagggtaggtaggaggaggcatttacaaaatgctacctgttgaggtgcccgcatttgatggaaacttcaccccgatcatgcaacatcagagctgaaaggaaggatttggtcctaacaaagttcctttcattgtttattcctgagtaaacaagtatgacatcgacccatagcaatgctttgagattgggagtggggggtgggggaacaacagctgtcatcaatccagtgtctgggggtctcgctgacccatctgaagagggacgcagagaaatgcctgctttcaatacatctaattttaaatacgctactatattcatccacctacctgttacaagtcaccagcctcagttattatgacggaacatactgcgttttctgttgttctgtctcattgttcccgtttaccaatattaaagatacagcttaaaatgtt

SEQ ID NO: 245663 - DNA, 495 bp, Homo sapiens
agtctcatttagtttatactcaaactactggttaaagatggaaggctaagacagcaaaagaacatagatgttcaaatagaagttaatgaagagcacaaaatagtaatccggtaaatttatttcaaaattttctgtattctgaaataatatcttctacagcaacctggatgaaaccgaaggccattattttaagtgaagtaactcaagaataaaaaaccaaatactacatgttcttacttatgagtgagagctaaactatgagtacgcaaaggcatacagagtggtataatggacactggagattcagaagggaagagggtgggaggggggcgagggatgaaaaactacctgctgggtacaatgcatactcaggtgatggtgcactaaaatcccagactttaccgcaatataatgcatccatgtaaccaacaaccacttgtaccccataaagatattgaaaaataagtaaataaatacattttttaaaaacaaaat

SEQ ID NO: 245664 - DNA, 339 bp, Homo sapiens
gcggaggttgcagtgagcctagatcacaccactgcattccagcctggatgacagaacaagactctgtctcaaaaattaattaattaattaattaaataaaatattttcaaaaataaatctgggtacactagagaaaattgaaaacaaactgcttaatactgattatcaatacattaaaaagttacaaccataataaattctgtacatattcatgtattttaatcattgtcttaactgtatctgtctcatgtcatgttacaggtatattttacttctgaagaatatatttttatatgattataatttttaataaaagtatctctaaacttccacatttca

SEQ ID NO: 245665 - DNA, 473 bp, Homo sapiens
gaatgagaaaagggttattgtaaattctacacacatttaaagaataattaggctattataaacggctttatggcaatgaatttgacaacttagatgaaaaggacaatttctttgaaaaatacaatttaccaaaattaatataggaagaaaaggaaatccacatagccctatgtctactaagaaacattcccacaaagaaaactcaagacccagatgttttactgttgatttctaccaaatatccaaggaagaaatgatatggattttacacaaactttttcagaaaatagaggaataaggacctctgcccagtctgtttttgtggtcagcataactctaatatgaaaacctgacacattgtaggacatcctatcggtcctgatgtgattattatacactgcatgcctgcatcaaaatatcacattaacacataaacatgtacacctgctatgtacacagaaaaataaactgat

SEQ ID NO: 245666 - DNA, 474 bp, Homo sapiens
tcgctatatatcttgaactcctggttcaagtgatcctcctgcctcagcctcccaaagtgctggtattacaggcatgagccactgtgcccagctgattctttttttattacctgttatttaaatgggcaagagatctggtttaaactcttctgactttagagttttactctggaaaagataagatggttaaataatacatattctacaaaaatcttgaattatttaaagaatctataaaaattattcctggtaagaatttattattcctactgataataaaaaaaataaaaattaccaaataaataaaaagtaggttttacatggacttaaacattctacttcaagtgaaaaacctgatattttaggaaggaaaaggtattaattcaagttggtagagtcactatataaaattctgttgacaagacttactgtactcataatttgctttcctcccttagaaagattcagaccagg

SEQ ID NO: 245667 - DNA, 458 bp, Homo sapiens
aaggtacagaaagtgactccaggtcacactctagatgtcggcggggagggatctgacactcaagctgaggttcttgctgttgtgctgtacccacacacgaatgtcatgtttgtggagaagagtagctagtgaatgaagccgtggtggtggaggggggcctgatgcatctggagaggtggcttgaagctgaattgtgaaacaccttgaatgtcagacccagcagcttgacgtcatcctgtatccagggggattttgatgtagatcctaccttttactcttagagagcacacagtgagtgccccagtaggtgtacacactaagctattgggatcagataaaactattaaaattattttatctcacatgaagacattaaacttataaacacttaatttagactagcagatggatatcatttataaataaataagcatctattgagttttgtgcttaaaatg

SEQ ID NO: 245668 - DNA, 499 bp, Homo sapiens
gtcaaaatttcttagggaaattacagagcctttgtatcaacaaaatagcaacaggatgcattgtagaatgttatgcatctgttcattgctcagatgcataaggaataccagtaaagaacatatcacctactttttctttgcttttgagagactgctctattttttatcttgcctagtgttctgatccccttggttgtaaccataagaaaatctgatgagaattatgtaggccatctgccctaacttcacaaatgagagaaaaggagactttacctggggaacctcatctcttttctgatgaaaaatgatgagtaacccgtgattgcttgaaatacaatgttgaatgggtgaataacaaagggcatgtgagatttgtggggttgactgcatgcttcctaaaactcagcatatatggcacatcctttaaacagaaaaaggtcctctgctggttatctgccagggacatgcaagggaagaatgaccaaaatccatttcacta

SEQ ID NO: 245669 - DNA, 358 bp, Homo sapiens
aagccagacacatgagtcatgtcatgtgattcctttatatgatgtccagggagaaggagggggaattaactagaaaggagaaggagggagctttttgggtttatgggaattttctatatctcgatatagaaatctgtattttctatatcttgacataggattgtttacatgattgcataatttgtgaaagcaaaattgcacacttagaattgcatattttactatatataattagtacagattttattaaatatattaaatatatctactatctattttactatatataattactgtatataattgttttcctgcatataatttgctatatctattttttggacaagttaagtgtcta

SEQ ID NO: 245670 - DNA, 463 bp, Homo sapiens
agtagttatcagtagcaagtaaattattcttgcttttcaattaaatgttttaaacagaaataatgtggattcctttgaaatatttttatttcaaagagtgtgcttttgaatcctttgtgaatttagggttttaagtttttattctttgtacaaatatatttttttcttttgctctggcactccagaactccagcattgaaaacagaacatcgtgtctagagaaaccttacacatttattggccccaaaaatacataacacatctagccacataattgaaaataataaggccacgataaatgggatggccccagggtaaaacacccaaaggattcaattggtgtcactttgcatcaatgtccatgcatcatggtaattgaggtaacataaccaattaccacattttaattagagttctaagaactcgaggaaatttgcaatgatcagacagctcactttacaaa

SEQ ID NO: 245671 - DNA, 597 bp, Homo sapiens
ccataggattcttcctgaagccaagccaggatgattaggtatcgaggggggtcagataccaagggtgggggatttttgtacacagactcagcaggatttttgctcaaaccagtttctacaaggacagagagggaaacccaaggtcaggcctagtcagaaagaactcagagcctgactagaggcttggtcagaagagagtcttcgctaatacccatacaactggtataatgcaattcagagcaataaggtttttacttcaaatcttctatcttacaccaataccttccttctttcacattaaaaattctgcttccagccaggtgcggtggcttatgcctgtaatcccagaactttggcaggccgaggcaggcaaatcacttgaggtcaggagttcgagaccagtctgagcaacatggtgaaaccccaactccactaaaaatacaaaaattagccaggtgtggtggtgcatgtctgttatcccagctacttgggaggccgaggcacaagaatagcttgaacccgggaggcagaggtttcagtgagtagagatcacaccactccactctagcccgggcaacagagtgagactccatctca

SEQ ID NO: 245672 - DNA, 406 bp, Homo sapiens
ggggcactgcatgaggagctttttcaggtcacaggctgtctgggctttctccgcctgagtggatgtgtttgcaaagtggatgagtgacctttcattcctggacacccagagggccaatcagtctgttcttgctccactgagaaaactgaataaagtgcttgccacttgaaatgagagtaaggcataaataactataaaaataagcaagccccaaccccctcaaagctcaaacacagttgaagcactttgtgttttaaggcaccctgagtctggcagatgaagaagccttttctcgtgtttcctcctgcaatgtgaaaaatcacttcactggaaaagatctctgccaggccagaaagcctgtgcaccccagccgcatgctgcacccccgtcatgttctcttctctca

SEQ ID NO: 245673 - DNA, 486 bp, Homo sapiens
agtctcactctgtcacccaggcttgagtgcagtggcgcgatctcagctcactgcaacctctgcctcccaggttcaagtgattttcctgcctcagcctcctgagtagctgggattacaggcatgtgccaccacgcctggctaatttttgtatttttagtagagatggggtttcatcatgttggtcaggctggtcttgaactcctgacttcgtgatctgcccgcctcggcctcccaaagtgctgggattaccagtgtgagtcaccgcgcctggccccgagggtcttcgtttctaaccagctcccagatgacgcagccctgctggccccgagccacactgggtgcttaccggcaacgtgttgcactctgcaaccaaaggcaaggccgcatggcacccatccttccctcctgccccacatgctagtatgttccttcaatcaactctcactttgttccctaaatgtatttaaaggtaaattttaaattctt

SEQ ID NO: 245674 - DNA, 493 bp, Homo sapiens
attatgttttttttttcttataaagtttgttaaactggtgattgtatatttgcatcaaagaatttaggaaatgacaacagggaatggaaagttggaaccatttgaatgaacatagaggataacagctcatttaacaaaatctcggtcttcccatgttgtcattctcatgaccccagctaaagaaccatcttattgtgaaatgacttcccagaagaataacctatgtgggcatctaccttccagcaagctaatataaatacatatctgacgtatctgttatacaatatgacaagtaaagagatatgtcagatgaataaaaaaaaagaacagaaacaacttaagtttgctcagaaccctcttaatcatgaaattccaagattatcagaaagtcctataaatacatttttaatgattttttttaaaaaaatggtaatggggtgagcatattagtgctataagttgccctaaattttctgagagaagatgctttgct

SEQ ID NO: 245675 - DNA, 336 bp, Homo sapiens
acgggcatatcttcacataaaaactagacaaaagcattctcagaaatttctttgtgatgggtgcattcaactaagagagttgaaccttccttttgattgagcaatttgaaccctgtttttgtagaatctgcaagtgggtatttggagcgctctgaggccttcggttgaaacaggaataacttcacatgaaaactagacagaggcattctcagaaactttttgtgatgtgtgaattccactcaccaagttgaacccttcttttgatagagcagatttgaaacaatctttttgtagaatctgcaactggacattttgagagctttgagggctatgggg

SEQ ID NO: 245676 - DNA, 518 bp, Homo sapiens
gattggatgctaaacgtaaaactcagtgttctcaccctgctctctcttctaattcaacctgtttagaacttgcatgaaacaatacccttgcattccacatggatattacagaaacgttatagactcctgctacctgaaattttcttgtctttgcctcagtgagaaaaatgccatgactcttttgatctacctgcaataaatctgatggccaaggaatggatattcactgtcctatcaaatgagagccatctggaactttgtaattttgacgaacatctctattccctgcttctctgagtttgacttttttagatttcacatgtatgtgagaaaagacagtgtttgtctttctgtgcgtggcttacttcactaagcacaatgcccttcaggttcatccatgtcattgcaaatgggaagatttgcttccttttttaaggctgaataatattcctttgtgtatataggaatgatattcctatgcatgtgtgtatatgtatatcaacacttaagtttttttc

SEQ ID NO: 245677 - DNA, 415 bp, Homo sapiens
ctgtaactctctccccagcctccgcattcctttcccagaaggcttccagtgttccaagtttctcatgtatcctttgagagatgggttctgtgcacacaagccaatatacggctatagtcttttcttccccttctccccttctgctgtgcactttgattttcctgcctaactctctatcctggaggtggcgggagaccagctcatgaacttcctttattctggttgtcgctgcgcctttatcagatgccagtgtgggctatactgcaatttagtatcgatgccttattgacagacatggttgtttctaatatttagggcattaccttaaaactctcctgcctcaatttcctcatctataaagaatgcagaacagagcctggcacaagacattcaataaatattgaagagtaatata

SEQ ID NO: 245678 - DNA, 326 bp, Homo sapiens
ccaataaactctttccttctttcccatattctctcctgtatgtattcatgaacatatctaatttttaacacagctataatcaaagcagggtattatttaaatttaccaaaatcatgttctactaagagtcttcaaatttttaatgtaatgtattttttgtaatattccatttagtggatgtttcagtttcctgaactaacacctgaatatactttgagtgtttcaattaaaataatgcttcagtgttctgcttcagataacgacaagttaacatatattaaaataaacttgctacacataacaattatacattctggacaaaatat

SEQ ID NO: 245679 - DNA, 370 bp, Homo sapiens
gcgtgcttgatggacatgaacgcgctgctggaccgattccacaactacatcctcccgcacctgcggggcgaggaccgcgtctgccactgcaactgtggccggcaccatatccactacgtgatcccgtacgacggggaccagtcggtggtggacgcctccgagaactactttgtgacggacagtgtgaccaagcaggagatcgacctcatgctggggctgctgctgggcttttgcatcagctggttcctggtgtggatggacggcgtcctgcactgcgccgtgcgcgcctggagagccggacggcgctacgatggctcgtggacctggctgcccaagctgtgcagcctgcgggagctgggccggcggccgc

SEQ ID NO: 245680 - DNA, 429 bp, Homo sapiens
gaaaattaagctttgaggtcatagtgctaaatagccagggcctatgatttacttgacaaaaattgttttttatacatttgtcagtttctaattgggtagttggaaaatgccaggaaactattatttctgttcattttttgtgctatatggaatctgttatactgaggggatgtactttataagttattagtacaaggattaatcactgatagtccccttctctcgtcattcttgcactctgtggggtctagtgatccatccatacaaggagaagaaacggtggctggagggataatgagttccctctcctctttcctacacactagaagtagggtcaggaaagccctgcatgcttcttccttccctgtcccttccctgccccttgtggagggtcatcatgaaacagttacatgcaggtgctataaaaat

SEQ ID NO: 245681 - DNA, 318 bp, Homo sapiens
tgggcgacaagagcgaaactccatctcaaaacaacaacaacagcagcaacaacaacaaacaacaaatgagtgcttcctgagccaggtgacaagactcccagaatttgagtgctaggtagtctttatatggattctgtcctccttgtgccctgggtaccaacagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtg

SEQ ID NO: 245682 - DNA, 320 bp, Homo sapiens
ttgggttacattgccacgctaacgcagtggggcccaactaatctcttaggaggcaagtttcttaaatacagtgttagaccaactggaaaattaactagggtgttgtctggaaagatctcattttcatcctaaaacttgccaagtagaaatgaaagaggtggccaacaactcatttttcaaagcgtgtcagctgttgctgtactttttcatgtaaattatctttcccagggaatgaagaattgaaagggtttcttaggcattaaaaacaaaacagaacaaaacaaaaaatgctgagacattaaacaagacagtggttagct

SEQ ID NO: 245683 - DNA, 491 bp, Homo sapiens
cccttacacttatggccaattaatttttgacagaagcagcaagacagtttaacagagaaagaatagtcttttcaacaaatggtcctagcaaaactggatagccacatgcaaaagaatgaagttggatccttagctcacaccatatacataaattaacacaaaatgagtcaaatacctacctaaatgtaagagctaaaactataaaactcttttaagaaaacacaggagtaaaccttcatgactttggatttgacaaaggactcttgatatgacaccaaaagcatcagcaacatggtgaaaccccgtctatactaaaatacaaaaagtagctgtgtgtggtgcatgcgcctgtagtcccagctactcaggaggctgaggcaggagaatcacttgaacccagaaggcggaggttgcagtgagctgagatcatgccactgcactccagcatggtgacaagcaagactccgtccccccacatacacaaaaaaaaa

SEQ ID NO: 245684 - DNA, 633 bp, Homo sapiens
  misc_feature (8)..(8): n is a, c, g, or t
ggtaagancaatggcttgtgttgggcagaccaagggcatggaagctctccagcaaccagcacagtgggacagcacaggcttctagcaggcatggtttcagcctcaattgtttacaagccttgggatctggaacaattgatttgagccctacaacattagaatggttccttttctcagggcctaatatggggtcagagaaggcactcagcaaggagggttttttcagaggcccaggaagaactagttcagaggccgagcctcctgggagaatgtctcccagctcacaaaaatgactactcactggcaagtaacactaagtacagaaagaacgtcatcagttggttggtgttcttgctttctctccgtgaacaattaagagggcgcagaggtgagatggggtggggtgggataaagggaaggcctggaagaagggacagaagggctgcaaataatcacccgggagcccagtgagactcagagaaagattctaacctaaaatactcttctgctgtcagctattctgtaattaacatccacagatgaaaacatgaagtgtattaaaaatcctttgtgttttttttcaattttgactgatggacataatataatgacttgataattaaaaaaaaagaa

SEQ ID NO: 245685 - DNA, 491 bp, Homo sapiens
tacagaaggaacgctaattttcaataccttaaagaggccaaatcattcccacagcattagtggcagagggggtatttgaacccaggcagaatgactcgaactccctggtaattagccatggtggagaatgtctcccagctcacaaaaatgactactcactggcaagtaacactaagtacagaaagaacgtcatcagttggttggtgttcttgctttctctccgtgaacaattaagagggcgcagaggtgagatggggtggggtgggataaagggaaggcctggaagaagggacagaagggctgcaaataatcacccgggagcccagtgagactcagagaaagattctaacctaaaatactcttctgctgtcagctattctgtaattaacatccacagatgaaaacatgaagtgtattaaaaatcctttgtgttttttttcaattttgactgatggacataatataatgacttgataattaaaaaaaaagaa

SEQ ID NO: 245686 - DNA, 556 bp, Homo sapiens
tgatggtttctcagatttttcttgtttttgataatcttgacagttcgaggagtatttgtcaggcattttgtcaaatgttcttcaactggggtctctggtggttttctcatgattagactgggaatgtgcttttgggaggaagaccacagaggtgatgtgccagtctcagaacatcgtactaagaaaaggttctgccaacttgacttaccactgttgctggtgactttgagcccccggctgaggttactcctttgtaaagttactctttttttctcctttccatgctgtatgttttagaaggaagtcactatgctgctccaagcaactcaagtttgatgaatggggagttccgccccacctccttgagggcagagtagctacataaattacttggaatttctcaaggagatttgtctgtactcccagtttattatataaataaatgatttatttatattacagggacccagggatctttactgtatgctttgggttataatccaatggtactttactttgtggctcaagtatactacttttaaattggaaaaaaaaa

SEQ ID NO: 245687 - DNA, 642 bp, Homo sapiens
tattgtattcttgggatgttttaacaaatcacctcaacactcagtggggtatggttcttctggtctcagtggtggttctcctgatctcagttgggctgtcatgtctggagattggctgcctctaagctggtctaggattatctcaactgagaggaaagtcatttggactcgcctccacgtggtctctcatcctccagtagagagcaaatggcagtgacagggttccaagacagagaagccaaacttagggtcacctctgctaccttcttttggccaaagcaggtcgcatgacctgcccatattcaaggtatggacaagtcatctcaacctcttgggagaagcagcagggcacattgccaagggcaagcatacagcaggccattgcttgggaccatcagtacagtcggtctacaataagcataataagacaagccccaagaagaacaaaagaatcacacacaatccctgacaggtaggaggtaagtaagaaatcccagctgccgttactcttgccatgagtgaaactgtatagctaagttatacaccaagggttttgctggcaattgatttatcttgtagcctctctgcttggacactgcactatttttatattggagaagggaggagtaactgttaccggcc

SEQ ID NO: 245688 - DNA, 401 bp, Homo sapiens
tgcatgctctgtaatcccagctactcaggaggctgaggcaggaaaatcacttgaacccaggaggcggaggttgcgctgagctgagatcgcaccactgcactccagcctgggcgatagagccagactcggtctcaaaaaaacaaaaaaagtgtactgagcaccaactctaggtcatctctgtgacctgtgcttggatattcacagcatgtgtttaaattctagaatgtgggcagtagggttactaaaaacccacaacatgaacaagtcagtaataattagatcccatcgctatggtgactaaggacggtcatgcggtgtctataaaagcatcataattattataccatttacaagattgcccatacagagctttctattgccccatgttgtcttacaaggaa

SEQ ID NO: 245689 - DNA, 259 bp, Homo sapiens
atttatctacccatttacctgctaatagacatttatattattttctatattatttaatatatatatttaatatattatttaatatattatttttatattaaaaataaaaaatgatatgagcatttgtatccaaaaatttgggtctcaaatgtattaattctaggagtagaatatctgagtcatatggtaggtgaatgtttaatgttttataaattgaccacactgttttccaaaacggtttacattctcagccgaagtg

SEQ ID NO: 245690 - DNA, 405 bp, Homo sapiens
aaaatccccagcaagctgacacaagttagctatagaaactggggagaaagggatggggtgaggtggattgggtgggaggctgccttaggtgggagctgccaggccattttttgtgagagctcagaaccagaatccatcatgttctcattggcccttggttgaccatttcgtttagttagcaaactaatggcttaatattcacaaaatgcacgtgatgtcctagttaaccaggacaccagagcaccaggagaacccaggtcaaatgggggactggaccacccacttgcatgccttcctttctgtataaaattttgatttgtttcctcatgccttttgttttggtcttgtttctgtgtgcctgagctgctgctgatgaagggttggaacagggcaggccagagctag

SEQ ID NO: 245691 - DNA, 578 bp, Homo sapiens
tcgggctggtggccagcggggtctgggcgtggttttacccagctcctttgcgaagctgctgtcctttcctcaacgttaccacccggctgggcagcctaccctcgcagcaacaggtgtgcaccttccaagcttgcaacagaccacattcagaagcttgatttcttgttgttctgggaatatctggatcagagatttctccaagccactctccccgtcatctcctccacccccaggacccaactcctgcccctcccaccctagcccctgttctccctgcccacctcctaccccactggagtggcctttcatcaaacctaaaccaaagaaaccaacagaccttgctgtcaccactactccgggacctggaagttaaagcgagggagagacggtgaaacacagaaagcagaacgccttctgttcttccacaacacagggtttgtggacgtggccactataagaactcgcactgcgtgctgattatactcctcagcacaattcatttcttaaactttttagaataatttaaaatttacaaaaagttgcaaaaataaaaaccagtaaacttttaaacttcatct

SEQ ID NO: 245692 - DNA, 465 bp, Homo sapiens
cgcgcttaccgggagcccgggttgggagagggctccccaggaggggtgtgagctccgaacgagaaagaacgccaccgcctcgtggggtctcttcctaatgtgcagattccaaatctctacaatgctgcaaaagagcagcaacaggtgtgcaccttccaagcttgcaacagaccacattcagaagcttgatttcttgttgttctgggaatatctggatcagagaccttgctgtcaccactactccgggacctggaagttaaagcgagggagagacggtgaaacacagaaagcagaacgccttctgttcttccacaacacagggtttgtggacgtggccactataagaactcgcactgcgtgctgattatactcctcagcacaattcatttcttaaactttttagaataatttaaaatttacaaaaagttgcaaaaataaaaaccagtaaacttttaaacttcatct

SEQ ID NO: 245693 - DNA, 384 bp, Homo sapiens
  misc_feature (15)..(15): n is a, c, g, or t
  misc_feature (32)..(32): n is a, c, g, or t
cccaagccacttttnccccgtattttttttcnaccacccagccaaaaatttttgggccctccacacacccctgttctccctgcccacctcctaccccactggagtggcctttcatcaaacctaaaccaaagaaaccaacagaccttgctgtcaccactactccgggacctggaagttaaagcgagggagagacggtgaaacacagaaagcagaacgccttctgttcttccacaacacagggtttgtggacgtggccactataagaactcgcactgcgtgctgattatactcctcagcacaattcatttcttaaactttttagaataatttaaaatttacaaaaagttgcaaaaataaaaaccagtaaacttttaaacttcatct

SEQ ID NO: 245694 - DNA, 363 bp, Homo sapiens
cttcacaggtcagtgaccaaaacctctaaaaattcacaaagaagctcatgaggaggtccgaggctgcccaaaaggcatttggtctctggcccaggagctcaggacagacctaaggtttgagtgaaatctgggctggagtaaaccttagcaacctgtcattacctacagggcaataagctggctcccttccagtggcttctgttttgtatgttcatctctgcccagagctctgtcatctagtgttgcactgttcagtatgggaaccatgagccaaaactgactgctgagtatttgaaatgggactaacactgagatgtgctgtcgatgtgaaatacacaccagatttcaaagacttagtatgga

SEQ ID NO: 245695 - DNA, 591 bp, Homo sapiens
attctgtttgctaatactttccttttataaattaacatgcagaagtcatattaatctgcagccttccttttttgtacaatctttgtcaagttttggtattatttcctaaaaaattcagaagttttccattttctaaaatgtataacagttttaaaatagtattgatattatcagctcttgtatgatttcgtagaattcccctataaaaccttgtgacctgccgttttttgtttggtttggtttggtttgctaggtagctgttttaaaacttccctcatttattttgtgaaaatcagtctaataatttatcgtacaattaaaaataactaaaaatataattggattgttggtaacataaagaaaggataaatgcttgaggtaatggataccccatttaccctgatctgattattatgcattatatgcttgtatcaaaagctcgtgtaacccatagatatatacatctagtatgtacccataaaaatttttttttaattaaaaaaaaaagtctgttcaggctgtttaggttcacttttggtagctcacattttactggctatcgttattatgatttttttttttttttttttg

SEQ ID NO: 245696 - DNA, 373 bp, Homo sapiens
ggcaacagagaatggtgtcctggctcagatctccagcaagcctccacaatgatggtccagtatctgaagccatggccaaggcagcaggagctttgggtgcacatgggggcttcccccactttgaagtgagtcatcacatctgtattagaccctagctgttgcttaggcaaaaatgatgatttagaagaagatggagagaagaggaaagttaatttaaaagtacttatattcggccgggtgtcgtggctcatgcctgtaatcccagcactttgggaggctgaggcaggcggatcatgaggtcaggagatggagaccatcctggctaacacggtgaaatcttgtctctattaaaaatacaaaaaattagctgggc

SEQ ID NO: 245697 - DNA, 467 bp, Homo sapiens
ctgtcttcacatcctcacctttataatgggctgcttaatagctgctgggcatgaatagcaatcataaaacataaagtgctgtacaagtattgattagtaattaatttctcattttattcatcaaagctacttaattgagaaactttttccccacttatctaagcttacacacccagaaaatgagggaagcgtgtgcgtgtgtgtgtgtgtgagagagagagagagagagatctaagtgtgtatatggcagtaggggctggatttagggcctctggtttttttctctctttcatccactcacctgatggccgtctatctctatgagtcatgcaaatggctttggggcagtgatgtcaaggacatcaataacattgttataagaaggactgatgagtctgcatacttgcaactgtctaattggttcatctagaaaccaaaagactgggtcccaaatagcaacagttcaa

SEQ ID NO: 245698 - DNA, 362 bp, Homo sapiens
tgagcagaaagtggcctcgtgtcttgctgggacctgagcccttgatgctgtccacacaggtgaccctcaggagtgcagagcagggccaagaagagtggtgtgtcaagaaggtttcaggcacagctgagcagcagtaacatcgacacagagacctgaagactgacaacagactctggcagtaagatacagcaggctctgaaagaaactgaagtattttactatcaaacagatttctttgacatattttgaaatagctctgcaaagctgtctcttatgaggaaaatctacattctgtgaagaatccccttccctttctagctcttttctcctgagataattaactagagtctgataagaaacat

SEQ ID NO: 245699 - DNA, 455 bp, Homo sapiens
gatgacactgatgttactcaatttttctagggtttctgaggaacagcgatcctgctctgggctgggtccctgtgtaacaagattacattgctgagtgagatatttaaacataagacatttcctgtaagtgtcatatgcagaaaaggaggttaaggaactttatttacagtgtcttggctggatgctgtggctggcggctgtaaacccagcactttgcgaggccaaggcgtgaggatcacttgaggtcaggagtttgagaccagcctgaacaacatggtgaaactccgtctgtaccaaaaataaaaaaattaactgaggtggtggcatgctcctgtagtctcagctacttgggaggctgaggcagtagattcgcttgaatccaggaggcagagattgtagtgagctgagattgtgccactgtactccagtctgggcaacacagtgagactccatct

SEQ ID NO: 245700 - DNA, 822 bp, Homo sapiens
gggcacacatgtgctttatgccgttgctaaaaatagaaatctatatgcctatgctactttctgtgggaattgttttttctttgttatttctatactttctcaaactggttattgaccacttacattcttcagatattaagaaaactaggccaggtatggtagcttatgcctgtaatcccagcactttaggaggctgagatgggtggattgcttgaggccaggagtttgagaccagcctggccaaccctgtctattttttaataaaaatttacaaagaaaggaaaactagtgcctgattattttttcagccttgtttctgacacttagtgatctcttcccttcttccaatatattcttcatccttcattacttgccacatgtgttgatttctcaacccaagcctcaacctctggctccatattttctacctcatcagtttaaacccatttatgcctagtgttccattattggaacgctaagcatgtgggagtttatatcctgctcaaggttatcgcccaggtctgattgcaaaaattaaaaaaagaaataatcactgcactatgttcaaagcttgttgctacggcactatgagagattacgttatgtagcctttgctatcaaggagcccccaatttttttattttttttttaattaatttttttgagacggcattttgctcttgttggccaggctggagtgcaatggtgcaatctcggctcactgcaacctccacttcccaggctaaagggattctcctgcctcagcactttgggaggctgaagcgggcggatcacaaggtcaggagatcgagaccatcctgg

SEQ ID NO: 245701 - DNA, 976 bp, Homo sapiens
  misc_feature (609)..(609): n is a, c, g, or t
  misc_feature (621)..(622): n is a, c, g, or t
  misc_feature (628)..(628): n is a, c, g, or t
  misc_feature (632)..(632): n is a, c, g, or t
  misc_feature (636)..(636): n is a, c, g, or t
  misc_feature (970)..(970): n is a, c, g, or t
gaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgattntcacttaaatannttgaantagnctgngtaataggagcaataatctgtagtacttagctgttggattcacatattatttatgagacatagcgtcattatttcgatgcatatagcaggctgcatacatttgtatagctgatgaagtccaaatagcattactcctttcattagcatcctttaggtaattgtacaccgtgcagaagtcctatggcctctttagaactgcttaacttaacaggcctttattggcggaggggattcctctttctgagtgtcccctgtctaaaaatgccccaaatagccctttttcgtttttgggcttaacgtaaattttttcataagtggtatatttctttttaangaaaag

SEQ ID NO: 245702 - DNA, 789 bp, Homo sapiens
gaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggac

SEQ ID NO: 245703 - DNA, 447 bp, Homo sapiens
ttctgattcatctaataattgtaagatgtattcctctgtcattttcttctcttggccatcgtgggtggaaaatgaaaatttttgaattcttaggtggagtcagtgaaagctaacattagactacgaagatggtattctagtctttcaaaaatattcttaaaaggccgggcacggttgctcacgcctgtaatcccagcactttgggaggccgaggtgggcgggtcacctgaggtcaggagttcaagaccagcctcaacatggagaaaccccgtctttattaaaaatccaaaaaaaaattagccaggcatggtggtgcatgcctgtaatcctagctactcgggaggctgaggcaggaaaattgcttgaacctgggaaacggaggttgcggtgagccaaaatggcgccattgcactccagcctgggcaacaagagcgaaactcagtctcc

SEQ ID NO: 245704 - DNA, 523 bp, Homo sapiens
ttcctttttttaaattatgaaatagcatccaagcatctttgtggtgatatctatacagcatcacaatagaaagcaatttggaactcttctctagaccacaggtttccatctacattactaaagtgttgactacgcaaacctcagggcaccttggcaagacttgggatggacataaagagctttaccatttacaccagaatcccatgaaaatattatcatctctgtgtgccaagatgagacatgtccaagtatctctgccctgaacttcacaggatccattataaagcttcaaaataaattgttcagcttaacagcatagtcaacttttaatgatgcagttatttgattcttttaatgactgaattggttctgctgcattgtgatttattccttcagtagcaatatttccattaaaggtaatgttttaatgactcaaactgttctgtgataatcattgagttaacttcgaatttcactagaagcatcttaagttcataaccatatcaagggattatgtcgacgc

SEQ ID NO: 245705 - DNA, 473 bp, Homo sapiens
tactattgagttgtttgagcttcttacatactctggttatcaatcccttgtcaaagggatactctgcacatatttctcccatgctatggactccaacttctctttggggttgtttcctttgctgtgcagaatctttagcttgacgtaatctcatttaccaagttttgcttttgctgcctctgcttttgaaatcttatgcaaaaagtctttgctttggcctggagcatctccccaaagttttcttctagtacttttatagtttcaggtcttatatttaagtctgtaatccatttgatttgatttttatatatggtgagagatagggatctagtttcatttttctacaaatggttacccaattttcctagcaccttcattgaagagactcctttcctcattgtatgttcttggtggctttgtcaaaaatgagttggctataaatgtgcagattcatatctgggctttctattctg

SEQ ID NO: 245706 - DNA, 236 bp, Homo sapiens
ccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaa

SEQ ID NO: 245707 - DNA, 222 bp, Homo sapiens
aaagaagagagggcatctccatgcttgtgggacccaaaacctatctctggccctacaaaagttttcctaattgtctgatctttagtgcattcaggttatggcacctggagaggaatgccctttatcttttgaaggatgggatttcccatctcaaccctggattcctcaccttcagaacgagccctgccactgtctccaataaaatgttttctgcagcatcga

SEQ ID NO: 245708 - DNA, 391 bp, Homo sapiens
tacttagatgcttattagaaaaaaattgtgtttgagctgtgaaggggattgtgagtattggtccgaagaattaatgccagaggataacttctcaatgagaaatttataagccagagattcagacttttgcgtttctgtaataatcttttatagtctgcttcatgtagaataggggatggcaaacatttgctggaaaggaccagatagtacatattttagactttaaggatcatatagtccctgtcacaactattcagccctgccgttgtagctcgaaagcagccataggcagtacgtaaatgagtgcagttatattctaataaaactttacagaatagtcagcaggctagatttggcctgtgggcagtagtttgctcaacttctgatgtag

SEQ ID NO: 245709 - DNA, 521 bp, Homo sapiens
ttgagacaagagtctcactctgtcaccaggctggagtgcagtggcacgatctcagctcactgcaacctctgcctcctgggttcaaccagcctcagcctcccaagtagctgagactacaggtgtgcaccaccacatccagctaatttttgtatttttagtagagatggggtttcaccatgttggccaggatggtctcgatctcttgacctcgtgatccgcctgccttggcctcccaaagtgctggggattacaggcgtgagccaccgtgcctggccagaagacatattttctaatactcagaggaaaaacaagctctcccttcttcttggacttataatgtggataatggtgtcagtaataaagaaatatactaacaggtgtcaatggttctgataactggcatatgttataaaatgtcctaactggcttcagaataactggagaccttggaggaaggagggcaggagtgaggatcagaagacaagatgggacacccacacagatcacaaagttaactgcct

SEQ ID NO: 245710 - DNA, 418 bp, Homo sapiens
cagcctcccaaagtgctgggattacaggaggaagctgcttcgcccagcccttgatctttttaaatttaggcaaatatagtcaaattaacacagaaatagagaacagatagatagaataattttcagcttaaaaatcacatttgtggctgggcgtggtggctcacgcctgtaatcccagcactttgggagtccaaggtgggtggatcacctaaggtcagagctaccagcctggccaacatggtgaactctattaaaaatacaaaaattagccaggcgtggtggtgggtgcctgtaatcccagctacttgggaggctggggcaggagaatcgcttgaagccaggaggtggaggttgcagtgagcggatattgcgccattgcactccagcctgagcaacaaaagcgaaattccatctcaaa

SEQ ID NO: 245711 - DNA, 160 bp, Homo sapiens
aagctttttttttttggcaaacccaaaccacaatttccttctcttctgaatccatgtctttagttggagatctattggaacatttttaagatcatactttccatcatgactatgcatcaagttgactgtgtctttcataatgcctctttaaaagaatgct

SEQ ID NO: 245712 - DNA, 395 bp, Homo sapiens
atagatatatttatttgttacgaattgtcccttcatcaggaaaatgattcctttttccctatttaaggtatttgttacgaattctagttttatattatctactatatcttacccttaacttttctgagtcattttcagtgtatcttttatagaaggctatggttggaatttttttaaaacctgagtatcattgtcttctgatacagaatctgaaaaccttttaaaaattagtgaggcgaaaaaaattagccaggcatggtgacgggtgcctatagtcccagctactcgggaggctgaggcaggagaatggcacgaacccagaagccagagcttgcagtgagccgagatcgcgccactgcactccagcctgggcgacagagtgagactccggctca

SEQ ID NO: 245713 - DNA, 429 bp, Homo sapiens
  misc_feature (48)..(48): n is a, c, g, or t
aattaattagtacaaacaagggtgagggggcagggaacaccatactcnggtacttaatgtctgaaattatcagggaatttaacacattttcccataggtttatttcttgtgtaagaagtcagataaattatttccatttcaagtatttattattcagattatttaaagcaaagctttcacaaagccttttgtcagctttcctataatcctcaaataatttttcctggctggacgctttggcttactcctgtaatcctggcactttgggaggcagaagcaggaggatcacttgagcccaagagttctaggctgcagtgagctatgatcacaccactgcacccggcccttaaatctttacctgaaatattcctagatggggttaacatagcaccaggagaaccagactaaggatagtagaatcatccatgg

SEQ ID NO: 245714 - DNA, 301 bp, Homo sapiens
actttactgttctacctatgtttgttatagaaaaaagtagaaaacataaaaaattgaaatcaccaataatcctactgttcagaaataacaacttggaacatatcaagaaggaaaaaaaaaaaaagaaaactacagaaacagacttgaagatgacccaaatgttggaattagcaaacaaagactttaaataaactattctatacatgttcaacgacttgaggaagtggctataatgtgctaaaaatagaatactttaacagacaaattgaaaccttagaacaccaaatggtgattgctgaac

SEQ ID NO: 245715 - DNA, 471 bp, Homo sapiens
ctttcaaacatatgatcttgcctccacttcctgtgaaattaacctcctttctttaaaaatacaatgatttaaagaaaattgccaccataaacaaagctaaaagactaggggaaaatatttgctgcatatgtagtcaacaggattaccatctataatatataaagaggtcctataaattgaaaatttggccaggtgtggttgttcatacctgtaatcccagcactttgggaggccaaggcaggagaatcactcgagctgaggagtttgagaccagccctggcaacacagggagaccccatctctacaaaaattaaaaattagctggacatgatggtgtgcctgtagtcccagctgcttgggaggctgaggtggaaggaccacttgagtctgggaggtcaaggctgcagggaactatggtcacaccactgcactccagcctaggtgacagagcaaaaccctatctcaaaaaaa

SEQ ID NO: 245716 - DNA, 431 bp, Homo sapiens
agcagattaaatgagttaatatatgaaaaccacttaaggcagagcctggtatacagtaagtgctgagtacatgttagcgactagcttatttatacataaactttaaataatattggtttttctcttctgtggcagctgtaagggtgaaacaataatacttatgaaaagcttaatccagtgccagaaggatagtggatttttaatacatgatgcatagtattaacattaaagcctatcccactcccactaagaagagggttcaggtttctttcctcccaaatcaaagaagtgaattaaaaaatacagatatggccaggtgctcatgcctgtaatcccagtacttagaggggccgaggaagacagatcacctgaggtcgggagttcaagaccaccctggccaacacggtgaaaccccatctctactaaaaata

SEQ ID NO: 245717 - DNA, 448 bp, Homo sapiens
ctcccgcctcagcctcccaagtagctgggactacaggcgcccaccactgcgcccggcaaattttttgtatttttagtagagacggggtttcaccatgttagccaggatggtctccatctcctcaccttgtgatcctcctgcctcggcctcccaaagtgctaggatcacaggcgtgagccactgcgtagtaacgcagaatttgttcttttcaataatactaaatggtttgggaattacgatatcagaaaagtgaaatcgttttcctgaagacagaaaaaaacagaaagcattatttagctttagaaaaatgttctctacagacaatgcaatgttttaaataacaaaactgtgagatgaaaaaaagcccagtcatccacttcaggacgtgcgatgcctcactggagaatgcacttccacgaaggggctgggattgttcgagaccattcat

SEQ ID NO: 245718 - DNA, 520 bp, Homo sapiens
tatttcccccaaaagagggtgttgaggctttaacccccagtacctcaggatcaccttatatggagacagtgtcgttacaaaagtaatcaagttcaaatgaagccagtgggtgggccctaatccagtatgactggagtccttataaaaagggtaaattgggacacagacacacacacagggagcagcaatgtgaagatgaaggcggagatcagggtgatgtttgtacgtgccaatgactgccagaaacctccagaagccaggggagaggcctggaagattctcacaaccctgtcgacaccttgccttggatgtctagcctccagaactgtcagacaggaatttctgtgcttgagggaccctatttgtgataagttctgggagtccaagcagactaatacaactgtcttcagagtttcaggcatccagacctgatgctgttcctcccccatttgaaacccttcagtggctccttcactctcaaggaaaaaaaaatatccagacttcttgtcctggtgttcct

SEQ ID NO: 245719 - DNA, 361 bp, Homo sapiens
cagaactcagaaagggaaggataaatattgcctgacaggtccattctaactttgatccgaaattctgcattcttctgggagacttgtagtaaatgatttccacacttctcctcggctgttagtccttgctgtccaccaccctgtactttagaaacaaaagacaggagtaccaggagaagacagccttaaaactcttctttaaaggattcagtaactggggtagcagatgtcaattgccctccagatatcactgtcctagatatagagtgagctgagtactctgaaagctatgggcagccccaaatcttggacccagagtatattcccagtcagcattccaggggtctgaatttcccatcct

SEQ ID NO: 245720 - DNA, 240 bp, Homo sapiens
attggtcactctggagtttagtgcttccttctctgaaacccaagcaggcccaatctcaggaaggtttgggacggtcccttgaaggagttcccctgccaccattcttggggtgactccagctgctgagtttggccggagagaaaaccaatctacacgtacaacctttccacctttatcagtagtggggaatgttcaacgccctagctcgacgcggcccgaaaattttagtagtagtaggcg

SEQ ID NO: 245721 - DNA, 479 bp, Homo sapiens
accttgacactgctccccagcattttgaggggctggagattgtcctcttcacacaggccattgcatgggctctggttaacccaagtgtgttttctagtttaaacattgtctctgggaaaaaaagcacatgagcctccccactccttcccttggaaaaacaagatcagaaataatactttctcttttaagcatggtaggcggtttctgatagtacagtgtgagccagcaagactaagaactaaagggaagagtttcagagagattcattgttttttccttctcatctttcacgtcggttttgccaccaagaaaaagaagaatccccctgctgtggctaaatgcgactgtttactttgcttacagacgttgtaaattttttatgtgccgcggttgttttaagagcttttaaagcattttggatgattatataagtcacaaaacagctacagtaaaaatgaatttatttttaaacggtgtca

SEQ ID NO: 245722 - DNA, 467 bp, Homo sapiens
gtttataatatcatggaactagtttttcgggtggagaaacagacattaagcagatagctatgtatttaagtatttagtgttaataagtcctacaagtaaacaaggggtgctaaacagcacatacatggaaattagagttagtgtgttagagaaaactagtctgaaaaatataagtttgagattaaaagaataaataaagaataaatataaaaccgagatgtttggcattaagagagagtgtaaattgtcaggaagctcagaattctattaagcactcaaaataatgaccttatacaataaatttctttccatctaaatgttttctaatctaaatgtttcttctttaatcttcattttaactcgcctatagcttttgttgagatgtaagacctttaaaagacagtcattataagtgtgatttcccaaaaacatacttaagaagcaaaaatcatttgttctcacaattg

SEQ ID NO: 245723 - DNA, 451 bp, Homo sapiens
ctgtgtcaggatgctgttgggtagctggctctgtggacaagtggctgtgagtggaactctctctgagagtagctggaaaaaacccaggctccagctccctgaggagacagcgggaagtctcctgactttgtgggccccagctttctgtaggagagggtattaattctgtctctacctgtgagcagcgagggagggtatgtgccagcaccgtgtacagtacagagctgcatcgtgcaaggagtgtgcctccagttgccaggctccacactgcgggctcagcttgcgtggtagcatctccatcttcatcgccagctcctctgaattttcctttgaaatacttattattattattatttgaaatggaatctcactctgttgcccaggcagaggttgcagtgagccgagaccatgccactgtactccagcctggcgacagagcgagactgtctca

SEQ ID NO: 245724 - DNA, 338 bp, Homo sapiens
ctgtgtcaggatgctgttgggtagctggctctgtggacaagtggctgtgagtggaactctctctgagagtagctggaaaaaacccaggctccagctccctgaggagacagcgggaagtctcctgactttgtgggccccagctttctgtaggagagggtattaattctgtctctacctgtgagcagcgagggagggtatgtgccagcaccgtgtacagtacagagctgcatcgtgcaaggagtgtgcctccagttgccaggctccacactgcgggctcagcttgcgtggtagcatctccatcttcatcgccagcctggcgacagagcgagactgtctca

SEQ ID NO: 245725 - DNA, 296 bp, Homo sapiens
gactaagaaatgacccaaatgttaaagaattatcagataggactttatcatagctataactgataaaagatctgttgggaaacgtggacaacttgcatgaacagatgggaaattttagcagagaggtggaaatgattttcaaaaaatcaagtggaaatgctagaaatgtttaaaagaaacccatgatatcaaagatgaattccttttacatacttaaagggaaggtggacatcattgttgaggaaagaactgtgaacttgaagataggtcaatgattaaaacaggacaaaaagaaa

SEQ ID NO: 245726 - DNA, 516 bp, Homo sapiens
taacaaattagttgggcatggtggtacccgcctgtagtccctgctacccaagaggctgagatggaaaaattgtttgaggcaggaggttgaggctgcagtgaaccatgatcatactactgcactccatcctaggcgacagagtgagaccctgattcttgaaaaaaagaaaggaagaaagaaaataaacattctcctttaattgttagttctctccttcacactgttaaaaccctgaatgggccaggcatggtggctgacgcctgcaatcccagcactttgggaggccaaggcgggtggatcatttgaggtcaggagtttgagaccaggctggccaacatggtaagacccccatctctactaaaaatacaaaaattagctgggcatggtgccgcatgcctgtaatctcagctatttgggaggctgaggtaggagaatttctcgaacctgggaggcggaggttgcagtgagccgagatcacaccactgcactccagcctggatgacagtgagatatgtc

SEQ ID NO: 245727 - DNA, 420 bp, Homo sapiens
tcacaggataaatgtgcgtaacacacataatgtagtgcctggcccatggtaagtctcaataaaatctgacttgtaattatggttccctctaggtgtgaagatcatctcaggatccacagattgatttgaaagtggattcccagtcctcttcctttctgtcattgactctgtgtctctttattactttgggtttttctcacttttcctttcctgatcttcctcctctcattcctttaactagccataattgggattgatttatagctttatttgttgtattttaaaatatgtaattttacattttctctttttaatttaagaagtcaaagaatggaacattttatatttccttcaataaaaaagaacctttttatttgatttttatatatatccccattaaatttcatctgcttggctttg

SEQ ID NO: 245728 - DNA, 427 bp, Homo sapiens
tccttcctccttttttttcttgctggagcattttaaaggaaattctacatagcatggcttttcactcataaatatttcagtatctatttgccagatgaggactgaaaccccaaactattatcacatccaaaaacatcaacaataatttcttcctatcacatacctattgcatatttggttttgctgtatctcaaaaatgtcttttttatatgcagatggcttgttcaaagaatgataaaaacaaggtcagaacattgcactcattgataagcctcttaagtcgtctcttaaatcttttttaatctataaagaacttagctgttttctataatatttaacatttttcaaatttaaaagtctttataattcaatgcaagaaattcatgaaacgcagaaaaagcaaagcaatagttacttgtctcactat

SEQ ID NO: 245729 - DNA, 443 bp, Homo sapiens
gttctaaacttcatgttgatattcaagcgaccaaacatagccacaataaccttgaaataaaaagtaaacagcagggatactcagaattcacaattttcaaatttactacaaagctacaggaatcaagacagtgtggtacccgcatgaggacaaacatataaatcaatggaatggacagttcagatataaaccctgcatttactattaattgattttttttaactaggattctaagacaaatggataataatagtcttaacaaaagatgataggacaattgaataccacatgtaaaagagtaatattggaccctctacttcacatggtacacaaaaattaacttagaatggatcaacgacctaaaactgtaaaactcttagaagaaacattaaagtaaatcttcatgaccttggattaggcaataattccttagataggttccc

SEQ ID NO: 245730 - DNA, 319 bp, Homo sapiens
tgaaataggaagactgcatgaaaaatgtctttcctgttaacaaaggcttgaatacatgcttccggtttccatggcagcccaaccaaacagaaaaataagtcatagaagtggccttttatatcaatgacttgcttcctaaacaataggaccaggagcagtcagtgaaaaaataatgactggtgctgtcctacttatgaaaactgttttacaacttatcagattatttaaaccagagggaacatagtttgaaaataattgacacaaaattggaatttatgttttcattttgactatgtctgtctctagggtcattacttaa

SEQ ID NO: 245731 - DNA, 513 bp, Homo sapiens
tagcaggacagatcctcatgtaagtgttttgggtgaagactgggcattttttggtttgttggttagttggtttaattccagggattctaccgtgagctaggatagggtagggaagcactgggctagaggctggtaggctgtcactgcagcacgccccgggagggcaggatccagaatggtcgtggccaattgcccagaatagtaatggggtgacccaggttggctgggtccctgtcttagggaggaggccttgtgatctggaagcaaccacaggtcttgggacctttgaggagccactggtctgcagtgtggggatgaatgaattgtgagctgtggtgtcacagttttgaagttgtctgccaacttcagataaggctgtgacccccaggagcaactggagctccaacgacttgggaaaaactgtaccttgtacccaaccttggaagctcaactagctcctattccccaagtgccctaagccttttgctcctggcctttgcatagatagtctcc

SEQ ID NO: 245732 - DNA, 429 bp, Homo sapiens
cccacctcagcctcccaaagtgctgggattacaagcatgagccaccacacctggctagtgattttaaattttaaaaaaacttgggaagagaggaaaataaagagatttggaaagatgcattgttcatatttctcaggaaatacttgagggggaaagatgtgatggggcactgtcagatttgctctttatatctctgtattatttagattttaaagtaaatatcacaatcatggagctattaatatttaatcagagtcttagtgagaattacaaaagataatgcattattaaaatgttcatttttggctgggcatggtggtccacacttgtaattctaacactttgggaagccaaggtgggatgatcacttgagcccaggagttcgagaccagcatgggcaacatagtgcatcctcgtctctataaaaaa

SEQ ID NO: 245733 - DNA, 493 bp, Homo sapiens
gagagaaaaaaagcaaaggttagtgattacctaaattggattaagttctgtctagcagcatttaaagaaatgcctcttgctccctaattaccatcaactaagaatttaaacggtctattaaatttaagctgacttttttaaaaaactccctgaaatttccagctgtaacatattctgagattttagaggtttttatatattcttcaaatgtgtagaggacattctctgctttcccccccttttaaaaaatattgcatttctggagcaggataataaatgacatcactatatactaacttcgctaaaaagcagaagctcacagctaggctcagctagaagggtttgtggagagcagtagaaatccatctgaccgtggcctacgggaagaccttgtaaacatctaccccctccaaacaacctgtcattaattatttgttcaatttatttagcatagaattatatgttacataaaattatgtatttactcgtgtaa

SEQ ID NO: 245734 - DNA, 346 bp, Homo sapiens
tacccatggtcaacgaagatgaggggggctttgaagactgctttgggaagtcgggtggtggtcttttccttacacttggccagcttgggtggtgtcccacgtgcggtcaccgttggtgatcagtaaccacctagcatttagatattggaaatttagctttttgcgagggatggggcggcgaggagtgggttgggagtttgggtgagccacggatgacttaaagctggacgctggattatgatcactttgggcttttgcctgcgttctcttgaatggagttttccttcagcatttaagaaggtgttgcactccagcctgggctacgaagcgaaaatccaactcaatt

SEQ ID NO: 245735 - DNA, 411 bp, Homo sapiens
ccttcacgtttttctacatatccaggaactcttgcatcaaggcctgtgtctccatatcttctgtatacttaaatccaacgtagctacatcttgtgtcttacatgaaatgtctacccatgcaaattagctagaacttgcatgagttgggatgatatcctgtctagttccagaatggttgttctatttctttcagaatggctacattggtgacaattgggttagagaaaaattgtgtgattgagccatgtgcattttattccctacactacatgttccatgttgttccatacaagcgagttcttcttcctcctacaaactgcccttacccctccatctcagccctcattaatattcttaatatgggagaggttcttaatatgaacctctcccatagatgttggaggaagttca

SEQ ID NO: 245736 - DNA, 394 bp, Homo sapiens
gtccagtggagctgtcgggggagccagaaagaactgagttgtcatcagctctgaggaggtaactaggctgcaagagaggttgggatttctctttaggaaagtatagaggccagacgaggtggctcatgtctgtaattccagcactttgcaaggccaaggcgaggggattgcttgagcccaggagttcaagaccaggctggtgaacacagcgagatcccgactctacaaaaaatgttaaaaaatttagccgggtgtggtgacatgcacctgtggtcccagctactggggaggctaaggtgggaggatcccttgagcccagaaggttgaggcagtgaactgtgatcacaccattgtactccagcctgggtgacagagcaagaccctgtctccaaaa

SEQ ID NO: 245737 - DNA, 382 bp, Homo sapiens
aatctggcatcgttgtcgcctgtaacagagatgtcaatattagaagtttgaatcctggaatgatcacaagtgggattatttaattcctaagaaggctggcagttgagggcaagaaagatgcatttggaacaatctccaagagttttttgtttttgtctttggtttccaactagaaaaggaaaacagagattcaaatcctaagcagacttttcaaaagacaggcttcttccaagcagtaagaaaatactatttctattcaaagacacttgaagcttgtgttccttcatacctgcctggggtgctgagtttgcagagcctttctgcagacacctgaggtttttatcaatgagaatcatgaagctttggagaaataatatacaat

SEQ ID NO: 245738 - DNA, 381 bp, Homo sapiens
caaagtttatcttttactctttaatggaattggtaatggtttactaccaattttgttaacaagaagtttattcatttttaagattattggatttgcagagatttgagagtttcaattttgcatgatacttctttctaaccaatcaaatttatatgaatatagcacagcaaatactaagaggtaaaccctaaatcatttgtcatgataccttcaccaacagcattgttggttgaagagctaagatctttctctagaaagcttgactcaatttaggaaaataaaatatttggagtagagcttgggagatataattatttttatctaccagtgagaaattgactaataataatatacctattattgattttaactttcatgttc

SEQ ID NO: 245739 - DNA, 471 bp, Homo sapiens
tatgttgtcatttctagaaaatcatacaacatgtaattataagaatggcttttttttttcacttggcattattgcatttgggattcagccatttttgtatgtataaaaagatctgttcctgtatccattgctgaacagtatttcccattgagtagatacacaattagtttatccattcaaggacattcaagttctttccagattttggtgattatgaacaatactgctacaaacatttgtgcacaagtttttgtgaactttgtctagaataaatgccaggttatatggtaggtatatgtcttacttttgaagaaactgccaaactgttttctagagtgactgtatcatgttgtaatccaccagcaatgtatgaaacttccagttgttccacatcctcatgaataccttgtattatcagtattttaatttaggcattctaaaaaatatatactaatgatgttgagcaccctt

SEQ ID NO: 245740 - DNA, 499 bp, Homo sapiens
gagtgaaggccaatggttggtccccctgtcgtggcttgggaggtctctctcaaatgtcagaactgtttttattcttttataaaggctgcttagaaaacaggataacaggctttagtcaggcagatctggcttgaaacctaaagtcattctgcagctgtttgcgtttggacaaatgccttgacctctctgagtatgtttgttctcatctgaaaaatggacataaatcctcctgcctcataaggttgatgaaaggattaagtgagaccctgtctcaaaaaaaaaaaaaaaggaagggcgggcgcagggcctcacacttgtaaccccaggatttggggaggctgaggcagggagatttctggagctcaggattccaacaccagcctgagaaacttggggaacccttgtctctactaaaattacaaaatttagccgggtgtgtggacacaggcttgtaaccccagctactgggaaggccgaagcaaaagaatggcgcaaacct

SEQ ID NO: 245741 - DNA, 406 bp, Homo sapiens
gagtgaaggccaatggttggtccccctgtcgtggcttgggaggtctctctcaaatgtcagaactgtttttattcttttataaaggctgcttagaaaacaggataacaggctttagtcaggcagatctggcttgaaacctaaagtcattctgcagctgtttgcgtttggacaaatgccttgacctctctgagtatgtttgttctcatctgaaaaatggacataaatcctcctgcctcataaggttgatgaaaggattaagtgaggtgatgcaaagaaagcccatttcctggtacataagttcctggtacagagtctcactctgtcgtcacccatagtggaggcttcaataagccaagatggtgcctctgcactccagcctgggtgacagagtgagacactgactcaa

SEQ ID NO: 245742 - DNA, 521 bp, Homo sapiens
gagtgaaggccaatggttggtccccctgtcgtggcttgggaggtctctctcaaatgtcagaactgtttttattcttttataaaggctgcttagaaaacaggataacaggctttagtcaggcagatctggcttgaaacctaaagtcattctgcagctgtttgcgtttggacaaatgccttgacctctctgagtatgtttgttctcatctgaaaaatggacataaatcctcctgcctcataaggttgatgaaaggattaagtgaggtgatgcaaagaaagcccatttcctggtacataagttcctggtacagagtctcactctgtcgtcacccatagtggagtacagtggcctgatcattgctcactgcagcctcgacctcccaggctcagttgatcctcctgtctcagctacttgagaggttgaggtgggaggatcacttagcctgagaggtcagggcttcaataagccaagatggtgcctctgcactccagcctgggtgacagagtgagacactgactcaa

SEQ ID NO: 245743 - DNA, 747 bp, Homo sapiens
tatatatccttctccactccatttgtagatagcttatctcccattgtatcctatcattgccaaccatcagaggtagggccaccttttctttctgacccacactcctacacttactatttctatgtgaaagaaaaagcaaacaaacaaaacaaaacaaaaaattctatttgccattatggcccaatgtgatgagtatgcagggatctgagtgcctaaactcgctgtggtggcacctcaacacagttgactcagagctgtctcctgctaaaagtatatactaaaaacatgttaaatgatggacttccaatagtgtccagcaggttgagactctggtttctttcttcgtttgatattttctgcttcccaaatttcagagattaaaaaatacaaatggaatttgccactatttttatatgtaaagactttttttcccattataagcagaacaaatacaacgtataaatccacttaaaatagtatatttataaccacattcctcattatactacacaacaaattattttatctatactatatatgtgatatattaagctgaagtttatattctttcacctgaagtgctcttctaaaccagtctttaaatttttcattcaaaaatgcccatttcagaatggaagttagtgtaaactctatggcaatttttcaaagaactaaaaatagaattaccatttgatccagcaattccactattgggtatctaaccaaagggaaaggaattattatatt

SEQ ID NO: 245744 - DNA, 387 bp, Homo sapiens
cagataaaacatgttaagtgtttaaaaagttaaataaaaatacaatctaaattaggttatggatatgataaagcaagtagaatatggattattgttagtttatgtgtatcttagtccattcataattgaccttgtattatttgtactctccgggctttgatcatcacaaaaggaaatatttcaaatatttgttttccaagttgtgattctactctgtgaactactacccattaaaacaaatcctataggctttcaggtggagaaaaagaaaataaaagtgctctatactagactgtatctaagtgctttgcaaatttaaatacaggtttgcttttagatctcagccacaatgctatacagaatcttggtatacttaaaaacaagctc

SEQ ID NO: 245745 - DNA, 535 bp, Homo sapiens
tcagcacactgactgcaaaccagttctcatagagatcaattataaattgagacggtgttctggatgctttagtcagatttggctggtaccccaatgatctctgactctatttcttcagatactagtatgaattttcatcttcaattataacctgctaccaggatggcatatacctgatcctcttctatttattatttattttgcagaaaataaaaataggaaaaaaaccctatgtttgtacttttacatttaactcaaaactcaaatattagtgaattcctttgatttatgtgaaaattaaagttggatctaacataggcatccagcctcctttttttgacctttcgtcatactctctttgctactctcaaatttggtcaccccacactggagactggtaatttgcaagttaattcattcatccagaatttattgagcacccatcatttatcttgtactcagctagcagctatagaggagataaggctagttgtaagtatgggatttggtgaatttaatgttattgttttgatta

SEQ ID NO: 245746 - DNA, 360 bp, Homo sapiens
ctccagagggagcaaacagcatgtcttcacatggtgaaagaaatggaagggcataagagccagttagttccctcagcccttgtataacgactttaatccatctatgaggccagaacccttatggcctaatcacttcctgaaggtcccacttcttaatactgttgcattgagaattacgtttcaacaggaattttggaggggacacaaacattcaaaccatagcagtctaaaatgggtgattatgcagtatctgttccaattaatgagcattaattgcattaactaatgcaattaaaaatctggtcttgaaccagtctcattactcctatccttacagcaagaaaaaagctaaaaaaaaaa

SEQ ID NO: 245747 - DNA, 487 bp, Homo sapiens
ctgaactcattgataagtatacccccttcttgctggtcttgcagcctcaggaaacccaggctgttgttaacagtcctagaagcaccagtgtgtgtcctgccacttggcatggatcagtcgcatcataaacatttgtggtattcattaattcacaagttccaaaacaattttcaaatgtgtaagactcattttatttatgcatagagctgccagatgcatagacctgcctcatgttatccataaaagcttctttaaaaagccactttacacaactatgatgtggtagaaacagtcatgggctttttatcaggaatatcatgccctaatccctgctctgaccttcacagctattttcccataaacaattaatttctccaaagtcaaaaccctacgcttaaaaaccaatagaggaagaaggcacaacaattatcaaacatctggtaggattaaatatctccgtgttaaaacaaacacacacacacacaca

SEQ ID NO: 245748 - DNA, 918 bp, Homo sapiens
agttgccccggatgctcaaaggtggagtaggtgcaaggagtggaaggggatctaactgagagacaagtccctccgttaaagaaccataagtgtgtgcactcctcatgcagttgaagaactctggagtcagactgcttggattcaaatacagcctctaccatgtaatatctatgggatcctgagtgagtttccaatttcttcatctagaaaatggggtcataacagtgtcctgctttatagcactgtcacgaggcttcagtgggggctcattcctataaagaggcttagaggcaataaacattcactatgatctcattctatctcccaaacatccgtatacccagcccctggacggtaccttacacacagtagacaatacgaatttgctaaaaaatacccaaatgattattatctctaatttactgtgaggaaacagaaggctcagtgatgagggaacgtgacaaaggtaacaagggaaaggggacatgcgagtccagctggctccaagcccatgctccacacaaacctactgctctccttgccacccacccagcccgcgctccaatgtgggaatccacacaggggaggcggagtggaatctacctacagaggcaggcagaaaggacgcacatggcctgcttctaaactattcactggccgagtgtggtggctcacatgtgtgattccagcactttgggaggcctaggcaggggggtcacttgagcccaggagttcaagaacagcctgggaaacatgggaaaccctgtctctacaaaaaaatacaaaaattagccaggcgactggccaagcgcggtggctcacgcctgtaatcctagcactttgggaggcagaggtgggtggatcacaaggtcaggagatccagaccatcctggctaacatggtgaaaccccgtctcta

SEQ ID NO: 245749 - DNA, 581 bp, Homo sapiens
gtgaactgccaaatttcattcatcattactgatatttattgtgaaccaatccagccaaaagaattctgaacagacactttaaaaacctatgccaaactgaattgaccgtaccaggcttatcacatttaaatatttatttaaaatagtctttaaattataattatgttaattgttttattaaaatcaagagagaaaactaaccatttatcaaactgctgagactgctaaaagatttatcagccttatataaataagacacacttagtaaatattttcattccattcaagaaaggcttttgtgaccgagtgccgtggctcacacctgtaatcccagcattttgggaggccaaggcagacagatcacttgaggtcaggagttcgagactagcctagccaacattgggaaaccccatctctactaaaaatacaaaattagcttggcatggtggcgaacgcctgtagtcccagctactctggaggctgaggcaggagaatttcttgaacccaggaggcagaggttgcagtgagccgagattgcaccactgcactccagcctaggtgacagagcaagactgcatctc

SEQ ID NO: 245750 - DNA, 295 bp, Homo sapiens
ttttgtattttcagtagagacagggtttcaccgtggtctcgatctcctgacctcatgatccgccagcctcggcctcccaaagtgttgggattacaggcgtgagccaccgcgcccggccctctctcttctgtctgtgtttctgtcgctctcctttctctcctctctcttctctctctatctctctctgttatctttgtctctgtctctctctcctctctgtctccctgtctttctctcttctctctgtgtctctgtctctctcttctctctgtctctgtctttcccacccaccctc

SEQ ID NO: 245751 - DNA, 561 bp, Homo sapiens
tgatttttatttttctctttctgggacgtcttacatctttgttaacactactacttctaccctccatttatcttttagcttttctttttatattttctatttctctttttcttcttaagggatttgctcattctggtcttctaatacagtcactcattctcttggctgtacccactgtattatctatcccatcttctgaagcctttattttaaatatctcatttttcaatgttacaacaacttggcttggttctcacattttctttcttttttttaattatactttaagttctagggtccatgtgcacaatgtgtaggtttgttggttctcacgttttctagttctcatttcacattagtatcttcccgtatttcttctattactgttctcctcctttagagaacattcatagtccccttctttccatcttcaaatgctcttccctgcttcaaggttttcacaactgctgttctctcatcccttactcaacctaaacatcatctccttaaggatgccttccctgacccccaaacactaggttggtatcttctattatgatc

SEQ ID NO: 245752 - DNA, 472 bp, Homo sapiens
gcatggtcaccagggtgagatgtgaacaactattgcactgctacatctagcaaggagggtcttgcctctcgcctcagggctagcctagcccacctgggggtcatctcaggaagcccactgcttctagggtaaaaggggataggctgtgaagagcccagagaaatgtctccagggtttaaggatttctagagaaatatgcaccagagctctgtccctccttgtggccaggacttcaggtgcctcctttttgggaagcatttccattctgcctaatcagaaatacattggcgtgggctgggcccatctggggctggtcagataggccttggagaggctcctgtgagggcggctgtccagtgcaaaggaatcactgacagctttggccagcacttctggcttctaaagtgtggcaggagtctgtgaaggagccatggagaaagctgtcccagatgggacggcctagccagggtaa

SEQ ID NO: 245753 - DNA, 649 bp, Homo sapiens
ccaaaaaaagcccaggaccagacggattcacagccaaattctactagaggcacaaagaggagctggtaccattccttctgaaatgattccaaacaatagaaaatgagggactcctccctaactcgttttatgaggtcaccatttccctgatacctcaaattcattcagagtcagggatgagacagctttcactggccacacttcccctcccgctatctgcagtcctcagcgtagccaaatagtttgacatgcgggtgacagaaccccgcaatgcaaaagctggaagaaacctcaagccttggagtccaaccccttttttgacagatgctaagagtggagacatgacttatcaagatcttacaactggctgggcacggtggctgacgcctgtaatcccagcactttgggaggctgaggtggggcgatcacctgaggccaggagttcgagaccagcctggccaacgtgtcaaaaccccatctctactaaaaatacaaaagttagctgggcgtggtagcacatgcctgtaatcccagttactcaggaggctgaggcaagagaatcgcttgaaatcaggaggcagaggttgcagtgagctgagattgcgccactgcactccagcctgggtgacaagagctgacactctgtctc

SEQ ID NO: 245754 - DNA, 444 bp, Homo sapiens
cagcagcatcttgtacaatgacatattctatgtactttaaccaatgggtattcctgaatttcagggcagtgtgggcttcatcttgatttcctctcaggggtactcactcaccttcaccgcatggacatttggtctaatttatttttgagagtttttttcatgctcttgagtccatcaccctgaattggcagtcgttatttcttagtattatttccttaatgtctttttaactataaaggaaaggaaatattacagataatgttgtcatatcctttgatccccactcttctcccccattcccaggggattcacatcatgacacaaagttgatggatatcattctagtcaatatatgaaagctacatatacatatatatatgtatagatataaataagcaatgtttatgttgttttctggacaattaaatttacataactacctca

SEQ ID NO: 245755 - DNA, 781 bp, Homo sapiens
gtcctaaagagccagatacggattcaggacctacctcttactcctggccccttgaagacttgtggaatcagaacaagatcccccttccccctgcaggcatttgaggagtgctgctccagagagcattgccactgaggtcccacccctgtctggcttgggagctgggagtgcacagcctagagacaaggctccctctgaccgaagcccctggagaagtagggccattaacaccctgcaggtgcatcgcattatgccagaggagtccaaactgtccatcagaaagtctgtgtgatgtgagctagtttttacgaagcaaggattttaaaacaagcttaggaacagtgggtgacagcacccagatttgagtggggcacataagcccatccctgtcccccacatgccccgcaaagccaaggccaacctgcgtggtctcaggcgaagggttctgggaacacctggcttcaagcatccctcctttccttctgggatttcaagccccagggtgagctcctgactgtcttggagatgaccccccctcccaatgctacttccccacctatatgttgccagaagatgagaagccgatatcctcagagaatatgagcaaccagccaggatatcgagacacctgaaaagtacgattgcctcagaaaacaataataaaagtccagaaaatatgtatgatcggaagcagaagtgtagaagacagactaacacaggagttcaagaccagcaagggcaacatagggagacctcatctctacaaaaaaatttaaaaact

SEQ ID NO: 245756 - DNA, 407 bp, Homo sapiens
cagttcctaaaatacaacagacatgctctcacctcaggacctttgcacatgctgttctctcttcctgggactcttctcccagacagctgcatgacccagccctcatttcctccttagtgagacccagctctcactaaggccttccctggccaggcaatgcaaaattgtcacccccttccccccattcattctctctcttcttttcctgctttttctccattgcacttaccacctctaatatactgttttgtatattaatctttattattgcttgcctctctccactggaatgtaaaccccaaaggagaaacttttgtctgttttatactttgctgtagccccacctaaaattgtgcctggaacataattgacattcaataaataactgttgaattaatttgttgaat

SEQ ID NO: 245757 - DNA, 807 bp, Homo sapiens
ctgcattgtactatcaacctcttaagaacaaaaaatatataataggtgctcagtaaatgtttgttagttgaatgcatttcatgtcttctcaccactgatgcagataactcccttcctgattcctcagtctcttcctctgctggattacttccaccaacatacagtagtatcttttatcttaaaaacgtaaacacctgcacctctccccacccaataaaacaaaacctcctcagttgattccacatccccttccagttgctaccttctgtccctttttccctctttggcagtatttctccacttcctctccttccttaccgcccactttacagtcttcactctgtgttctcatcttcctcttcagtctttagcatgttctgttggctttatctcaggagtgtgtgctgaatccatactctgccgtatccacttcacttccactaccactgctggaccccgtgccgtcatctcactagggtaggacaggacaacccttctcgctggtctctctgctttcccttttgccccaccagaaagcagtctccacatagatcctgaggggtcttttccaaataaaaactttctgatgtcattggcctacctcaggccacgttcttacacctggagtgaaatccagtcatgctgcctggctgccagccttccgtgttagtgctggcctctctctctgtcattctctgcctgctcttctgctcactgtgctcaagtagttcatgggaaggttgcagagtgttgtggatggtttcaagatgcagtgtttggtctcccaattaaaagaattactaatac

SEQ ID NO: 245758 - DNA, 513 bp, Homo sapiens
ttggcctatggcccccggagtttgaacagtgtccccaggagagaagttgaggtgctcgaaccccgtctgggcttcctgtccggctgtcctgctcctgctgccccaggcctcccccccacaccacacaccacaggcaggcaacttggccctgggatcattacagtccagcacacatgtcccgtcaatcgcagatgtgctcaaaatagatgccgcttgtactcccctccctcccccttctgtgttactcctagagctaattatagtacaaacttctgccctccatgttcccaattctcctgcatgggccttttattcaggactcagaatacaaactctctgggctctataaccaatgtacaccctttcaggaactgtgccttctctaataggaccatgggctaatctcaactgctttcctccaaagaccctttcaaagtggcagcagcaggggcttcaattccatagctggcaaagaatggctgggcttgctccaagatcccaggaaagaatgca

SEQ ID NO: 245759 - DNA, 597 bp, Homo sapiens
ctgatctctttgaatctggtaaggatctagccttgtcttatttataccagcaagcagtgttgtcacttaatgctctcatttttcatgtaaatgactgacattttcccaagtcttcacaagtgatttctgaagatgttgctgcattgagcagagactatgtcattgtaattgcagaagttttaaaattaaatatgtttaataaaattttagagttctgtttatctggaacacataacacataatggtgtaatgtgtatttaaccataaattagcttcacaaaaagtttgtgtacataaaagtgtttatatccaaagaaattcttatttactgctcagtaatctcttgtgtagaagaaaatatgtaacatagtttgctgagtctttgataataaccctcatgtaaaataaagccgtaaagataaaatgagagttgatactcgatgaaactgatgtgagtgaatagaaactatgaaactgtgtctatgggagagaggaggacatggggctgctgttgtgaagaaggaatttgtacaagttagtccattttctgtaacttttatattctaataaaggaaaaccatatcttcatatttataa

SEQ ID NO: 245760 - DNA, 616 bp, Homo sapiens
actcctgtaattatagtcactacccttctctaaacatcttcctcatgcagtgtgtcttatttgataccactgcaaccctggaaggaaggtgtactggcattggccccacattacagataaggaaaccagggctcagactggtgacctcattcctcaatgtcacaaaggtagtaagaggccaggaagggttagcagttcatctggcaaatgagtggctggctaagtaagccagaggcccaaagtggccactgccctgaagccctccccttacctggagcctgaagccagaagccagtgggcctctggggccagggctgaatgggggaggctggtccctgggactttggattgggaagcatcctgcagttacttgtagggccagggctcgttgctctgaaaagccctctgttttatatctcttgacacaagtaagatatagcaggatagctagaaacaaacaaatagagaaagaaggaactagaagacatccttgtgctctggtatccacatgtgtatctttttatataatctagaaatgtatgtatttcaaaggtttttcattctggaaaagtctgaaaccgacgacccttcttttgtaaaataaaggcctttgcgt

SEQ ID NO: 245761 - DNA, 514 bp, Homo sapiens
cggtaccccaaaccctccacactcctcctggtcctggggagccttgggttccacccctcagatctgatgccaaagactcagtttccatgtctgtgaatgaggatgacaacagcttacctcactggcttcttgggaacagtaagtgaggttaccggtgtaacccagataatgcagtgtctggcacttagaactctataagtggtagtatttagcacttatctggtgcttagtatgtggtgagccttgttctgagtgctttgcaaacattaactcagttttcacaaccaccccaggaggtagacattcttagagtgaaaggcacagagagggtaagtaacttgtcgaagtgcacacagcacttaagtggtggaatcaggacacacacaggcagtggcttcagaattcgcacccttaaccccgcactgacaaggcttccccagcagctggcgttgtcgttgtaattacataaataagcattttactagattaatgtcggggaggagaggtgcggccg

SEQ ID NO: 245762 - DNA, 522 bp, Homo sapiens
cagtagagctcttagcatggtgtgtgtttcagtaaatgcttaataaatgttaattattatgttactcaaccagttcctggagacacttacccaatatgcattcaaaaataaagtacaatctggcaatatgaaatacccaaactaattgtcacactataaaatttaacaccacaacccctgtctgttataattttaacaccacatttctcaaaattcttcctcatgttgttctgcagatttatgtgcttttggactgaaaaatccttaaagtcagagagcatgtcatgactctgaatactatgaaacctgtgaccttgatttactcctcattgtgtcctcccatgaagagtacagtgcctcagccacaaaatttgctcaactgctcttttttgaaggaattaattgtgtggcttaaggaaaattcagattcaggctggcctatactcaaagtaaagaaagagatatttcccctttttttgttttaaagaataattaaaaaggacaccttttggcttacatagg

SEQ ID NO: 245763 - DNA, 672 bp, Homo sapiens
aggtactgatttgcttttggggcagaaagcaggggcttttaaagtgggacttggcatgaatggcatgcaggggagggagcaagcaggtgaggatctacatgactctccttagcgcttttatctaccgggtgtttgagctggcaccatggcaggcaggactagattgtaaagtggccattgtctgagatgctctccaagtgggacagagtttcctagcaggcatagtttagattgtaaattgactgttgtctctccaggcagtctcctggtgggagagatttctggcttagaaccttctaaaagcacatggttaaataagcttgccctgtaaggagtgtctggtgaagggaaggtaaagattataattgcatttctaaggaactaagtgggaagtgggagaaaggagaaaaggagaaaagaaaaaaaaaatgttttaaaacacagttatctttctcttagaaaaatgggggtactcagtaaacagaattagaaaatcaccatttggcaatcatcagacaagaaatatcaatgtttgctaaatctagtggggaaaagttgaataaggaatgagttacttacataggttcaaagcatctccccatgaaattcttatttaaaaaaacaggaactttacaaaagaggaatctagtagatatcgtcttactcatgaca

SEQ ID NO: 245764 - DNA, 742 bp, Homo sapiens
aactgacttagttatgaaatcctggaaaactaccacctattcatagtaccccttgggtaaataatttaggctctctgaacctaaggctcctaatctgtgcaatgggagagaagagtttggaaatattcccacctcatagaataatcatgaggattacccatgaacatgttattttatgtgtacctggcacagtgttgttggtgtatgtgagttctctctgattatacctactcttccaaagaggaaggacaaatgcgtccctagtcatcagagctgatctaacagaaagaacagggagattggagttgtaagttttggatctagtcatttgttcatcattcattcgctaaagacttaagcatctactcagtgccctaccctgtgttaggtcttattagggatatagagcaagtaataacaccattgtcccctgttcttatggaaatgacacactcctggggaggcaagcaccagtggcatgtaaaatgtaaacttacttgaaacttacaagagggccatgtgctgctctgtgtttggatccaagtgcattaacaactttaggagctagaagggagaggtgactaggcttgagcacccagagagaggcagcttactgcaggaggaggggcacaggatggactttactaaatgggatcatcttattcctccactaattaatgaagtggccttgggcaggttacttcactaatcatggcctcagtttcatcatctcagaaaagaa

SEQ ID NO: 245765 - DNA, 192 bp, Homo sapiens
ccaattttccaacaatgtcaacagttatttaaatggaaatatagatcccagaagtcaccaaatgtgaaacacagtgaaattattccttaaaaatggaggatattttatcattaggcatgacttacctatttcataattatgttcatttgctttctaaaatggaaagagaataaaaagcatgtataacctttt

SEQ ID NO: 245766 - DNA, 588 bp, Homo sapiens
gggtccactagatcatcagtcctcaaactctttggcaccagggacaggtttcatggaaggtaatttttccatggggttgtgggggtaaagatggtttcgggatgaaactgttccatcttggatgatcaggcaacctagatccctcgcatgtgcgggttacaatggggttcacactcccatgagaatctaaagccaccactgatctgacaggaggtggagctcaggcagtaatgcttgctcgcccatggctcatctcctactgtgtggcccagttcctgacaggccacagactggtactggttggtggcccaggggttggggacccctgcactagatcactttgccataataagatgtcctcagattccctctgccaggtctttattttactttctccaaaggctattttctctttttcttcctggaactctgaacaccctttcctgtgtttgctaagcgataagacaattttgttcacaatgttatactatgagaattctgaataggagtgagaaatgaactccactgataatcatcctatggtaaatctacttcagtgagttatagaataaaaattagactatgaaa

SEQ ID NO: 245767 - DNA, 346 bp, Homo sapiens
gcgcctatgagaaagggaagcagaccttcattctgttgttgcagctgagttcttgcttatctcctgacagggcttctagctgccctttggcctcagccatcataatctgcatcctctaccaggccactgaagctgagttgcagaattctaaaacctagcggcattataatttcattatttttattctgacttttgtattttttaagaacttttatataattcacctaccatacatacagttcacccatttaaagtgtacagttcaaaagtacctagtagtatttacagatatttgcaaccattatcacagtcaattttagagcattttcatcacctcaaaaaaaaa

SEQ ID NO: 245768 - DNA, 722 bp, Homo sapiens
tctttgtaggtgggaagtacagacaggtgatgatacttgcaaaaagtttcctgcaatcttgcatcgtcacccaggctacagtgcagtggtgagatcctggctcactgcaacctctgcctcccaggttcaagcaattctcctgcctcagccacccaagtagctggaactacaaggcatgcaccaccatgcccagctaatttttgatttttcagtagaaatggagtctcaacatgctggtcaggctggtcttaaatcctggccgcaagagatctgaccgcctcggcctcccaaagtgctgggattacaggcataatccagtgcacccagccctgattcagtgactattgaaaccccaggaattcaaggataatatcaggatttaggaatgtgaactgcttaaaatcacaaagtaatagtagtggtttctattgcccattttaaagtatctacaaaatcacttttttggtgttataattcttttaacaagtacgttgaataaaggaatatagttaagtactggcactaaataaaaactgctaccaaatatttgacttataagaccattattattattattattattcatgtgttattatttttcatggagttttgaagaccaaaaatatctgaaaaacattttaatctggccagttgaaaactagtgaatttcaaccagatgtttttaataccactttaaaaataaactgcagccattttattat

SEQ ID NO: 245769 - DNA, 541 bp, Homo sapiens
tctttgtaggtgggaagtacagacaggtgatgatacttgcaaaaagtttcctgcaatcttgcatcgtcacccaggctacagtgcagtggtgagatcctggctcactgcaacctctgcctcccaggttcaagcaattctcctgcctcagccacccaagtagctggaactacaaggcatgcaccaccatgcccagctaatttttgatttttcagtagaaatggagtctcaacatgctggtcaggctggtcttaaatcctggccgcaagagatctgaccgcctcggcctcccaaagtgctgggattacaggcataatccagtgcacccagccctgattcagtgactattgaaaccccaggaattcaaggataatatcaggatttaggaatgtgaactgcttaaaatcacaaagtaatagtagtggtttctattgcccattttaaagtatctacaaaatcacttttttggtgttataattcttttaacaagtacgttgaataaaggaatatagttaagtactggcactaaataaaaactgctacc

SEQ ID NO: 245770 - DNA, 538 bp, Homo sapiens
gccttcgggtgggaaactcatatcagtgagatacttgcaaaagtttcctgcaatcttgcatcgtcacccaggctacagtgcagtggtgagatcctggctcactgcaacctctgcctcccaggttcaagcaattctcctgcctcagccacccaagtagctggaactacaaggcatgcaccaccatgcccagctaatttttgatttttcagtagaaatggagtctcaacatgctggtcaggctggtcttaaatcctggccgcaagagatctgaccgcctcggcctcccaaagtgctgggattacaggcataatccagtgcacccagccctgattcagtgactattgaaaccccaggaattcaaggataatatcaggatttaggaatgtgaactgcttaaaatcacaaagtaatagtagtggtttctattgcccattttaaagtatctacaaaatcacttttttggtgttataattcttttaacaagtacgttgaataaaggaatatagttaagtactggcactaaataaaaactgctacc

SEQ ID NO: 245771 - DNA, 466 bp, Homo sapiens
tgaaagaagcttatggatactggaataaaaaatgaacagtgaaaaaaggcaaatatatcagtaaatctacatgaatagtgcttttacgagacaacaataataataatatattgtgacatagatccatatgttagtagagaggaaggcagaaagagagggaaaaaaggaagaagggaggaagaaaaaggaggaggcagagaaggaggaggaagagagagaattttaatatagaattttaatatgaagtataattttatacttcagcagaagcataaaagttgagagagtaaagttatgttaagctccttgctttattaaggaaaagggtaaaaatatcaattcatatttgattttagtaattcaagaattcatattgtagagactagtaaaagagcctatcactttcaaatgaacacagaaaaacaacagaaattataagaactaatcaatccccccaaaaaaggca

SEQ ID NO: 245772 - DNA, 361 bp, Homo sapiens
gacagtggggaacccacttattccttctctggagagcgccatcctgcttgctttgggggtacattcatatatgaatgtttttatatttgtttgtattcacacatatagatgtatgttatacaaggaagaggaggaaggtgcagtgcaaaggagacaaatacacccagtcagtaggaaaaatgtgaatcattctaattacgccaagacctaaaataagttatagctattataatgtgctggaaaggaatgcttttcagctctttagtaaacataattataatgtggctatttaagtaaaagacctaaactgatttgaattatctgagcttgatcttcttgatctttataaacattcaaaaaa

SEQ ID NO: 245773 - DNA, 560 bp, Homo sapiens
tttatttcatgatggggacagaagaattccagaaggagcaaggctctagggtattaaaaccagcacttcagagctttcctcttgtgttaggaccatgacctcattaagctcatgttgttcacagcactggtccttccagggcccctagctctcagattttccatgattttctcatatcagtatgtttccatctagacaatgatcaatgattggtttgttatattaataaagcatcatttacttagttttcagggcagaatatcaatgtggatggggggtatgtcaggtggattttaaaaataaagttgttctacttcatctttgctgtagaaggtatgttatgtccacagcatggttttaaaaggtaattatttagtatctaaagtaatggtatggttcttgattacaagtttggtgtaagtaggcagtgactaaggctcttaaatgtgtaaaattcatatatgaagtggagctctgtacactgttgttggaggaacggtctaacatcaatgttttcagattttcctgtgtgaagttttattaaagagcatataatttga

SEQ ID NO: 245774 - DNA, 446 bp, Homo sapiens
ggcgctctgcataagaaccaggcctgtttctgtagctcctgggggagacttgggtgggggcatgcctgggaccaccaggccagagttctgtccagtgactgcccccaagatgggctggggtggaccaaagctcactctccaaggagaagtcgctacctcaattagctctcctcccaggagcggctccactgatctcctcagaggcacagcaggctcccaagggctgcagccccccgcggcccccagcctttgcccagagttcccggccacattgtgcccgaggccccacgctgcccttttcactccctttgcctggccagcagtaggcagtgcctttgaagtcctgttttctggtccaactggaatctttgctcagaaccaaaattaggctgcacaatcagcttgcaatttaaaatgccacccaagcctccccccgtccccccttt

SEQ ID NO: 245775 - DNA, 483 bp, Homo sapiens
tatatatttttcataaatatgttttattattttttatatttttatattcttttaaactcaaccaatatccaaaagtaacatttggagccatcatttcaacagcaatttgtaactgacacttgaatacacttgaaggtcacaattaataattcttccaatatactttgtgtataacatctaaaattgcggcagatttgtaaaacaatcagaaaagaatgcaaacatcaacaagaatatagtatcatttctctttagaattctagtatttctaagttctgtattttgcttctctgtgttataaaaccaaataaaataggtctggggctgacaaatggctggcaaataaaactgaaaacatcctaaagaaaactcatctggttttacagtaccagagtaagcaaacaaaaatctgcccagattttcatactactagccatgcttcaaagttgacttgaaatcaaacattcctaagtttctttctca

SEQ ID NO: 245776 - DNA, 386 bp, Homo sapiens
ccttggaagtccatcctccagtcccagtcaagtctttagatgactacagcctcagctgagaatctgagcataatatcatgagagtcttgaagctagaaatactcagccaagctgcttctgaattcctaactcacaaaaactaccactagctccagcttgataagggcatggtgacttgactggtgtatcagatgccttaaagatgagggtctaagtttaagtaaactttattcccaggaacactagccaaggagtgcgactaaatgcatgtattgaaacctggatctaatgcgatcgtgaagatatcgttttactaatcttttatttatgtcccacacttggtagggcacacttcagagaaagcaataaacattatctgttaatta

SEQ ID NO: 245777 - DNA, 739 bp, Homo sapiens
accttataaacacagatcgttcatctaccccactaactggagagaaggaaaacgctgggtaaatagaatggagaggcctggctgtgatcgatcagcctcaagaaaggagacagggtaaaagggagaaagaaaaggaagacccaaagtaacccaggaaatcagcacatagaagagacgaacagcccagcacgaagcgctgactcaccgctccacgccttcctggtccttaatgattggcggctggaagcgggaagaaaagatccgtggtgccatttgattggccaacgaattgctcccttgccattggctcagagggcttttgatgaacagatccagaaaatatgtgaagcgaaacgcccacgccccttgaggggctgttctagacctttgctcctggtgtcgtatagagcgggggatatttcaagctggagatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgcttcctagcttgtttgctttcgaccagccaaggagacctggtggcagggttggcaatcaggagggcatgcaaagctgtcatgaggagaaaattcatgctgcatgggaacagtcacacttttggcaaaattccttataa

SEQ ID NO: 245778 - DNA, 629 bp, Homo sapiens
accttataaacacagatcgttcatctaccccactaactggagagaaggaaaacgctgggtaaatagaatggagaggcctggctgtgatcgatcagcctcaagaaaggagacagggtaaaagggagaaagaaaaggaagacccaaagtaacccaggaaatcagcacatagaagagacgaacagcccagcacgaagcgctgactcaccgctccacgccttcctggtccttaatgattggcggctggaagcgggaagaaaagatccgtggtgccatttgattggccaacgaattgctcccttgccattggctcagagggcttttgatgaacagatccagaaaatatgtgaagcgaaacgcccacgccccttgaggggctgttctagacctttgctcctggtgtcgtatagagcgggggatatttcaagctggaggttcctattgagaattcccagggctcacggctgcagggatgctcctccagtctctccaaaatggttcatttggagagttggggtgactctgtttataatttaaatgtctaattccttcctacatgctaaactccttgaagaatgttcgtgtggcacaacatctttctgccgtaactaaacctgtcgtgcaagaagaaa

SEQ ID NO: 245779 - DNA, 277 bp, Homo sapiens
gctgtctttggagttgattttggatcatgggagctgcatcttctgcaccctctatgggggtgtttcctgtgtccacgattaagccgtaaaataggtttattcattatgagtcacattttggaaaaagtgtacctttggagatactaaatcatcaatggccacacagcagatcctttgatttggaacaacttttaaatttgagaggattttcagaaagctctcatcctaaacaaatgtcctgttaccaatatgggaggatcagaatgaaaggacattt

SEQ ID NO: 245780 - DNA, 348 bp, Homo sapiens
ccgtattgaagtgattcagctagaaattgataatcttcattttaacactgctctgagttaatggctgctcttgaaaaggtattgaatccacctggaatttccttgtgtttatggttcaagctgttcgtgagtattataccacttgacgactgaggcagaatcaaagaaagtactaatgctcttcagtaaaatatacaaaactacagacaatggcagtgccttattttgtaaagtatatagctatgagcctttgctactccttgctgacatttggaatttaactgaagtgtcttgttaaaaaacatttatggaaataaaaagaatatctttcctttttagggatataaa

SEQ ID NO: 245781 - DNA, 758 bp, Homo sapiens
tcggcctcccaaagtgctgggattacaggtgtgagccaccgcgcccagcgccaagttcctttcaattattgcaaaataaactacattacaaatatataactaattgttcagacaaaagctctcccacccctctacatttctattcccaatatttacccctcatctttcatctttgataaaaataagccccaaggtactatggattcctaaaatggtacaaagcatgcataaattaaatccttgcagtgacatctaaaacaatgttgtacctaaaaaaaaggaaaagaaagataatactcaaagttggcaagatgtgaggaaattagtttagtactcctcacatactactggtgggagcataataaacctataataaatataaaccttctggagggcaactgtaataaacaccaaaaatgttaaaaagaacactctttttgacctggtcactctacttctagtaatttattctaaggaactaataagaaaaaaatgagacaaatggattccatcacagtggtgtttaagatagcaaaatatcaataaaagattacttaaataaattctacaatcaagaatattataagaccactgaataatgatgtggattctttatttacacacacaaaaacaggccgggcatggtggctcacacctataatcccagcactttgtgaggctgagatgggtggatcacttgagccccggagttcaagaccagcttgggcaacacagtgagaccctgtctctacaaaaac

SEQ ID NO: 245782 - DNA, 493 bp, Homo sapiens
agtatgtgacagagaagaccctgtctcaaaataaataaataaataaatgaataaataaatactatatgactcaacccattcaattcatagctatctacccaaaagaaatgaaaacaaagttctacacaaactcttgtgtggtgacaaaagtgactccatcttggatgctaatttgccatgttgacctcagattaaccgcagtcctgtgaatgcctcctgattccttgtttatttactgtctttaatgtaagaatatgtactcacaatatatcctacctttaggtcaaagcaaccttgatgttatcacgcaactcattctggcctgttctagagggttgcctttcattgtctctatagtgcacataccctttttcctgtggtatataagtcccgggtctggggaataatggtgtggagatctacctgacttgttgctgaccaagaccatgcttgtgtccataagttccctaataaattgccctctgctgataaa

SEQ ID NO: 245783 - DNA, 417 bp, Homo sapiens
tcagatgtcataagagcctattgggtggggggatgctatctcaagccctccctgcctagacctgccttattcccacttatgctgtacagctactctccaaagcagggctaggggacttctctaaagcattgccaccccctcaggctttatctggggaggaagctacacagctcctctattcttgggttgccctccctgtctgggctccggtctgctatcatctatcccttccaggcttattcccaggcaggcagacagggccaggcctgcctctgggtctgactggcagctaagctcccttatccttctctgaagcttctctttacccaggctgtcactttccattcccaatatatagagggaattaactgtatacctggctttctgcagagttttagcctttgaaacttaaaaaaa

SEQ ID NO: 245784 - DNA, 282 bp, Homo sapiens
aaaatgtgaaatctgtccatttttatactgattacatactgaaattatcatttttaatgtctcagctaaatgtgatatgacaatcagtaatcaccagacatttgaggaaatcctctaatgtgaaaaacaaataggtgaaaactttgtaaaaactttttaaaaaaactttttaatctcagagggataagagaagatacagcagccacaaaacaagaacaaagaggcaatgaaagagattatttgaagaataagaaagagcccttggatattgaaatttttacc

SEQ ID NO: 245785 - DNA, 402 bp, Homo sapiens
gcgggctggagttggagatgcctggaaatgaccagcagttctcacctcccatgaaagtggcctccagaccccagattctaacatgctcaccttgaagatcccaagagcccatacctattcagatgctcctccactgcacaggtctgagaagaagggaaatggaggggagagtattatgaccacttctgggccacctttgtatccaggaaagacccttaccctaccccatcttctactggagagagtgggtaggatgcaggctgtcataggaagtgaattggagcagtttgagatcactcagcctcaggagtccataggacctagacatcaccctgcgatgcttccatcattgataaccactaagatctatcaataaacagggcatcttattcaacctaaaaa

SEQ ID NO: 245786 - DNA, 214 bp, Homo sapiens
gtcgacgaccagttgaattttatttaacctttaaaaagataattctaacttttctaggccactgcacctagcctgggtaatctatttcaatttaacaaaccagcccaacactgcatggctttaaacagtaatagccgtttctttaactcacgcatgtgcagtttgggcagggctcagcagggctggctcatctcctctccgtggaggcctgggg

SEQ ID NO: 245787 - DNA, 407 bp, Homo sapiens
tcttgggaaattattccaaaatttcaagcttcttggtatatgcaatagaattagaagagatcaaagttatatctgatatggcttaattatgtacttacattgtgtaactcaaatgactacatttcataatcctgagaaccaattgagtattacagatgtatttgaagtaaacttattcatctcaatttcttcccatttgttataagaaaccctattagtgataaactaagaggtcttcactttataccatagtcgaatcacctgggaaactttctatgtatatgtgtaaatgtgacaagttaatagaggcttttgtagtggtcagttacactgtataattttaaaatgtaggaacttataggaaatctgtcaaaacattgttaaataaataatggaatcaatataga

SEQ ID NO: 245788 - DNA, 682 bp, Homo sapiens
tggtaataagtaagacaaagtacctgctcaaaattatcagcaaaatcaataattttaaagcaagggaaaaataatgcatagtccttactttctaatcagtcctcggcccctcagtttagttcagtaatgattaatatcatcatgatcatgaccatcatcatccactaggttccaggctctgtgctaaatgccagagtacaaatgtaaagaagacagggcctgggcccctgaggggctctgcctagttaactctagggtacatgttggtgccctaattgtgataggtttgacctctagatttcttctagggctacaattagaacacactgtcaatctggaatgagaaccaaccaatgtaagtatctaaaaattgcccaagatgctataacacttgtgctaggtatagcagggtgactgattttctaacaatattgaacctatctgtaaacaatcaatgtttcacacctagatttattttaacacatactgggcttaaaaaattattgtatatacttgtgtacatgatattttgagatagataatgaaaggttactctagtcacacaaattaatgtctgtctaattgatcaaactaaattactcagaatttcacattcgcctgtcagttacatataagatgaatttcaaataattaaatgaatgatgttaattaagtttagtat

SEQ ID NO: 245789 - DNA, 450 bp, Homo sapiens
gcagtggagcaagagctgggggccaggaagggccaccggacgggcagccatggccaggtgaagagcctggagtcccgaatcaggatccacctctccctgctgagcaagatcctgtgcccctgtttctggtgattttgtaagtgctgactgaaccgactgtcgctgggaaataacacacccgtgaccccaagccaaagtttcacccacagacaaggaaacagactccatgaacacgccgactcccgacggtagaaccggggtgcccaccccagccccggtcactgtgtgtcctgcgcaggggccagggcagcccaaggctcagctctgtcctcctgcccagacctcgctcagccccctggacgccgccccgcgcccgctgcctctcctctcctctcctcccaaaggctccaggaccatgtctgcctctgaagcctgacgttacctcccact

SEQ ID NO: 245790 - DNA, 260 bp, Homo sapiens
aggtgaagtggccttctcatcacatcgtgtcaacaatcacatcatcaacaggactttccactgaggatgtgaacaattactggccatggcagcatccaacaggcttctccactgtaaagtcgcttcgttttccccttcccatactctactttttggaagcaagtcattatgtgtagcccacattcaagaaggcgttggaggcggaatcgtcttcaccagggaatatctacattaaacatttgaaattcttctgtaaagaa

SEQ ID NO: 245791 - DNA, 398 bp, Homo sapiens
cattaaaagactagccaggcatggtggcacatgcctgtagtgcaggctactcgagcgcctgaggcgggaggctggcttgagcccaggaggttgaggctgcagtgagccgtgatcacaccactgcattccagcttgggcaacagagcaagaccctgtctcaaaaaatgttaaaaaagaaaaaaattcaattaacccacctttatctcatgccaaaatacaaaatcctaagtgaacaagctaatttcaaatagttcctagaaggtttaaaatttccctgttctgggctgggaccagtggctcacgcctgtaatcccagcactttgggaggctgaggcgggcggatcacgaggtcaggagaccgacaccatcctggataacacggtgaaaccccgtctcta

SEQ ID NO: 245792 - DNA, 748 bp, Homo sapiens
ggatttatcctgtgtattggatcactcattcaacaaatatgttgagtaattttgtatgccaggtatagaatatgcaatataggttcataatttgcttttatggcctaatatatctggggcatgtatctttgttagtagatggagacctgcctccttttgatggctgtatagtagaccataattaactattccttactgatagacatttagatggtttctaattttttgacttcaaaagcatagttttgctatagaaatactttctaagtagaatgttgtatcaaagggcaggaccgttttttaatataattgatactgctaagttgcactccagaaaaagatttgaagtcccacaacagcgtatgtatttatgtctgtttctccatgcctttgccaacactggactcagtagagttcattctcaagtttacattgctttttttatttgtgatgttgagcttacatctcctgtttatttatgttttttgcccgtatttccttttgagttacctcttcatataaggtaaattacaccctctccacccaataaataggtgcagatcattttcttgtttaacttaaaatcttaagtcctgttattggttagaagctgtaagttgcttttttaatggagccttgctctgtcacccagactggagtgcactggcatgatcttagctgactgcagcctccttatgggctcaaacgatcctcccacctatgcctcccaagtagctctggctacaga

SEQ ID NO: 245793 - DNA, 814 bp, Homo sapiens
cacgctcaggcccccctccctccccgccaccaccgtccgcgtttggccggccgtggggaaggaagaaaggagccaaggaggcgaggcatggatccgcagcctcctccacccgcccagggcagcccacctcaccgtggccgaggccggggccgtggccgaggccgtggtcggggccgtggccgtggcagggggggcgctggagcccctagggcgcccctgccctgccccacctgcggccgcctcttccgtttcccctactacctctcctcccccggcacccggactggagccccactgcagggagcttccaggcacaccaacaggcactgaaccccgcgtgatgcgccccaagtgccgttcccgcaccggaccgagacacaccattgtccccgaccaaccatagcgacggacacagggcaccacagaaccaccgacatgaggcatgacgcacgaaccatggaccaccgcacacttcccagaaccggcccagctcaggcgccacctggctcaggagcacgcgggcggcgaggtcgagctggccatcgagagggtggccaaggagacggccgaacccagctggggcccgcaggacgagggctcggagccgcccaccaccgctgcagcaggggccacggaggaggaggcggtcgcagcgtggcctgagacgtggcctgcgggggagccttccacgctggctgcgcccaccagcgccgcggagccccgggagtcggagtcggaggaggccgaggccggggcagcagagctgagggccgagctggcgctggcggccgggcggcaggaggagaaacaggtc

SEQ ID NO: 245794 - DNA, 730 bp, Homo sapiens
acaccccacgcacctctttttatctctgccccgcttcccatctctcccctctctccccacaggcatggatccgcagcctcctccacccgcccagggcagcccacctcaccgtggccgaggccggggccgtggccgaggccgtggtcggggccgtggccgtggcagggggggcgctggagcccctagggcgcccctgccctgccccacctgcggccgcctcttccgtttcccctactacctctcccggcaccggctgagccactcggggctccggccccacgcctgcccgctgtgccccaaggccttccgccggccggcccacctttcccgccacctgcgcggccacgggccccagcccccgctgcgctgcgccgcctgcccccgcaccttcccagaaccggcccagctcaggcgccacctggctcaggagcacgcgggcggcgaggtcgagctggccatcgagagggtggccaaggagacggccgaacccagctggggcccgcaggacgagggctcggagccgcccaccaccgctgcagcaggggccacggaggaggaggcggtcgcagcgtggcctgagacgtggcctgcgggggagccttccacgctggctgcgcccaccagcgccgcggagccccgggagtcggagtcggaggaggccgaggccggggcagcagagctgagggccgagctggcgctggcggccgggcggcaggaggagaaacaggtc

SEQ ID NO: 245795 - DNA, 251 bp, Homo sapiens
cccagctactaaggaggctgaggcaggagaatcacttgaaactgggaggcagaggttgcagtgagccgagattgtgccattgcactccagcctggacaacaagtctccatctcaggagggaaaaaaaagggggtcgggggaatgagttcacagaggaatgacttgagatttaaacccaaaaagcaccaaaatattttgtgacttcctggttctccatagtctttgaaatgtgtttaattttcatgatattt

SEQ ID NO: 245796 - DNA, 303 bp, Homo sapiens
aacccagggccccagaatcctcctccgctgagcaaatgtgcaggccccaccacgtgccaggcagagtttcggttctgggacgagacggggcccaatctggaagactactaattaacaacgtcacagaggggcgagcaagagtttcgaagacaaatgaaggccagacactgcagcacacacctgtggtcccagtgctctgggaggctgaagtgggacactcgattgagctcaggagtttgaggccgcagtgagctgtgatcacatcactacactccagcccaggcaacagagccagatcatctc

SEQ ID NO: 245797 - DNA, 493 bp, Homo sapiens
caaaatcttcctggatgcagtgtggacagctgtggaagatgcagggggcagaaggattggtgaggaagttaggatatgtagggggtggccatggaggcagagaaatgagtggatttgagggttctggggtgcaaaatcaaggcattgtgataaattggttagggtgacaagaggacattggcaagggtgactcctagatttccatgattggttggacggtgttgccttttccttatcagtgtgctatcaaccccacaatacattgtcattatttttgtttaaattgtcagttaggtgtgagccactgcacctggcctgaagcaattcttgtgcctcagctatgtgggagtctgaggtgggagaatcccttgaaccaaggagtttgaggccaggctgggcaacatagtgtgcgaccccatcttgaacaaaaaagaaagaaagaaagagaaaaaaatcacatgaggcactttcataggtgcattatttctcttac

SEQ ID NO: 245798 - DNA, 760 bp, Homo sapiens
gacaacttcccaggagtttaagcaagaaattggtgtaaacccagaagacggagcttacagtgagccagtttgtgccattgaccccaagcttgttaaatgcagaaattaaaactctatttctgtatatcactatggtaaagggttgttggttacctgtaccatcaatccacaaaaggtataaaacttcatgtattattcttattatcttgtgctgataccagagtacctttaaaataccacccaaatttagttccgagaggcagatggagagtttggattgtctccaaaaatctaaaaggcccttgttttgacaattaggtttacgcatgtggtacatattgaggggcacataatcactggtggattggaaatgcatacctatccttgttccttccctaactaaaacggcatttaaaaggagcgaaactcaccaggatggagaaatcgagagattaaaaaaaaaaagcaagctagaaaatggacagattagtttataatttagcagcttcaggaaatggaataccaaggccagcagtgggggcaaaaaaaaactcagaaattaaaaaaaaaaaaaaaccaaaaaaaaaaaaaaatgaaggacttggcagcagtccaaacccctggaggtgggggcaaaataaggattggatgaatctgtctaaccactcaaatcccagatccttttccctacactgcgcagttgggcaacagccctctctcatttgttcattctctagaaaaggtagcccagtctctggga

SEQ ID NO: 245799 - DNA, 561 bp, Homo sapiens
gagggggctagggatatgctctggggctttcatgggaatgatgaagatgataatgagaaaaatgttatcattattatcatgaagtaccattatcataatacaatgaacctttatttattgcctaccacatgttatgggctgaataatggcccccaaagatatctgtgtcctaatcctcagaacttgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagcca

SEQ ID NO: 245800 - DNA, 766 bp, Homo sapiens
gagggggctagggatatgctctggggctttcatgggaatgatgaagatgataatgagaaaaatgttatcattattatcatgaagtaccattatcataatacaatgaacctttatttattgcctaccacatgttatgggctgaataatggcccccaaagatatctgtgtcctaatcctcagaacttgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagccaaaaaaaaaaaagaaacagagaaaaaacaaagcaacacacacagagcgaaaggacagaccaacaaaaaaagagccaacaaaagcaacaacaagagacgaacaataaaaaaacaaagaggagggggccgccgaaactaaaatatgcctccgggggggcaccagcgaaggtcagacacaacagagagtatgcagaccaggggagccca

SEQ ID NO: 245801 - DNA, 632 bp, Homo sapiens
cggacccgagctttctccttcaccagagatgattgtatctcttcacaactccacatccagtgatgtcatgttggtagcttgtcatcagccatggtgggagtatttacaccaaggaaattggcaaccactacaaatcaaagttttgttagtttggttgattggctggttgggttttcttcccccatgaatagctagttactataaagttagcagcacaccactggctggataagaaccatggaaaccaggtaaagcagtgtctaaaggcaggagaagacctgtgcttaaagcactggaaatcaaggagcccatgaaggagaagatgccagggcggtgggtcttaggatgaaggctctgacactggaatgcagtccacatggagtgtggagtcaagccccagaggccatgtaggaggggctgagtactaggcctggtttggggaggggcactggggcagttgagcatccaggaagaacatggctgataacccagagcacgtggcaggcagccttttgagagaaagaaaagagtgtctgtgagctccatgagacttcagaccttgcctcattcatctgtgtccctggtgcctaaaaccatgcatggtacaaaggaggctctatgcaattgcacca

SEQ ID NO: 245802 - DNA, 466 bp, Homo sapiens
aaaattagcacattcatttcatacagtcctgttataattctgttgacaaggttagtcatttgtttaccttaagcaaaatgttctgctttaattaaaatattcatgaataaacaatatttctcacatctcgaatttcatagctggcgttgggctcagcaaaccacagtcagcatttgaaaccataaattgacccctgctgccaaatggcagatatttggtctttagacataatttatatttaactactctgactaattctgaagccacttttcaatactgatctgtgtgtctgtttttgagttcagcattacaaaatattagccaagccttatgccctgctgtaaaatccaaaatgtgggaaatttaaaatagctgtatcaatgaaaatacatttccatttacacagtgaaggatgaaaaatattttgatctttcaggctgatttcaaaagattgccaaaaaatata

SEQ ID NO: 245803 - DNA, 580 bp, Homo sapiens
tattagggaaacaactcatgctttttgcttttaccagataattttgaaagacttgttcctaataaatttggcacgcaatttcctaagatgtccacttctttaaaagaaatgagaacatgtagagaaaattttgaaaaaaaaatgcttgttagaaaagaaatttacatttagagacagattttttaaaggaagtattttcacaaaaggcaggtgacaacattatcacatgtacacaatattatggacacttcctagctttagacagactgtcagttttgttttgcagaaaaccacacaatggcttatctgcttcagagaactttataaacatgataggtaacacattagcatttctaagaaaccatgggaaccctctctgctgagtgatagctcatcatttctccatctctactctttgaagctgggcaaggtaaactatataatagatgtatttacgaaggaggtttaataaggtgaagagaagagcaaactagtcctacttcagagaccctctacaagattctatatttaaatgcagaaagatgtattagccacgtataaatcttgctacctttgagtc

SEQ ID NO: 245804 - DNA, 480 bp, Homo sapiens
actgagttttttggttctcaagtgctttattaagtgctgtctccaaaaatatttaaaaaaacctcaagtcctcagtgtgtgagtgccacagcctcagatatgttgaatgtggtaggagagggacccctcccctactccagaatcttcacacttggccataaacacactccctctacctgaagcaaagctactctgtgacacacaagagggttaaacaaagaaaacctgcatccctcctcagcaaggcctaagctgagttggaagacaaagcacatcagccttagtatcatttgggaggaatttttttacattgtcaatatgctttcagttatgagctctagacagaggtctcattgttttgttgtagggttctccagtatgtggataacattagttgttttagaataggtaattgcaaattagtctgaagaaatctaacaggattcttttaagagcttagatttttcagggaaaaaaaaa

SEQ ID NO: 245805 - DNA, 551 bp, Homo sapiens
ttttttcctccctccacccttgcgcaacaacagcagtcctccaaagagaatgtttgaattgaattatatgaagccctcctttcttcaaatgaagtcacggactctgatggcactggcttgtcaggcaggacgaccggactgggaaagagaccaggtagaaactagtgacctagtgacgggtgaggggcgccaagtggtgcggaccacagtctcaacccccgttccctctcggtgggagtcaagggggaaaagcccttgaatcccgagacggggggatggggcgacgctgcagctggagtacttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgtt

SEQ ID NO: 245806 - DNA, 366 bp, Homo sapiens
taagtactaagtaaaagttggacaaagtatagctttaggagtactgggattttgttgggttcttttttcatcaatgagctcactgtgatgctactgccatgaggtgcttcacatttccccccagcatctgatgtgggcctcatcacagtatttgcacagactacagaaacagctcctccaaaccacaaaagtccccagggaaatcccgagaacctgactgcagtaccctttttacccaatgatccacacatacttggctagtttcatttttatcaccatcactcacagaaaggcaggtgcctaatgatgtagagcggtgtgcatgatgcattgatgggggattagcagaaacaactccttcgcctg

SEQ ID NO: 245807 - DNA, 787 bp, Homo sapiens
agaaaagaaagccatgtaaccatgaaggcagagattgaagtgattcaactataagccaaggcatgccaactgctactgggagccaccaaaagctagtcaaaggcaagggaaccatcttcccgagagctttcatggggagcatggccctataaacaactggatttttgactcaagtctccagaactggaagagaatacaatcctcttttgttgttctaaaccatccaatttgcacaaaaacgtgttttgaacctactctaaccaactgtcaaaaggctgtgttaagtgattctctgacaagaaccgggatttagctgaactaagaagcaaaaattctgcatcattttggtggcgtgtacagggacatgaggaaggaaccttggccattctgatgtttaaccaagagttgagctgagtggctctgaccagcgtggaagatgagagcagcctgaacttacactgtgaaaatgccctggagaaatgcagagatgcaggtttaatgaagtccatcagggtgtccagtttcaatcactaactgttggaactgatcctcagacaagccaggactcaagtacaagcccatctacaaccagatgagcccttagggccactggggccatttctgactttgtgctcttcacacacttccttacattagaataatgtaattgttcagtatgttgtgctttaattttttaagagaatgtcaaaggctagccatgacactgttatgtgtatttcttttaatttaacttttccataaatattaaataatgtaattgttcaga

SEQ ID NO: 245808 - DNA, 892 bp, Homo sapiens
gagtatttggatgaaagaaacagaagagctcattaaacctgcaaaactctattccaatggtgaccagcattacttcacctgggaaatcattgaaaaacaattactgtgagactggattgacagagtcatgctctgctgccaaggctggagtatagtggcactatctcaactcactgcaaactccacctcccgggttcaagtgattcttctgcctcagcctcccgagtatctgggactacaggctctctttttgcctgctgccatccatgtaagacgcgacttgtttctccttgccttctgtcatgattgtgaggcttccccagacacttggaactgcacaaaaacgtgttttgaacctactctaaccaactgtcaaaaggctgtgttaagtgattctctgacaagaaccgggatttagctgaactaagaagcaaaaattctgcatcattttggtggcgtgtacagggacatgaggaaggaaccttggccattctgatgtttaaccaagagttgagctgagtggctctgaccagcgtggaagatgagagcagcctgaacttacactgtgaaaatgccctggagaaatgcagagatgcaggtttaatgaagtccatcagggtgtccagtttcaatcactaactgttggaactgatcctcagacaagccaggactcaagtacaagcccatctacaaccagatgagcccttagggccactggggccatttctgactttgtgctcttcacacacttccttacattagaataatgtaattgttcagtatgttgtgctttaattttttaagagaatgtcaaaggctagccatgacactgttatgtgtatttcttttaatttaacttttccataaatattaaataatgtaattgttcaga

SEQ ID NO: 245809 - DNA, 396 bp, Homo sapiens
aggaaccagagaggatctgggtaagatctcacaggaagagtagcatctgggttgggtgtagtgcataggagtttggcaggcagagggttatgatcataattaccatccccaggaacccctaagtatcccctggcattaaaccagagtggtctgaggccttatgttgtaagtccttggcactccaaacctcagatgaaacaaaaattgatggatgtgctttttgaatagttcactcaatcaggttaattttgacgtttaaagaagcagaaaaccactgctcagccaagatcctgcagaactttcctattctccatcctaagcccttggtgaagtagaactcaaattccctacatttttctttcttttatttttcccccctcttgtgagggatgatta

SEQ ID NO: 245810 - DNA, 260 bp, Homo sapiens
atgccagactaaaaggtcacagataactacacttatcattgctggacaaagctctatccaaatgatggcggagagtgatggcatgtacctgtagtcccagctactcgagagcctgaggcaggagaatcacttgaggtcaggagttaaaggcctccattctctatgattgcacctgtgaatatctaagctgcactacaacttgggcaacatagcgagacatctcttaaaatgataataataataaataaaataactctaca

SEQ ID NO: 245811 - DNA, 477 bp, Homo sapiens
ttaatctcaggtcttggtgatgacatggacaaagaaagaagtatttatttgaccttcgctttattggtttcctagggcaaccataacacattatcacaaaccaggtagcttaaaatggcagaagtgtattcttctgtggttctgtaggcaggaagtctaaaatctaggtgtgggcagggccacgctccatctgaaggctctggaggacaatcttccttgcctcttctagcttctgatggctccagatgttccttggcctggccaggatcactctcatctctgcctgtcttcacaggaccatctctgagtctcttcctttctaaggacacctggcactggatttagggcctaccccaagtccaggatgatctcatctcaagatacttaattatgtctgcaaagaacttttttccaggtaaagtcatgttcacaggtcttggggttaggacttggatctgtcattttggggaacaccat

SEQ ID NO: 245812 - DNA, 377 bp, Homo sapiens
ggatcagaaggtaattattccctgtgattccaccccttttcccataggatatgggaatggtgtagagttgggtggggaggacgtttaaagaaaaacataccctgcccagcatgagaatctgcccggcaggggtaagtcccatggacttactctgtgaagatgtctttcaatggcaggtgaggacacaagagggaagtcctgcctttaaaagccacaaatgggccagacacggtggctcacgcctgtaatcccagcactttgggaggccgaggcaggtggatcacctgaggtcaggagttcgagaccagcctgaccaacatggtgaaatcccgtctctactaaaactacaaaaattagccgggtgtggtggcgagcgc

SEQ ID NO: 245813 - DNA, 424 bp, Homo sapiens
atatactataaaaaagttatatgaatgtggcctctctcaaaatatcttattgtactgtacttatctatttctggacagttgactgtgtgtaactgaaagcaaaactgtggataagaaaggacgtttgtatttcttgtcatttccttgctttttttccctaagaaagcaatttccttccactatgtgtagtttggaattgaattttttgttttgcttttttaaaaaattttaacaactgtttcaagcctttgtgcctcttgtttatgggtgtaagttctggaactggagggtaagaggcagagaacaacaaggctagtcttccgtattctgacaaagacgacctggacacacagtgaaatggacaacaacttaagctttcagtgcagaaaacgctccacatcaaataccagggatactgacagag

SEQ ID NO: 245814 - DNA, 461 bp, Homo sapiens
agatcccttttgggaatggtttggttacaaactggtaaacattttcataaatcttagaataattccatacagaaaattatttgtactctacaaaaatatttattaaaatatacaatacataaatgactttctatgtacaagaaactctccatcttgaaacatttgtgttataatatctgtccctcgtgctctctctcaatatcaagagtacagcaacacccttacatgtctgccactcaccatatattttgggggtaaattgacaaataattaattctgcagttggacgttttccccttcccatcaccattattttcctgcaacttttcaggcaaagggagcagagcatggtgtcacaggaagataatgataataattaatgttaaatccactacttcctcctcctcttaggtattttccctccagtattgattatgaaagaggcttagcctcacatcagc

SEQ ID NO: 245815 - DNA, 554 bp, Homo sapiens
ctggcatctccaccactcgagagcctccccaggaaaggaggaaaagagcttcatccttccctccttacccagccctacccccttcccttcacacgtgcccctgagcacagactgtgactctcagcagtcccatcgggtgggtgggctcagtgtggccttggagggccgggtggaggcttgggggcagggggtgggacctctctatgtggggagccttacagctactgtgctggtggacaagggggagccctgaggggtgggccttttccctggaagtctggttcttctacccaaggaagtctgttctgaaacctcggaggaccctagctgatgtatctcttggcctccttggcctcactgacttgttggcagccaaactgccagatccgggctcccctggctggagagggtcccatactggcataatggtctcttttctggagactggaggctgagggaagcctgggggtcagctgttcttgaccttacccccagcagcctccaggctcccaggcatcgggaaacactgcctgttctctcctctgccatttctg

SEQ ID NO: 245816 - DNA, 349 bp, Homo sapiens
acacacaaaaataagtggtatttctatacactagcaatgaataatatgtaaagttaagaaacaattccagtggggggcagtggctcacacctgtaatcccagcactttgagaggccaaggcaggtggatcacgaggtaaggagatggagaccatcctggctaatacagtgaaacctctctctactaaatatacaaaaaattagccaggagtggtggcacacgcctgtggtcccagctaccagggagacagaggcagaagaattgcatgaacctgggaggtggaggttgcagtgagccgagattttgccactgcgccccagcctgggcaacagagtgagactctatctca

SEQ ID NO: 245817 - DNA, 390 bp, Homo sapiens
actcctgagtctcttctttaccttcgtcactgcctgctttcagatatttttctcttcaggcagccctgcaagtgcctagcaaggatgacaaatgagcttgacttccgcggcgacgtgactgtccacaaacatagcctggagcatgcacaatgcagcggcgtccacggcacagtgcaaatgccggaatgtgctgtggggttggacagagatcattgctgcagaaacaaaatgcagttttagattagcattctaggctatagatagctttgcttaattagaggaataagcaaataagtatcctgagtagcttctggattgtctcaacagaggaaaatgtataagtgaacaagttgcacgtaattaaataaaattcactgtgatctggctgtc

SEQ ID NO: 245818 - DNA, 437 bp, Homo sapiens
cccaagcctgtgaccccattgtccatccctgatttcttgggctacgggatgcagtggcgcccactctggcgagggaggggagagggtctagagttcgttcgtgccgaggtgaaatcagcggagtgggagactctgctttttagcttcagtaatttgaatgcacctctcctgtcatacctgagtagagctcagccaaagagccagaatgctcgctgtctctctgtcgttgaccttgaacaaacacttttctcacgttcatattcacctggttgataatatcaatatgatgaaaatatgaagaagctaggatcccaaccttgcatgcccaggggtgatgggtggagttattccaggaattacaacacttccatggaagtgcttgtaattccagcactttgggaggctgaggtgggcaacaagagtgaaacccagtctca

SEQ ID NO: 245819 - DNA, 532 bp, Homo sapiens
aagtgaactataagagtttttgtacaatctgcatgttgagtgcaaggaatctacactaagatatgaaggggccacgagcagtctgggccctatgacacagttaaccagctgtagttccctttccatttaaagccccacactaaggaagaactgctgggaataaaatccaaattgagtaggatagggataatagagccaaaggaaatagaaggttcagattaatgggggtaagtaaagtttcaggaaatctcacagtgtctgaggtcatgtctttaaacacttgagagaaacaacaaaatagagagttctagagctgtgaagttagaaaacctatcttgactcgtaactcctatgtaaaagttggggaaaactaatttcatattaaaatgagcagtaggaaaagatcacagtcaaatccatggaaacctatttgaaaagtgaaaataaggattagcgtaatgtctccacagtcaagctgtaccagaaagacatatagtttatgaagctagtgtaaaataaaattaatattttg

SEQ ID NO: 245820 - DNA, 413 bp, Homo sapiens
tggtggtgggcgcctgtaatgccagctactcgggtggctgaggcaggagaatcgcttgaacctgggaggtggaggttgcagtgagccgagatcacgccactacactccagcctaggcaacacagcaagagtccctctccaaaaaaaaaaaaaaaggccccaacttcatgaattacatatgccagtaggggagacataattaaatcacaagtaatcatataatttcaggtaataaaaaatgtcatgaagaaaaataaattaggtaagagggctgagaatgggaggcttctattttaaatacagtgggtcagggaaagactgaggataagacaaaatatatatcaaaaccaaactatgccattaaacaaataaatactctcttttaaaaagtaattggtggcagcacaactctct

SEQ ID NO: 245821 - DNA, 812 bp, Homo sapiens
  misc_feature (680)..(680): n is a, c, g, or t
agcggatttgaacagggcctgttgtaagtagttaatgtgtttgacaaccctgtaatatttgatatacctttggaaatgcatgagttactaatttttttgaaatctagttgtttgtaatgattgtcacttatgtctaatatcacaaaatattcaagaaattggagctgtgcaatgaacaataggacttctctttaaaaattgcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatattttgtttggtatatttactaagtgcactctttcaaaacttattctataactttatcaattcatgtgaanttttagctcaatttttcaaagttcactaatattctcaatatttaatgctaaatgctttgcttacattgtaactcaccctaaaaacttttagtgaccaaaatcctaatatgttgggaaaaaagcatatgcata

SEQ ID NO: 245822 - DNA, 639 bp, Homo sapiens
  misc_feature (507)..(507): n is a, c, g, or t
gcagtgaccctcgccccttccttggcagcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatattttgtttggtatatttactaagtgcactctttcaaaacttattctataactttatcaattcatgtgaanttttagctcaatttttcaaagttcactaatattctcaatatttaatgctaaatgctttgcttacattgtaactcaccctaaaaacttttagtgaccaaaatcctaatatgttgggaaaaaagcatatgcata

SEQ ID NO: 245823 - DNA, 682 bp, Homo sapiens
  misc_feature (550)..(550): n is a, c, g, or t
atagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatattttgtttggtatatttactaagtgcactctttcaaaacttattctataactttatcaattcatgtgaanttttagctcaatttttcaaagttcactaatattctcaatatttaatgctaaatgctttgcttacattgtaactcaccctaaaaacttttagtgaccaaaatcctaatatgttgggaaaaaagcatatgcata

SEQ ID NO: 245824 - DNA, 287 bp, Homo sapiens
ctgggaaaaaagccaactgctgtgttcggacacttaaagcctatggacaggcctatgtgttgaggaactgagatatccagccaacagccagcaaggaactgaggtctgacaacaacctcatgagagagattggaagcagatcctgcagccccagtcaagcctttcagttgctgacaccttgacagcaacctcatgagagacgctgagccacgtgatgaggctaagctgcgcccagacttctgtctcataacagctatgagataataaatgtttgttttaagccacta

SEQ ID NO: 245825 - DNA, 222 bp, Homo sapiens
ccatccacagatggcaatgcaactggcacctccagggtggggcagtgggaggccttgagtgggagagaataagccgcaaggcagggcaaatcccgtgttcaccctagtctgtctttcccctctctgggttggttttcctctctgcaaaattaggggttaaatcagtgagtttcctcttgatgtttattattaataataagtaattaaaataatatttaatta

SEQ ID NO: 245826 - DNA, 452 bp, Homo sapiens
aagtgctaagattacaggagtgagccaccgcacctggcgcctattcttaataatgaatttaaataagtagtatcataatttgatcttacgaatttttactaatgaatcttttctgttttatttaatggcagttccatttacatttcattcaacaatggagactactgataaaataatttgaaaactagtctaatctattatttttacaaattaagaaattaaagatcagtttaaatgtgtcttgctcaaagttataaaactagaaaattgcagataccaaactttctaatccttagttcactgtttttctgatttgttacttcatctctgtgttcctgtaatacatctggttcaacaagtcattttctgtgtgccaggcacttttctaggcactggtgatatcccctgaatgtggaattgtgctgaaaataaaataagaaaagtagattcta

SEQ ID NO: 245827 - DNA, 461 bp, Homo sapiens
ttctctctgaggtgatctttatggtaaaggataacaacactcagagcaaacctgatggcagaaaattcctaatcccccacccttttatgcccaatttatatggtataagttagctcaagttcccggaggtccctgaaatcttccaaaggccatctgacatttctgacccttgactccctacttcacagaccatactattgtgaccattgcctgcacttcctagttaaagtgaccgccagatactattgtcatttaaatgttgtataagtgaccaaaaaaacatacctgaaccatgaaaaggaaaaatctaattcttttctagtctttcatgtttgaaagagtcccagatcttttgtattaaagattcctgtaatcactgaagtaaaacaagactaaaataatttaaatcaaaaatccctttgacaaggaatagcccctttttgagttattttccaaactct

SEQ ID NO: 245828 - DNA, 553 bp, Homo sapiens
ttgagatggagcctgtctcccaggctggactgtggtggcacaatctcggctcactgcaacctccacctcccaggttcaagcaattctcctacctcagcctcccgtacctgggattacaggcacacaccatgacacccagcaatttttgtatttttagtagagacagggttttgccaagttggccaggctggtctcaaactcctgacatcaggtgatccaactgcctcggcctcccaaagtgctaggattacaggtgtgagccactgcactctgccttcgttcttcaagtcccctgttttcctacctaattcctatctagttgatatacccattgttgacagtgcagtattatctaactattatggaagaactatttctgtcttcaattctgtccacttttgctgcatatgttttgacagtctgttactgtatacaaaaatatgtacacttgtattatcttcttgctgtatttaatctttaattaatatataatgtcctttgtctcatataatctttatttaaaatctattttatctgataataacatagctgt

SEQ ID NO: 245829 - DNA, 395 bp, Homo sapiens
tacgccaatcaattctattacacattttcctgcaactcctcacttgataatgaagtaatcaaaagaatcagggttttacctataaatattatttcacttgatactttagatgaatttcaggatccttgcatgcagtgtgcccttaataagtaattgctgaatgaatgaacaaagtattgggctgaatcacattattgtatatattcacaaagtaatagatcaaatcatatttttagtacagccagtcatgaattgattcttaaaataaacccatggtgatcattttataaaagggaagacaatttttttaatttggtaagaacacttatactttaatgtatgttttttaacctttcattttgaaataatgttataataaattacaaaagctataa

SEQ ID NO: 245830 - DNA, 188 bp, Homo sapiens
cctcttcggtggcgggggattggggataggtgggggtggcactggggctcagcagccacactggaaggtttttcagggggtttatctccctcttctctgagctgtcgtgcctgttttgtttgcctcggtcccttccccacccccacagttctctgttaaattgtgttattatatttaaacaaatcaat

SEQ ID NO: 245831 - DNA, 950 bp, Homo sapiens
ccgtcccgagtatctcaggtacaacaattgcttgaggacgggcgcggtgactcatgcctgtaatcccagcattttggaagactgaggtgggtggatcacaaggtcaagagatcgagatgagcctcaccaacatggtgagactccgtctcaaaaaagaaaaaaaaaaagcactgggataacaaatagtaggtgcaggaagtagccatcttctatccctcagtctggggacccaagggaagagcctggggatctcagaacccagctgccctgatgagggcttggacggagctaggacccagtcctctgtggaaggcccttggccagtaggtgctggtgtctctctcgggggttgtgcacggttgctagctctgggggtacgagacaaagctgaaaattggaaccaactgctactgctgacagtaagtgcaaggtcctaagtcccttgtttctccttcagttttccagttctcctgcagcaccccctattggcaaccctagagagggcgggctgccaaaggaaagattctgcagtgccagccccagaatcacaaagccaactacaaagagtgcatgtgggctgggcacggtgactccagctaataatcctagcactttaggaggccaaggtgggcgaatcacctgaggtcgggagttcaaaaccagcctgaccaacatggtgaaaccctgtctctactaaaaatacaaaattagcctggcatggtggcacatgcctgtaatcccagctacttgggaggctgaggcaggagaatcacttgagcccgggaggcggaggttgcagtgagctgagattgcaccactgtactccagcctgatgacagagcgagattccatctcaaaaataaataaataaataaggtttcttgtgctttctatgactgcatcagaacagagaatgtcagtatccaataggatgccagtggaattccctg

SEQ ID NO: 245832 - DNA, 850 bp, Homo sapiens
ccgtcccgagtatctcaggtacaacaattgcttgaggacgggcgcggtgactcatgcctgtaatcccagcattttggaagactgaggtgggtggatcacaaggtcaagagatcgagatgagcctcaccaacatggtgagactccgtctcaaaaaagaaaaaaaaaaagcactgggataacaaatagtaggtgcaggaagtagccatcttctatccctcagtctggggacccaagggaagagcctggggatctcagaacccagctgccctgatgagggcttggacggagctaggacccagtcctctgtggaaggcccttggccagtaggtgctggtgtctctctcgggggttgtgcacggttgctagctctgggggtacgagacaaagctgaaaattggaaccaactgctactgctgacagtaagtgcaaggtcctaagtcccttgtttctccttcagttttccagttctcctgcagcaccccctattggcaaccctagagagggcgggctgccaaaggaaagattctgcagtgccagccccagaatcacaaagccaactacaaagagtgcatgtgggctgggcacggtgactccagctaataatcctagcactttaggaggccaaggtgggaggattgtttgagcctaagagttggagaccagcctgggcaacatggcgagaccccatctctacgaaaaatttaaaaattagatgcctgttgtcccagctactaaggaggcagaggtgggaggaaggcttgagcccaggagttcaaggctgcagtgagctatgatcttgctgctgcgttccagcctgtgaaacaaagcaagaccctgtttctaaaaaaaa

SEQ ID NO: 245833 - DNA, 342 bp, Homo sapiens
tgcccaggacacaccaagttgccctgggagtgcttcattcagccttattacaagcaagtttttaaagactgaaggggacaaggagtgggctgatatgaagtcagcaggaattctgactgctttccagagagaaccttagtgactggctataaggtgttggactacaggggaagagttatggtgtccagcgtctggctttttatgtctacttggtgtcagtctggaacccacagagcaattggcttcaagaggtcgttagctcaagtgggagtgacatgtgactgctgtttcagtccagtgactctctgggccagataattaaaggggtctcgcattcctcag

SEQ ID NO: 245834 - DNA, 443 bp, Homo sapiens
ttcctaatcaggtctatttatgcaaagaaaggactgaaattcacatagttctgattggtctgtatagctgaattctgatttgtttgttttcaagccccaaaccagaagtctctgtcagatgtttatttcaaacagtcaatgggagtagtagtttctggccaaagtttatcttggcaccgacaacaggaaatgatttggcttgattatagaaagaggtgctgtgacacctttacaatgtctttctgagaacacagacatccctcacccagctgtagcttcctggttctgttgtaactttgaatacctcagttaaccatgaggagtctattttggtcgtcggccagggctcactttaacaaagctataagaaagataaattaagtgggtccatgaaggttttgaatatattaagcctattttatgtttaaaaatataaagcaaaa

SEQ ID NO: 245835 - DNA, 449 bp, Homo sapiens
actttataagcgtgattctcacaacatgcctggggcttgggactgccagcccagcattacagggaaaggaggccagagacagcaagcaatttgcccaagacgacacagctgttagcggcagaatcaagatctgaactcaggcttctgacactccaaagtcttgatttaactcttcagtgtactgtgaaccttactgcaacagactccagatgagaatctcagcatggtagctaattagttgtgcttggagaagcatgaggagtctcccctgctctgaatttgcaatctgtgtcccccacctggctttctgcctgaagctgcccccatgactcccttctttgtgcaaaagcatggaagcttctgttaggatttggccaactacagcctgcctgcaggtcaaatccagctggccgactgattttataaataaagttttattggaactcaaa

SEQ ID NO: 245836 - DNA, 355 bp, Homo sapiens
agctttgtgcatggggccggctgtgcggtctccgtgctgcactctctccccaggagtccttagcctcagaggagggaggaagcacgacaggagggatcaccgtgaggcatcttcccccagccctgcctccatcctgctcccaacccccggcccccggcagagactggagagccacagggagcactgcccggccccagccaccgataaaactggaattgaagactgtcattgcatggatgttctcttcatatatttaaaaatgactatcaggaaaaagtttgagcctcctaaaaatggtagctggtttgtttttcaacaacaaactttaataaaaactttaatgtttgatatttta

SEQ ID NO: 245837 - DNA, 298 bp, Homo sapiens
aatgttataacagaatacataacagctaagaaaacatgccacattttattttagcattttcaaataatttgtttttggtgtaagcacaggataaaaaaggagagcgtcaaagaaaagagacttaaaaaaataacattcataaaaattaacaaagtatattttggatgatgtttttacaggaaatagtttaagttggtagaatttttaaaatggtactgtattagctaataaaatattcagtacatatatatgtttggatttatgcattaaaaaactaataaaattatttccaactttt

SEQ ID NO: 245838 - DNA, 465 bp, Homo sapiens
agcctgggcaacacagtgagaatctgtctctacaaacataaaaaacatcagctgggcatagtgctgcagccctagctatgtggtggctgaggcagaaggatcgcttgattgcaccaatgaaaccatttcgcatgtgctagaatagctaaaaaacccacaaaaagcaaaataagtgttggtgagaatgtagacctactggacctctcgtggacaaacgatggtccgatcactttcgatgactgtttgacactttcttatacagtaaaagcagttctactcctaggtatttactcaagagaaatgaaacatctatctacaagaagatttacactagaatgttcatggcagtcttccttataatagattaaaaaatctagaaataaaccaaatgtccaccattataagaatgaatgagcaaattgttatattcataaaattgagtatcagtcagcaattaaaaaaaaa

SEQ ID NO: 245839 - DNA, 218 bp, Homo sapiens
attatattgcattgcagggatgcagtgtcttggagcatctagagaagtagcattaacccagggcaatgcaaacctgtggtctccttggcgttgtgctcaacttgcctttattttccctgacaaagaagcatcttcttatgttgctttcttcttattaattgaatttgcctgcagactgtagtgattaaccacaattaaaatagattaatgtataataa

SEQ ID NO: 245840 - DNA, 384 bp, Homo sapiens
aacaacaaaacacagagaatgtactctaagaccatagaaaaaataataaagataaaagcaaaagcagaatttaatgaactaggaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgta

SEQ ID NO: 245841 - DNA, 511 bp, Homo sapiens
ttttaaaaaaaaggtttttaaaattatttctatcgaaagagagcctggttctttcagaaagcatttttttggccttcactgagatgtgtgaatttcaggcacagggttgggagcaggcttttaaaatgaccacttgttcagagaatgatttcacttggaattcagttcataaaaaatagcagcagaaagccaacagagaatcaactcatttgaccctattcccaaagacagggcagcttctgattggcagttgccaccacaaaggccgtgggatgaaattgaatgctggcatgtttcgggatttcttgaagtcagctcagagttaatatgaaacattaccaaggaaaactaggtttttccgtctcgcctgcaaaaagcatcatcaggtaaactcttattcctaggagagaaagtgaaggcccaggtactttaataatttcgatttagagatttagagctgtggaaaagctttctccccaaattaaagaagactctaataaaatttgtgccc

SEQ ID NO: 245842 - DNA, 267 bp, Homo sapiens
aaatggtataacaacaaaaatagccaacaataagatcaaatacagactatataaaattcatgtatgcttaccaggattgtcaagcccaagaaaaaaaggaaatggttgatgaataagaaaggtaggattgggtgatttttttttcctttaaaatgttataacattgcctttataattacatgtttaaattccacaaatagaagcattttgttaactccttcaataccttccagttagtgtactgcactcccactcacacctcatgcc

SEQ ID NO: 245843 - DNA, 538 bp, Homo sapiens
tacattttgtaattggagtggttcagtgaatcctctccagttaaaataggcatactttttaaagtggattacataacctggctaatgagtactcacaatatgccaggcactgtgttaagtgcattatataatgaatgttatactatttaatccttgcagcaactcttaagaggcaggcactattattattcccagattgcagatgagggaataagttgtaggatagtgaatactaagtacccagcaaagcatgagcagcagagcagaaataagtacagtcttaccaaaaacagcagcttgaattggtgtaaaagcaccaaacgagagtcaggatattgttgttccagcctactgtgtgtacttacaagctgtgtgtcgttaggcaaatcctacccttttagggcctcaatttattcatttgtagaatgccggtgttaagggaacaaaagttctgaaccctactcatcagaaccccctggagagcttaaaaaataaagatcttggggtcacacctcagagattttgattcagaagaact

SEQ ID NO: 245844 - DNA, 276 bp, Homo sapiens
aatttaaaattcagtttttcaagtgtataccagacacgtttcaagcactcagtagtcatgaggcctgtggctaccgtattaatagagacacagaacatttccatcatcatagaacattcttttggatagcactgttctacaagtgttttgttaacagtatcgtcttggacctcatgttcatagccacttttgtggttcctaagtcaacaccttttttgccctgagtgtcattaaaggggttgttaagaagtacttttgggtcttctattaaaacta

SEQ ID NO: 245845 - DNA, 1048 bp, Homo sapiens
cggggcctggagggggaaccgcgcgctgcggctgctgcgcttgctccgtccccggacgccgctggcttgcttcccttgtcagctgtgtggggactggcagagggtgtgagagcgggaaacgaccggacgagcggcggggagcgtcctgggtgaggaggaggaagtctggtcttaggtgtgaaggatgctgacgcgttccggcgcgtcgcggtgccactctcggcttctgagcgttgccctacgccgcagcgggttttcctcagctgtgaagcgcggctgcgtcctgcccgggcttccccccgccgggacggttccaacgcccgagcccagcgggcttgggcctccgctgtcgggccaggctagttgctccggggctgggagttacggcaccggggttggggcggagaagacgaactagttcaactcgacccggttaagcaagcgcagcagtgtgtgttcttggatcatagtatttcatgtaaacattttgatttaagagaaacaaaagggaaaatattaaccgttttcaagcatccaaaggcgaaatgcttcatctctgggatggagtagaggagtagcctctgcggttgagttgcagtcgtgggtgcaagaagcagcgctgaagcagagtgcagccccggaatagggcgggatggaatggcctgggcagttcagaaacccgcgaggagtccagggcggaacaggtagggagcaggggattgtattgaaagatgaaactgaaagaggggtagtggagaccagatcatgaaaagccatattaggctaactgtggcgcttatgcttaatcctcattgacagatcttgagatcattttgaaaaatcactttgtcttcagtttggtaaaagtttggagaagggcaggacttggaagaccagcttagggagactaaatagtagtgacctccaagggagaaactggacagaaagaatatttatatttagtgccacagaactccgggggtattgttttctcctttaattttacttgaaaaagtaataaatgcacatactaaaaaattcagagtgt

SEQ ID NO: 245846 - DNA, 543 bp, Homo sapiens
actttgcatatctgcttgcttttgcattagagcttggtcagcactgttgagagatttgcaaatgcaactaacagggctttcttttagcatcctaccctttcaaaaatccaggaggcaaacaatgatcaatgttgtcataagtaatgcagaggatggcaataataataatacctgactttcaccataagccatgtgctgtgcgaaatgcttacctgtattgttttacttcatcctcatcatcccctataaggcagatgctattatgaccctcactctacagatgaggaagttgaggcttagagagaggatgccttactcaaggcctcagaaggggtacttcagcacccccccacttcccttcaagatcctctaaggccagtgctctcatttgacaaatgaaagacagatttggagagacctgagatcttttggacatcaggtttatgtgtcaagcatagttttatttattttattttattttgttattttttgagatcacgccattgcactccagcctgggtgacagagcgagactctgtctca

SEQ ID NO: 245847 - DNA, 343 bp, Homo sapiens
gagtttagcaaattgatcttgttggggctgaaggcccttctgacacatactcaggagtgtcttaagaaagtacaaactatgactatatggctgtttgccctgacacccattctgaaccagatcacaaagttgatctaatccttgccttcatgtgtctggctcccttctttcctctcagggcccatttccaggtagtgctccctcactccctcttttctctccatttctgctggccctccgtctcagattccagagccctcatccagcctcttcaccccgtctcttcttccttcctgtaccttctggctcttgtctattcccactgctttattctcctcccctc

SEQ ID NO: 245848 - DNA, 450 bp, Homo sapiens
ggacatttgaatgacatatcccctctgtcacttctctccggggcccaaggccaccctcctaggttaccacagtggcttcctaatgggccataccctcacttgctttccatcaccccctgagacctggcccctgcatacctctccagcttcacccctcacatatctccctagccagacctatagtatgttttaaaaaaaaaggaaatcgcactcctctggcctctttaccttggcacacatttttccatcacctgacccctgacccacactcccttttcctgtgtaatccaattatctctaggcctcccgtgtttctgtttgtccttcaatagaaggttgtttgtcttgtcttttattgtatttctagaaccaagtgcagagactgtacaaagtggacctcagcaaagatttaccgaatgaataaatgagttcagaacgctgacttaactc

SEQ ID NO: 245849 - DNA, 432 bp, Homo sapiens
tgaaaggttaattcaagtttgtgaagtagatgtatgcaaagacataaaggtcactgaagagagtttgggagaactgtatgtacctcagtattgatagctggcaaagtgttcaagaaaaacagcagcaggaaatgagactagatagattggcatggcacgtcctatattctctgccaaggagtttcgactttgtcttacagattgatgaaaaccttatagattgaaccttacagatgggaaccttatggattgaagagattttagtagaggagaaagttattagatttgcattttagaaagaagtagcgtggactatacaaagagcaggtttttttggcacctcatctgttttcacttcctcataaaagaggacatgattgtaggttgaactataccagacataaaattaagaaacttggagtgctatttagc

SEQ ID NO: 245850 - DNA, 126 bp, Homo sapiens
aagtttattttactgaagctagattacaagtatatgaatgtgtgtgtatatgtgattaaatgagctattacatgtaaaagctcttaaaacatggcacatagtaagctgttgctttaaaaaaaataa

SEQ ID NO: 245851 - DNA, 383 bp, Homo sapiens
ccaaggttcaaacgattctcctgcctcatcctccagagtatctaggactacaggtgcatgccaccatgcctggctaatttttgtatttttagtagagatgggggtttcaccatgttggccaggctggtcttgaactcctgacctcaagtgatccacccgcctcggcctcccaacaatcttcccttttgacaaagaagcagcaggatccccaggcttagagccccaggtggctaacattatctagttagaatttagtaataggacatcccctgccttgtctaaatccatctggcccttcccctctggggggttcagatagggaggattgggaccttctataaatttgcttcttgaataaacttgactgaaaacgttagttttaa

SEQ ID NO: 245852 - DNA, 365 bp, Homo sapiens
caggcaatagtgatgctgtttgaatcaggaaactgtccctaaacaagttaagttttctgagcctcagcttcctaatttataaaatgtgcattgccctacccaccatattttgtgggaactgaatgggtatttagagactgtgatgtactaggcagtaaataaatgctcaccagtatctttgttttaatagtttaatgtgtcatcagtcctcttgctagctgactgagaactcagaatctggatgtgtggaggagctggtatactagtatctgtgcgattgggtggttttggtcacatcaggcatcacaggcagatgccaggaaggcagaatgtaaacaaattaaaaacctgcacattgctcaagg

SEQ ID NO: 245853 - DNA, 296 bp, Homo sapiens
ccaggcacacatcctgctcctcaacaactctggggaggaggtcctgttactgtggccctctgacagatgaggaagccaggcgacactgccagcttcagatgaggaagccaggtgacagtgccagcaggtgacactgccagtaagaggcacagcagggatctggtgagacgaccaccagcaaactcccagatgacactgccaccttcagtaagcatgctcaacacacttactttgatttgctaagctgataaaagagcgcacctgcaggaatgccagatgggttgtggcactgtgga

SEQ ID NO: 245854 - DNA, 378 bp, Homo sapiens
tgttctcagggtgagataaagaggaatagagacctggctaagccatctgaaacaaacagacaagcaactcagcactacaatgggactttttggatatatttggaggcaaaggaatatcagttcttgtcaaccttcattttgcagactgtgtgatgtagcagaaaaaagccagagagatgtgggtggaaaccccagcctttctatttggcgaaataacttgaccctgggagagttcctccttttttagcctacaaaattagtaggagaatagagttattatgaaaattatacgagaaagagtatgcaaagtgctaatcattgagactggcttaaagctaggactcaaataaatatgagttctgctatttttccacatac

SEQ ID NO: 245855 - DNA, 494 bp, Homo sapiens
agcattgacattaaatctgtgttgacttgcattaaaatctgacttttaaaactgctatttgaaagtaacaaatcatctagctttgattagagagaggtttgcctggatgcttgcgtcagagggagattaaaaataggagttgattgctttcacacggagagggaaatcctggaagctccttattctgggtatatctgcttccagctgattgttgtttacatctctgggtgtttctagacatctctagaatgtctagaaacattctgaggaactatttctaggacccacactgattagctcacctctctctccttcagaaaggtgtgaaacttctacaaattgtgaatgccaaggcttaaacattttaaggacaagtgcatggtttgctttccaatgaaggattattttggttggcatctgacttggtttgaatttgtttcttatagatatactacacttcttgtatttcatttgttttagcaatggatgactgg

SEQ ID NO: 245856 - DNA, 1406 bp, Homo sapiens
tactgtatcacagggataagtcatgagtccagttagtgtaaaatactcgtcatgggagtaggattatgggtttataaaggcaagagtaacctgaacatttataagtaaacatattcaaagatattctggcctattttaattccaaattaggcatgtttcacaaactttttaacaaatttttaagtagtcataaaatttcacttcccagttcttatcactttttaattttaatttctttggattaatgtcatcattaaaataggaatacatattggatttttctgactaaaaacctttaaaagaattttttacagaattactgtaagacacaatttctagactctattttataaaattttgctgatttaatcagtgattatgaaattaaagtgacaaaaataagcattacattttactgtattatagtagcaccagtcaaaatttttttttttttaagtggccttatggagacatttgcagcatcagccctgtggaaaaggacaaggaacggagttcaacctcacatttcgtaaaggcagtggaaaaaagtcagaaactttaaaattttctacagagcacagaacagaacttcttacagaagcattgagatttagaactgatttttcagagggaaaaatcacaggaaggagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattgcatttatttgcgtcagagcaaagagaagagattattaaaagtgcaatagaccatgctggtaactacataggtatttcattgcggatcaggaaagagcctttagaattcgagcaatatttgaatcttcgctttggaaaatacagcactgatgaatccatcacatctttagcagagtttgtagtccaaaaaatatcacctagacattcggagcctgttaaaagagttctagcacttacagaaacatgtttagtagaacgtgatccggcaacctataatattgcaacattgaagcctttaggagaagtatttgcgttggtctgtgactcagaaaatccacaactttttaccattgaatttataaaagggcaagtacggaaatattcttcaacagagagagattccttattagcaagtttgctggatggagtaagagcctctggtaatagagatgtttgtgtaaaaatgacaccaacccataaaggtcagcgatgggggttactcagcatgcctgttgatgaggaagtagagagccttcacctcaggttcttagctacgcc

SEQ ID NO: 245857 - DNA, 1158 bp, Homo sapiens
gagccggcggcgggaggagctagggctggagcctctccagcctcccgcgaaggtttgagcacaaaatgaacataattagggaaaataaggatctggcatgtttctacacaacaaaacattcatggagggggaagtataagcgtgtcttttcagttggaactcatgcgattactacatataatcccaataccttagaagtaacaaatcagtggccttatggagacatttgcagcatcagccctgtggaaaaggacaaggaacggagttcaacctcacatttcgtaaaggcagtggaaaaaagtcagaaactttaaaattttctacagagcacagaacagaacttcttacagaagcattgagatttagaactgatttttcagagggaaaaatcacaggaaggagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattgcatttatttgcgtcagagcaaagagaagagattattaaaagtgcaatagaccatgctggtaactacataggtatttcattgcggatcaggaaagagcctttagaattcgagcaatatttgaatcttcgctttggaaaatacagcactgatgaatccatcacatctttagcagagtttgtagtccaaaaaatatcacctagacattcggagcctgttaaaagagttctagcacttacagaaacatgtttagtagaacgtgatccggcaacctataatattgcaacattgaagcctttaggagaagtatttgcgttggtctgtgactcagaaaatccacaactttttaccattgaatttataaaagggcaagtacggaaatattcttcaacagagagagattccttattagcaagtttgctggatggagtaagagcctctggtaatagagatgtttgtgtaaaaatgacaccaacccataaaggtcagcgatgggggttactcagcatgcctgttgatgaggaagtagagagccttcacctcaggttcttagctacgcc

SEQ ID NO: 245858 - DNA, 367 bp, Homo sapiens
ttttaacaatttggatagtagctctaaatatttacgatgacagttagatttttggtcgtttcaatagtgactgtgatacattaaattttattttatatgattttattttatgaacctaaaagtaatactgattctgtctttagagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattggtaagtactattttaaaaaaaaa

SEQ ID NO: 245859 - DNA, 524 bp, Homo sapiens
gtgtatattgaatagtaaaagggacatatgtcacaaaacagatttattcctacaaatttacataaaaaataagaagtgaaaaaataaacccagattttgaatgcgctggcttgggagcccagagaccaggcctggcttgcttttaaattgttgtgtgacctcagccatgtacctgtgcctctcaaggcctaaggtcctctctctgtaaaagaggggactacatgagatgatttcagctcaaatatccttggagactctcattgttttctagttgtaaattatgctttttctaatagtaaataagaaacgaaacagtattcatgtatgacagagaatactttgttgtttttactctgtctcaaaaaaaaacaaaacaaaaaggaggcacaaaaccccaggcttcaagtctctgcagcctgctccacatttgggcacagaaggactcagacaggcactgtgtgggcacgaggttttacaggggtggtcagacctcaggctttaatgaataaagacactactcccaa

SEQ ID NO: 245860 - DNA, 572 bp, Homo sapiens
aagagtgcactggacttttctggcagccacatacagtttttcacacacagggggtccaagtttcaatggagagaaacagttttacagaacaggagggtaaggtgagaaactgccagccccgccgcatctctagtaacacgtatggcaaaagatgaggatgaaagaaaagagtgctaatgggggctggcaaacgcttactgtaaaggaccagatggtaaataatttaggatttgccagccagataatctctgtagcaacgactcaactctaccttgatggcacaaaagcagctgtagacagtatatcaataaacgaacagggatgtgttccaataaaactttatttatagaccctgaaatgtgaatttcataggattttcatgtgtcatgaaatactgtttttcaagccatttaaaaaatgtaaaaacctatgacattatgttaagtcataatgaaagaagctagccacaaaggaccacctattgtatgactctgtttatataaagtgggtttctctgtaggcaaacccacagagaaaaaaagtagattagcagtggttgcccagggctggga

SEQ ID NO: 245861 - DNA, 455 bp, Homo sapiens
agatcatgccattgcactccagcttgggcaaccagagcaaaactccaactcaaaaacaaaacaaaacaaaacaaaacaacaaaaaaacaagaaaagactttctaattgacttgaaatccatccagaggcaatgaaagaaaagactggggctaggcacggtggctcacgcctgtaattccagcacctcggcctcccaaagtcctgggattacaggtgtgagccaccgcgtctggccaggattagtttttatttgcagtgtatatattgaacataatataaaaattgttcatttctgtgccatgtgctatataaatgtatttgtttttgattttttggcacaggatcagaaatatatgcttgtttttttttgtttttgtttttagacagagtctcactccagcttgggcaaccagagcaaaactccaactcaaaaacaaaacaaaacaaaacaaaac

SEQ ID NO: 245862 - DNA, 434 bp, Homo sapiens
agatcatgccattgcactccagcttgggcaaccagagcaaaactccaactcaaaaacaaaacaaaacaaaacaaaacaacaaaaaaacaagaaaagactttctaattgacttgaaatccatccagaggcaatgaaagaaaagactggggctaggcacggtggctcacgcctgtaattccagcacttcgggaagccgaggcgggcggatcatgagatcaggagttcgagaccagtgtgaccaacatggtgaaatcctgtctatactaaaaatacaaaattagccaggcatggtggcatgtgctggtaatcccagctactcgggaggctgaggcaggagaatcacttgaacctgggaggcagaggttgcagtgagctgagatcgtccctgtattccagcctgggcgacagaacgagactccgtctcaaaaaaaaaa

SEQ ID NO: 245863 - DNA, 140 bp, Homo sapiens
tgagaagtgaggagcctctccacccggcagccaccccatctgcttctagggtgcctgaggactttggagatggatctactgttgctgttcaagagcaaaccaaatttcaaaataaatatttcagttctttcaaaccaaca

SEQ ID NO: 245864 - DNA, 497 bp, Homo sapiens
tagagacactgtctatgatttgttactcacgctggtcttgaactcctgacttcaagcaatcctcttgcgtcagcctcccaaagtgctgggattgcaggcataagccactgcattcagcctgtcaccttgagttctttaaaagaacttgatggttgaaagcaaaattgttacattgttggatgaggtaggttttgagacagggtcacattttgttgcccaggctggtgtgcagtggtacactcttagctcttactgcagccttgacctcctggacttaagggatcctcccacttactggtgcccccgccccaagtagctgggactgtaggcatgtactgccacacaccagcatgctaggctaattaaaaaaatttttttgtagagacagggtcttactatgttgcccaagccgatctcaaactcctgggttccagtgttcttcctgctgtggccttccaaagcgctgggattacaggtgtgagccaccatacctggct

SEQ ID NO: 245865 - DNA, 469 bp, Homo sapiens
gaagtaggtgagatctcatcttcctcttacctcctgactcttgatctggtgaacactgtgctgtttttgttttattgcacgttgcattatgagtatgccagtcaaataccccggagccccaatgatccataggtgacctgtctaccttgccagggttcggctgcacaccagctttctccagtgattctggaatcctttttattccatccttcgtagactttacgtactcagagattgaaggctagtgagctgggagtcagaagacccagctttcggttttctgattttgcagttaacttgctttgccttccttgagtaagttcaaaacctctctggttagaggtctcattttttttaattcaatagaaaaaaaaagatactattgaactacatggtttccaaggtaatatacagtcctgacattctatatttgccattttaatacaaacacttatttgcatacatttat

SEQ ID NO: 245866 - DNA, 262 bp, Homo sapiens
aatcaatcttttgaaatgtttactagagagaataaccacccatgattatgagtttgcatgtgtacgtgtatacaaagctgtgaagggaacaaactggtaggctgtgtgccatttccaaccagcagagaagtctattttgtcctgcacagtattgtggtagtagtggtgattattttttaataagccaagattttaaaatcagaagattttacataacatttcagatttccagctgctcttgtaaaatcgtaggatctggcaa

SEQ ID NO: 245867 - DNA, 299 bp, Homo sapiens
aaaggaaactgctttttatactctgaaaagctaaagataactccaatttatcagtgctggtgtcacattggtggaaatttttcagcaatgagcatttaagggtgtttcatggactacaggcataaatatgtgacaaactactatggtactacaaaatcaggttaattgtagctttagagtgacgtttactgtgagttttaccaagataatacccattctgttacccttttattagtcctttatttgttgaaagtgttcattccttgctctaacttcaaaatataatggagtccttctgt

SEQ ID NO: 245868 - DNA, 1105 bp, Homo sapiens
atgaggagtttgaattagatgagcactctccagtgtttttcatggggaggatctgttttcaatcccccatatgtaaaggggaaggtggaagggatctgactgctagtagtggactgggggctcttggttctgcaatcaattaactcctcttagaaaatataaataaataaataaataaataaaagaaatgagcaactggagaccctgacctttggatctcatgaaatctgaagtttctccatattaccagtttctaggtttctgagtcttgcagaatactaaaaatgttcatcttgcaacaaagagataagatccaagtggtgaggtcttcattaattagagaagtatctggaatgtttggggaggagttatgcagggaggcagcagcaggcaggagatggcaaacccacaagggtccattggcgtttctggagtaaaatggtttgctaggttatttctggggctttgtgatagtaaagtctgaaaaactgtgtttataaatacgattggaaaagtacagaggttgaattattgccacatgttaggaatgtggaaggttgcttggataaatgagaaaagaaagaaaagaatgcaagtaatgtcctgctggggtagtgcagtattttgtttccaggtagcttcaaagtattaaatatatttacattgacccatgtagctagcaattaataaaacaaatcaataaatgagaacataagatcacccccagttctgccactcaaaactaactgatgtttctgaggtttctaaggggtgatttacaagtgaacatggttccccttggtgatgatgtcctcaaaagcaaaggccatcttccagatatgtgaattctttacccattatgaatcttgttttgttaaagtaactttttctttcaggataattttagatttacagcaaagttgcaaagataataggaagacaaagccccaaagacaaattcccaacacttcctagcaggccagttctctgactaaggtaactgaactttaaggtatttcccaataccgtcttactcaccaatatgacctaaattaccttatattacatttatcaaaattaagaaaccagcattggtatatatatg

SEQ ID NO: 245869 - DNA, 262 bp, Homo sapiens
gtttcttacaaagttaaacctatgatacatcaagcccatttttaggtatttacccaaaagaaatgaaaacatttgttcacaaaaagatttgtacaagatgttcatagcagctgtatttgtaataaaaaaaaaaataatcaaggccgggtacagtggctcctgcctgtaatcccagtactgtgggaggctgaggcgggcggatcacgaggtcagtagaacaagaccatcctggctaacacggtgaaaccccgtctctactaaa

SEQ ID NO: 245870 - DNA, 420 bp, Homo sapiens
gggctaccttttttcaggaaaggactgcattagaccaaaacccaatgccgtgaggaccacagtctttttttgtttgtttttttccttaaaagttttttctttaataatatgcccatggcttatgtagaagtgttgcaagatcttccactgagatagtaatttgtttaaatgtgtttccctcctcctctcttcccaccaccaatttcaagcaatgagcgtggttgtgcttctttgcctcagatgatatttgtggcaggatggacagcagaagccacttgaaatcagagaatattcttagtttttcttaaaacctatgctccccgatattattatggtaagtgtgccaggggatgaggaaggagaaagcagtgcctttgaggtcaacagagggaggaggaaagatttatccagagaagaaaa

SEQ ID NO: 245871 - DNA, 393 bp, Homo sapiens
ctaaaaataataataataagatttaaaaaatcatattttctctgaagccatttttaactttccagaaagaatcagttatcacaccttctgcaaaaccataactctgtacgtaaagcagaaataaatactttaaaacacaatgggatttcaaaaagttcatggaaaaatggaattaaaagttacaaaataaagacataaactttatttctcaacataagctccactaggtgtaagaaacttttataagccacaataatagccattcggagcatccctaaaaaaattgagagccctgggaatttaaccacctcaatgcaatcttttttatattattaactgaagaaaaattgacaccctttacagattttcttagaattaggaaacaaaaaaaaa

SEQ ID NO: 245872 - DNA, 386 bp, Homo sapiens
ttaatccacagcaagctcccttatatcatgtctggtacaacattgaatagaagtggtgagcgcaaacatccttgtcttttcctgatcttaaagagaaagcatccaagctttcaccagagttctcatgagtgagagggagtatcaggagagtcagtggtcagagatttgaagatgctacactgctggcttagaacatggaggaaggagcccatgagctacggaatgcagctctagaagctggaaatagcaaaagaacactttctccacatagagactctagaaggaacacagccctgctggcaccttgatttttaaacaagtgaaagtcattttggacttctgacttccagaaatgatatatgataataaatttatgttgtcttaag

SEQ ID NO: 245873 - DNA, 245 bp, Homo sapiens
ttgagcggccgcccgggcaggtactcactctgcccagacaggatagatggatatcacagaccattcattggtcatatctgacttaacctcaatatgaaattggcccagaaagagataatttctttttaaagaatctgccagcctgaatccatagcttgatattctgaatattctgaatattttttatttagcatccttcaacaaatagagccacaattttttagctgtcttgaggtaggcaaata

SEQ ID NO: 245874 - DNA, 417 bp, Homo sapiens
ttcttagcacttatctatttgacattgttatatatttattgtactcagtccacatacacacatgcacacgcatgcatatacactcacatatgcacgcacgcacactcaaatggaagacccatggggcagggcttggctttgtcttgttcactgtcacagcctgagcatctaaaacagagccaggctcacagaaagggcatgataaatggtggttggatggataattgttttgtcctcaccaaacaatcttagtcaaactcttttaaggtatgataaagtatctaaaagttctggctgggtgcgtggctcacacctgtaatctcagcactttgggaggccgaggcgggcagatcacgaggtcaggagatcaagaccatcctggctaacagagtgaaaccccgtctctactaaaaatac

SEQ ID NO: 245875 - DNA, 911 bp, Homo sapiens
gaccactgaagttgagccccacccagatgtgagcatatgaagatgaatgttggtgaaagcatgcgtcttgcatctggagaactgccttcctccgggagagccatcaacaaccacccattactgtgcagatgatgggactaacttcccttatccatgtgggcttctctgcccagctccccgccactgaggatgtgtttttgcaagacagtcaaagaagagacaagaagtaagccagcagaagccggtgagccaagtaaccctaactggtccacacaaagattgactgaatgactccaacatcatgaactgatcagttccaaagtctactcttcaagaacatgaacaatcatatcattttaaagataatttaatcctcacatggaccaaagtttttaaagaaacaactattcaatcatcggctaaaacacaaaattatacaccaacatttgaaataccattcaatataaaatataaataaatgtctttcaatttatactcaaagacaatatgttttagttaaatcatttgggcactcccaaactccttttaagtgcccagagattgacagagcagttcagctactgcatagccatggattagctatacaatatagaaacaggatctggcttcttcaaaaacgtaatatgatggatcatagggatgtacccggaagagcagaagttgaatataataagataaaattagaaaattgaagatactaagagatgaacattatgtggattttagaatcaagatactgaaagaattcagatacagacatttattactatttttgtttgctagtaaatttggcttcaataaagcccacactgttattttaatttgagtaatacttcaaaatactttcttttgagtatataatataataaaatatatgtgactttaaatta

SEQ ID NO: 245876 - DNA, 373 bp, Homo sapiens
gaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagtta

SEQ ID NO: 245877 - DNA, 629 bp, Homo sapiens
gagactgcatggggagcctgaacttccacgcccatccagtggaaaccagggagcccccctacttcagtgtagagtcagcaaaacctgtgcaggacttctatgccaaaattataaagcactgacgaaagaaagtgaaagggatctaagtaaataaggagacataccatgttcattaattttaagactcaacatagcaaagtcgtcaattcttcccaaatggatgtgggtttaatgcaattcctatcaaaatctcagcaatagtgtttctagataaagacaaaattattctaacatttacatggaaaagcaagtgaactagaatagctcaaacaattctggatgaaaagaacaaactagtaggaatcaatttcaatatagctacgtaatcaagaccctgtggtattgctgaagaaacagacacatagatcaatggaactaacacaatatacccacaaatatatagacacacaatatacccacaaatatatcaaactgatgttttgtgaagatgtgatggcaatttaatataataaaaatagtctttcccaaatggtgctggagcaactggacattcataggcaataacaaacaaaaaccttcagcctaaatctcacttcttatacaagaat

SEQ ID NO: 245878 - DNA, 447 bp, Homo sapiens
agctgactaaattaatgagtagttttttatgctacttagtatacttcagcattgtctccagaaacaggaatgttttatataaaacatgacaaagcagctggagtggggcagagacatggaagcattctcatgtccttccatttctcaggggtgctgcagttcactgaggagcagagtgtggaagttacagcatatctgagctatggggtgtgtgggttgtgttatacccaggttctcagggcctgcttttctaaaacgctgggtaactgcaggtgtttgttgtttgctaactgtgtgtagatatcatctgtgtatgcctggcaagaaaggagttaataaatgtcacgtctataatcccagcacttggggaggccaagatggaaggatctcttgagtccaggagttcaagaccagcctgggcagcataaggagaccctgtctctattt

SEQ ID NO: 245879 - DNA, 429 bp, Homo sapiens
tcatagatttgacttagcacatgacttgtttcctccacagttcccccattaagtggctaccaggtgatttaatgagggtgtattcagaaaccatctagaaaacagaccaccctccctggtgtatatatgacttcgtagaatttttagcaatagatcttgattattaaaacaaggtttctattattttaaagattgcacaaagaaggtgaaagtgaagagagaaggcactctagaaaacacaaaccatattagatgacattttggaaagaaagagggcatttaagggagaatgttggcaaagctaaaaaggagtagcttcaaaatagaggaaaaattatttgacattaatggatattacaggtttctagaatgtgagaattaaaagacaccttagagattctgtagcccactcctttgcatttatagatt

SEQ ID NO: 245880 - DNA, 621 bp, Homo sapiens
cattaaaggatgaaaagccagtcagcaacatgggatcatgttttaaaactgtctctggatgaatgaatatctctactctttcttcaagacccagtccctacagttgacaaccagggtggttctccaccaattcctggctcagggctttgctggaattgccaacattaccattagaaatcatttggggctgggcgcggtgactcacgcctgtaatctcagcactttgggaggccaaggtgggcaaatcacctgaggtcgggagttcaagaccagcctgaccaacatggagaaacactgtctttactaataatgtaaaaattagccgggcgtggtggtgcatgcctgtaatcccagctactcggcaggctgaggcaagagaattgcttgaacctgggaggtggaggttgtggtgagccgaaattgtgccattgcactccagcctgggcaacaagagcgaaactcagtctccaaaaaaaaaaaaaaaaaaaaaaatcatctgggagaattcccactctgcccgtcagaaccaagacagttggttccctttgtactcccacatgcataccatggcacctccccaagagctgctgctttctgttgccacacaactccctccctccc

SEQ ID NO: 245881 - DNA, 386 bp, Homo sapiens
ttaatgatttcccagacgagcttattttctctgctgtctttcatatttccctgtaaatgctgcaagacagactctggacctcacctctccagcaaggaatttgaggaaaggctcactgatattgaaaaaaacaacataaaagggatggtttgtactctgactgattttgtgaaaccaaatcattctgacagctgtaggcattgttgtaagtaggtaccccatcattgtcaaattaatcctgaatctgttccttcaaaaagcattaacagagagaatgtagtaactacaatctgaattaaacaaatccttcctcaggaaccctggttctgagaactcttgaaaataacagtttaaactgagtgggattttctcccactaatttctta

SEQ ID NO: 245882 - DNA, 514 bp, Homo sapiens
gtgtatacaccagttggacaaggacgctgccttattcatcactggatctatagtgatttgctcagtgccttgcacacaggcactgttgggccagcacttcccatgatctgagatgtccgtcctccttcctcttcaactttttctccagcagtgagttcctcctcctaactgaggcttccaggaaggatatcctctgcttctcagacctgaacctgccttgaatactcatgaggacccaggagctactcctcacctcccacttctcttccctcctgtcagataaccaaggcacggccaactgatctccaaccatctgaggaacccaaccgtgtgagaccacccacacctttcaagaatgttcctcccctccccttctttgtatttatactgatgcaaatttgctggccatcttaactcagtcctgtgcctcagttctcccacctgtaagatcaggaggaggataaagatgtaagactttctgcacacgttttaagatgaattccttgttaccaca

SEQ ID NO: 245883 - DNA, 711 bp, Homo sapiens
gtaagataggatttccaggtgatagttacaaaaaagagctcaaaaattttaaagactcataaataatagttataagaattatccagagactaaaacattttttagatttatgtttggtgtttaagtagtagaacttttcaagtgttcattttttagtatcatcatcattaataatactcattaaatgttttctttgtacttatggaaagcaccgtgctactacttattgagaaatatgttggggttctggggataagtgaaaggtgtaacatagataatattccaaaattgatagtcttttcactaccacagtaattcttgtaaagtgagatacattttctcttttgcatgctgactaaagtattatgaattattgaccagttatgggttaagctatctaaagaattaagtttcatgtttctcacattcatattgtagtggcgatgggtatctttcctaaattagtaagtgtgccatattatcatctcaaaaattcagctttttctcatgaagataatacttaatggtttttctttctttttaaagagatactatacagcttgatttttattatatagaagcaatcataacactgacttctaaatttcacaggagggattcagttcctcatgcatgcagaggtcttaaatggttcattgagtttcctcttaacacactataaatacctgaattttttggggaaaaaaaaaa

SEQ ID NO: 245884 - DNA, 1215 bp, Homo sapiens
cacttccgggccaggcttccgcgtggtgggcagtgtgggcatcccagcactgagttctgcccgggagaagccgacccctcccgcaatgcccgccccgccgtgcgcctcctgccatgctgcacgcgccgccctccgccgtccgctctcgggccaagcgctgtgcggtgcctgcttctgcgccgccttcgaggccgaggtgctgcacacggtgctcgccggccgcctgctgccgcccggcgcggtggtggccgtgggcgcctcgggcggcaaggactccacggtgctggcgcacgtgctgcgcgcgctggcgccgcgcctgggcatctcactgcagctcgtggccgtcgatgagggcatcggtggctaccgggacgcggcgttggcggccgtgcggcgccaggcggcgcgctgggagctgccgctcacggtcgtggcctacgaagacctctttgggggctggacgatggacgccgtggcccgcagcacagccggctccggccgcagccgctcctgctgcaccttctgtggagtgctgcggcgccgggcgctggaggaaggggcgcgccgcgtgggagccacgcacatcgtgacaggtcacaacgccgacgacatggcggagaccgtgctcatgaacttcctacggggcgacgcggggcggctggcccggggcgggggcctgggctctcccggcgaggggggcgccctgccgcgctgccgcccgctgcagttcgcctcgcagaaggaggtggtgctgtacgcgcacttccgccgcctcgactacttctccgaggagtgcgtctacgcgcccgaggccttccgcggccacgcccgggacctgctcaagcgcctggaggcggcgcggccgtccgcggtgctggacctcgtgcactcggccgagcgcctggcgctggccccggccgcgcggcccccgcgccccggcgcctgctcccgctgtggggcgctggccagccgcgcgctctgccaggcctgcgcgctcctggacggcctgaaccgcggccggccccgcctggccatcggcaagggccgccggggtctggacgaggaggcgacgccggggacgcccggggatccggcccggccccccgcctccaaggccgtccccaccttctagcgacttcgggcctcccgccgggatctgatgccgcggggtgggggctgcctgtaaatgacactgtgaataaacccgttacctta

SEQ ID NO: 245885 - DNA, 232 bp, Homo sapiens
actggggaccccaggcatctgtggctgaggaaggagggcctggggtcgtggactcctgggtctcagggaggagggggctgaacaccttgtgattcttgagcgagtggggattggttggggacctcctgcccagggcctctgctggttctgggtgcgctcagcatggtcctgaccctccttgagcatcagagaagttgaggtgctcaataaatggtgaccacttggacttggt

SEQ ID NO: 245886 - DNA, 821 bp, Homo sapiens
ggacgcccggggatccggcccggccccccgcctccaaggccgtccccaccttctagcgacttcgggcctcccgccgggatctgatgccgcggggtgggggctgcctgtaaatgacactgtgaataaacccgttaccttacctggccttccatgtggggttgggaaggagacgggggcccattcacctgaaaccctgaagaagctgggaccccagacttcgaggtctcagggaagaagggtctcgaactgggcttcaggctctgagggaggagggggctgggggaccatcctaggtctgagagaggagagggccaggactaagcctagaagaagtgggactggggaccccaggcatctgtggctgaggaaggagggcctggggtcgtggactcctgggtctcagggaggagggggctgaacaccttgtgattcttgagcgagtggggattggttggggacctcctgcccagggcctctgctggttctgggtgcgctcagcatggtcctgaccctccttgagcatcagattcctgatgtttcctgtttgcccgcagtggggtaagcggagcgtgacttgatggacacacgccattcacagccgccgtcacgatgcctcccttccagcgcttcgtgtgtagcacgcactgcaccctcatttcgtctccaccacggtctcactggctgtagcctgaagtggtaaatggccctaagacacccagtcggaaggggtcacaccgagggctccctccaaagctctcgaatatcacaggtcgtggaattggtcctcccccacccatcccctctcgaatctctcctggtat

SEQ ID NO: 245887 - DNA, 451 bp, Homo sapiens
gtaattccaatttaaggtatttaccctagaaaaatgaaaacatatgttcacacaaaaacatgcacacaaaacagtacctttattcgcaacagcctaaaactgaaaacaatttaaatgttcaccagaaaatgaatgaactgtggtatagtcatattgtatttaaaaaaacgaaacaaacaaaaatctgtgacaaacacaaattggatgaatctcaaaaacatgccaagtgaaagaaaccaggcatggaagagtacatgttacttgattccatggatatgcaattctagagtaggaaaactaataaacagatcagtggttgcctggggccaagagggagaaatgactacagacaggaaggaactttttggaggtaattcaattgttctaaagcttgattgtagtagcagtgatagtgtatatatttatcaaaatcaataaaactatatagtta

SEQ ID NO: 245888 - DNA, 334 bp, Homo sapiens
gtatcttcatttatcatccgctcccatttcgcaaacaaaatatgccatggtaaatataatctatatatcacattgtgacacagctgaccgcattagtgagccaagactgtcctagcggcagcttcctatcatgcattaacaatacaacggctgatacatttgcacaacacaataagaggtgggggagaagagagaacattgggctatgaaatcctaaacttcatgtctgaatacataattttgtcacctatctctggcatgaatgttatcatgcttactggagtcttgtgtggtacacctataaaaggcttataaactctttttgaaaaaaaaa

SEQ ID NO: 245889 - DNA, 465 bp, Homo sapiens
tttttaaaggagtggggattaagttgttcccagaattcatacggaaaagagccaagaaatgccaaattaagaaaggtaatgaaagtacgccctatgaaataacaagaataattttaaagctacagcaattaaaacagtgttattgatgcaaatatggacaaaaagaattatgaaacggaatagagtcgacacttagacccacacatatatgggaactggatataatacagagatagcattgcaaatcagtaaaggaaaaaaatggactcaataaatgatattgagacaactggttatacatatggaaaagataaaattagttcataattcacaccaaacacaaaaataaattcctgatcaatcaccaaaatgtgcaaggcaaaattttaaaacttttataagaaaatgacttcagggtggagaaagatttcctgaaaaacacataaaagcacaaatcaccaaggt

SEQ ID NO: 245890 - DNA, 455 bp, Homo sapiens
agagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaata

SEQ ID NO: 245891 - DNA, 315 bp, Homo sapiens
gtagattcggtgtcttgccatcatttttaatggaaaaaaacatcttacagttcaatccaggaactttcaaatattgttgtatggcaagcagaaatctattttcgtgggagagaatgggagaggaagatttttcagcttaggggaattattaagttattaaaggtttagaatttaatttttttgcagctgtaattaaactaagattcctattagatggacgcactatttctgccagctagaaattcattgttcttgatttagtctgttaactgtaatttggacagctgatggtctgtatgctcatgtttagttaag

SEQ ID NO: 245892 - DNA, 519 bp, Homo sapiens
  misc_feature (495)..(495): n is a, c, g, or t
ttttttttttgagacagagtctcactctgtcgctcaggctagagtgcagtgaggaaatcttggctcattgcaacctccacctcccagattcaagcaattctcctgccttagcctcccaggtagctgggattacaggtgcctgccatcacgcccagctaatttttgtatttttagtagacagggtttcaccatgttggccagactggtctcgaactcctgacttcaagtgatccgcccgactccacctcccaaagtgctgggattacaggttgagccaccacacctggtaagaatgttgggaaaattttttcatactaacacattggcatatcagttatcagttggataaaagttttcttccatataggaagttataaaatgccactgcccagagacaaaatcttctgaagagttattagatgaatggctgacaacatcgaataaaaatgcacaaagaacattgccataataaacttttgatatccaaagtcgacnggccgccgaatttagtagtagtag

SEQ ID NO: 245893 - DNA, 371 bp, Homo sapiens
ctactctttatttacatcctagcttaaccattctctgaaagtctttcaccttacctgctcttatttaattaatttattattttttttttttgagacggagtctcggtctgtcgcccagactggagtgcagtggcgcgatctcggctcactgcaaactccgcctcccgggttcactccattctcctgcctcagcctccccagtagctgggactacaggcgcccgacacaacgcccggctaattttttgtatttttttagtagagactgggtttcaccatgttagccaggatggtctcgatctcctgacctcgtgatctgcccgccttggcctcccaaagttacgggattacaggcgtgagccaccgcgcccg

SEQ ID NO: 245894 - DNA, 704 bp, Homo sapiens
gggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagacaccgtttcaaaaaaaaaaacaaataacatagattatccaggtgcgcctggggtcgcctgtgaggcagttatatctcttgaaccccgccaggctgctcgttgcagtgagcctagatttcaccattgcactccagactgggctacaagagtgcattccattttgtgtccccaaggaacatgaaacactcgccgcatgattaatgcttctttttaatttcgtaaattgtgtactgcgataaatttattgtgttaaagacactgcgcattctctactccatgctcctttatttctcttcccttttacagttgttctttttttcttagttgtgtctttatcat

SEQ ID NO: 245895 - DNA, 1581 bp, Homo sapiens
cgcagccggcgcggcccctcagctgggggctccgcagtgccgggccccggtccctgcccgcctgcccaacgccgcagcgcccccggcccgggccgccggcaccatgtaacccggccggagcccgagccgggccaggattcagtggtcctgagccttctgaagttaggcttctgcctggtggtggggatcctgacatcaaggatgggacaccctggatggaggttcctggggcctggcccccaagactatgaagagcctttgctgaggccatgaggggttaccatggcgaccgaggcagccatccccgcccagcccgctttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgccgcaagatgactgggggggttaccccaccggtggcaaggatggggagatcccctgccgcaggatgcggagcggcagctacatcaaagccatgggggatgaggagagcggagactcagacggcagccccaagacatctcccaaagcagtcgcccgacgcttcaccacccgtcgctcctccagcgtggaccaggccaggatca

SEQ ID NO: 245896 - DNA, 366 bp, Homo sapiens
attcaataggaatatatgtatattgtaaaacagcatattttaaaaatactgagctaaaatttttaatgccatcacttcctaagtgactagttaaggaactaaaatggaaaagttaatctaactagcatctctacggaaggaaaatggcactacttcctaagttattattttctggttttacttttttgttttgtgaaaatttttaaataaggaaaattccaaagactaaaattgtatcataaatacctatatctcccctttattaataactgctaacattttatcttatttacttcaagcattttagaaaattcagtgtttttctggtataagagcatcccctttaaacaattttgcttctgacct

SEQ ID NO: 245897 - DNA, 506 bp, Homo sapiens
ctaccaagaaagtttatttgttatattatcatacaaatattgttgagtgtttatacaaagcaccatatatcaattcccaagaaaatatatggtaaataaagaattggaaaccatttgtatctgtttcagaaattatgacttataccttatgccacagtgaactctattctgcattcatacaaattaacacaattttttgctaagaaagacctataataaaaacatattaagacattatggtattggatactttccctaatgaaaatcacaatttaattgggggatgatattaggatatatgcaatatttacggaacaatgaagtaagactgtgtggcgtcaactatttcacccaatgaacaaacaggtagctaatatccactttagtttttcttcttatactatcttaatttcttcatagtcagattttcactgttatgaaaaatagcataaataggataaagagcaaacacaatttgtcagttcctgagtagaattcataccttt

SEQ ID NO: 245898 - DNA, 226 bp, Homo sapiens
tcccagaatattactggcaagtaggaaagacaactaattggattccattttactaccctttctctttctatctgatggacataataatattattcaaattattaagaggctggccgtaagatataaatactagcaaagtaaataatagttcatacatggaattacaaggagtttaaccactgagtacaaaacccaggagatccaacttataaattatatataattt

SEQ ID NO: 245899 - DNA, 553 bp, Homo sapiens
aacacaaggtttctagaaaaacatattatcaaagatatgttgattccatgtctttgctattgggaatagtgctgcaatgaacatacaaatgcatgtgtctttataacagaatgatttatatttctttgggtatatacccagtaatgggattgctgggtcaaatggagttgtgctgccctcttagcagcttagaaaacattatttttttatggattatttttcctttggcagttgtcttatttccatacagtcagatccaagtgaaagagtttgtcatcgtgcaatggagtcagactatgtagattaaacccaacttatctttaagaatgaatttatatctcatcaaattacatagttaatcttgaaagatgtcctccttcaaaacctacagtacttaaacatggctgatggcgccaccaagctttattaagtactttgaaaaaaaaatgtttgtttaatgttgtgcacaaagccagactttattattctttccagagcaccataaagagattcctggaaaagcctaaatttaaaggctaattttaagaagtcc

SEQ ID NO: 245900 - DNA, 417 bp, Homo sapiens
atcgtttgaaggaggagaagagcaagtcaaaggccctgaggcaagagcacactgggcatgttcaagcatcgggtgctatgggatacctgcatttcactgtacaaccttggactctccctccctccatgagcaataggagaactcctaggaacaagtctaacactaggacttccagcaatcttgagactaaagccagaggtcacgtgaactacataaactaaattcctccaaatacaaaccaagcttcccaccccaactctccttagctgaaagggtgctcacaggtactccaacacctcctgaagtgtgttggaagtgtgcccaagtggaaagcatcaatatacttcatcaattgctaagaagatatcatattgtaatgttattagtaattcaattattaaaatgtattagtgttaa

SEQ ID NO: 245901 - DNA, 315 bp, Homo sapiens
gaagactgctggctgtggtctgctcttttcattttaattttatgggtgagccaggcatggtggctcacacctgtaatcccagcactttgggaggctgaggtgggcggattgcttcaggagtttgagaacagcctgggcaacataaggagaccctgtctcttcgaaaaaataataaataaataaataaatacgccaagtgcagtggtgcatgcctatagtcccagctacttgggagtctggggaggttgaggccgcaattagccgtgattgtgccgctgcactccagcctgcatgacagagtaagaccctgtctcc

SEQ ID NO: 245902 - DNA, 409 bp, Homo sapiens
ttgatgttaaccttggtctgctggctgaggtactgtttgtcaggtttctccactgtcaacttattcccctgctttcatactatactcttcggaaggaagtcactttgtgcacccacacttaaagagtggggatttatgctgcatctccttgaaggtggagtagctacataagttattttaccaattcacttttaatccccttaggtatcactctcgggagtccgaaatactcagtattgaactatttacagagtactaacacgttccactgtcaaatatacagaagaacattgtaatggaaaatcataaagtttccttacaactttttttttttttttttgagacgaagtctcactctgttgcccaggctggagttcagtggcaagatctcggctcactgcaacctctg

SEQ ID NO: 245903 - DNA, 429 bp, Homo sapiens
ttatggagatgatgaaatcacaatcaaaattccaaactaagttcatctgcaacccacgatcacactacatcttggcgggaatatgctggtttgaagtagtcaagggctggagtttgaaagaggaacaaatgaagcctgaccttgggaggaacttccaaagattctgagccaactcccaacagggagctctcaggattcagcgagtgtcctgagtgtgctgtctgtctgtgacgccggctaggccaagcctgatggttcctcatgagaatgtcctggcctgtgctgctgaaggtgtggtccacagtggggtcagtctgctgtttccagtctccaatgcaactcatccatgaacatatgtgcagagtttgtaaaccttccatttttctgttatttctgtatgtatttattgatttttttgtgtaaaatgta

SEQ ID NO: 245904 - DNA, 716 bp, Homo sapiens
caccacccctatattgttagtcatattttggtgtatttgctttattgcctatctatcggtctatccattcatcaatccttttgtttttgttgtatttcaaagtatactttacacctagacatttccccatgcctattattaactatttgtttacttgttttgttgtgcctgagcgagttagaaaaatgccacactttgagacgaattaagagtcctttattagccggcgaccgagagacggctaacgctcaaaattctctcggccccgaggaaggggcttgattaacttttatatcttggttgaggaagcgggggggtctagttaaaacaattttacagaagttaagtagtcaaaaaaattaaaaggataaatggttacaggaaagtaaacagttccaggtgcaggggctttaagactattacaaggtgatagattcggggctttgggcattatcaatcagacgaattcttggggactgcggatatagcttcccacagtatcttatcagttaattgcattcttggatgtgctgggagtcagcttgcacaagtaaagtccttgagggaaggggctgccagtgaaagccaagatggagtttgtctggttctcttagctaagggagaaacaaggccaggtgaataaggataaaacaaggttgggcattacagtttttaggcaaaacttgtatatagtaaaatgtacaaatcttatgtat

SEQ ID NO: 245905 - DNA, 488 bp, Homo sapiens
ctacttctccattcgaacttgaagagttttacacgtttgccctagttgttttgactttattcccagaggaacagctccatcctttccgatccggaagaactttacattcttctccctctagacatggctgcatatggcaccaccatttctgttccactattgaagcatccacacatgatggagcagctcgcgtggtgcctgccacctgcccagggaagcaggagcacttgactgtttgtgaccgttcttctatcttgttcttattacagcatctgtggagtgccaccacctcacaagttcccgttttaacatggtgagctttatgatggtttgcactggatacaactttcccccacaaggttacaataaatattattattagcagttttccttttgttgctttctgtaagtatctcttactcatcctgcagcccgcttcccggtggcggcaacacctgcgatctcctgcagcttttcggccgcgccac

SEQ ID NO: 245906 - DNA, 519 bp, Homo sapiens
tgaaggacaaaggggtgaacaggagctatgaaacctgaccacaggaatatggaattccatgatgtgaaaaataatgagtgaatgaatttactgcaaggagctgcaatgactcttcttactgacttcatcagctaacaaatacaaaaccaatactcagttgatacaaattgcactgatccaacaaccgatgaaatgttggcaaaaagttcaaattatctttagtcagcgaaagactctaatatttaccaagaaatcaaacaaattcatagattatagtacaatatagatagtttggataatgaacactaagatccttgttgctgtaagactgaaaattacaaaaaacccatgaagaaaacacaaatgaccaataaggagttttagcctctaggtaaattggtatattgtcttgtagatggtcttcctcctgtaacatagtctatcaaccaaacagtgaggttaactttaaaaaataaaaaaaatattttggcattggacaatttgaccttctgctttaaa

SEQ ID NO: 245907 - DNA, 600 bp, Homo sapiens
tctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagaca

SEQ ID NO: 245908 - DNA, 298 bp, Homo sapiens
gcacagtccgtctggctgcgtcgggaagtgtgtttgttccgcctccgccgggtgttttcttgagtactttcatccgctgtgctcctctcttgaaaagcttggaaagcaacctttgggagtttttttctttccgaaaggaaaaggatttctgcccttctggtgaggttggctctggccccgcattctcccgcgtctggaacctatctcttccggcatgttcctggtgagcaacggcggaaaaatggtttcaagagggctgtgacttccatttatttgctaaaaaatgtctcatctgaga

SEQ ID NO: 245909 - DNA, 561 bp, Homo sapiens
tgcaggtactgaggaaaggccatgtgggcaggcagcaagaaggcagccatctggaagctaggaagaaaatccttaccagaacccaaccattttggcaccctaatctcagacttccagcctcctcgaagaaaataaactgctgaacaccatgtggaagctgctaaggcttatggcttacattctttgaggcagtgacctgacatgtaactggatcccgtttagccatggttgaagttggatactccttgctcctcagcttgcagacggcctattgtgggaccttgtgatcatcaaggcaagaaggcctgacacgttcaatgtgctctaacctcctgccaagtagtgtgcaaggttcaagagatggaaaattggaagcgaaagtccttggagaagctctcattcaactgaaagcaaatatggaacagataagaaggcaagaaaaggatcatcacaaatatagcctgactggatgctgtttagagcagtagctattctatatcctcacattctcaggttctataatctgaaaatagctaaataaaaataatagctgagcccaaa

SEQ ID NO: 245910 - DNA, 361 bp, Homo sapiens
atgcctcagctcagaagaggtacgtattgatagccaacacccagggggaatgtgatgctgaccagtgctgtgggtgccagcgcactcgtctgcatcaaaccatcacctcgcagtcacacctacagttctttgcactcaatgcaaagctatggcccaggattgggggagcagcgtgtgctaagacacaggttaggagccatattccccaagcagtggtggctacattcatttctgggaaagctcagcaaagaaatgtgaccccagggacacctaaatttggactttttctgtatgaacacttggaagatttgtagcgttttataaaacttgtattcaattaaaatgtgtttcaatgatctct

SEQ ID NO: 245911 - DNA, 785 bp, Homo sapiens
cccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgaggtctggtaacatggccttggcccacgtccaggcctcgggtgctcaatcaaccatctgcagaatagagatggtctgggtttctcccctaacttaattgttccctggaataaaaattccaccatttcaag

SEQ ID NO: 245912 - DNA, 1401 bp, Homo sapiens
cccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctgatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggt

SEQ ID NO: 245913 - DNA, 367 bp, Homo sapiens
  misc_feature (277)..(277): n is a, c, g, or t
  misc_feature (326)..(326): n is a, c, g, or t
cccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggtaaagcccaagctttccccacgaagtcntgtcctaggctccagcagaccctgtgggctacagccagctctgctccancccgagtactaacggcactttcatccccaaagtactgttca

SEQ ID NO: 245914 - DNA, 2665 bp, Homo sapiens
aaagtgtaaatctctgtcaagggcaggacatctctgctgcagcctctaatctgggaccccccatggggtgaggggccccccgaggccatctgtcctctgcactcccaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttccctttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctcaaaaaaaaaaaaaaaaaaaaaaagaataggaagcttctgatatttgtctttctggagtactatttgctttgtgattcccacaatgcaatgcttcacctagtacatcatctggttctcccagacccttttaggactgaactgtgctttaaatagttacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgcgtctgcagcacagcggaaaccgaggttgtctgaggctgaatctggagtgttgcccatcctgc

SEQ ID NO: 245915 - DNA, 2805 bp, Homo sapiens
cccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttccctttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctcaaaaaaaaaaaaaaaaaaaaaaagaataggaagcttctgatatttgtctttctggagtactatttgctttgtgattcccacaatgcaatgcttcacctagtacatcatctggttctcccagacccttttaggactgaactgtgctttaaatagttacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgcgtctgcagcacagcggaaaccgaggttgtctgaggctgaatctggagtgttgcccatcctgc

SEQ ID NO: 245916 - DNA, 1361 bp, Homo sapiens
caagatcaagataatcgcacccccagggccctgaattagtcagcgccctgggtgggcagagatcacacgtggcctgagaaccaggaaccccctgctcctctacttcctagatgagccaccatctccatttctctttaggggaggcccagagttactgacactcaggctttcttccctttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctcaaaaaaaaaaaaaaaaaaaaaaagaataggaagcttctgatatttgtctttctggagtactatttgctttgtgattcccacaatgcaatgcttcacctagtacatcatctggttctcccagacccttttaggactgaactgtgctttaaatagttacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgcgtctgcagcacagcggaaaccgaggttgtctgaggctgaatctggagtgttgcccatcctgc

SEQ ID NO: 245917 - DNA, 2625 bp, Homo sapiens
aaagtgtaaatctctgtcaagggcaggacatctctgctgcagcctctaatctgggaccccccatggggtgaggggccccccgaggccatctgtcctctgcactcccaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttccctttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctcaaaaaaaaaaaaaaaaaaaaaaagaataggaagcttctgatatttgtctttctggagtactatttgctttgtgattcccacaatgcaatgcttcacctagtacatcatctggttctcccagacccttttaggactgaactgtgctttaaatagttacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctccctgcggaaacaaggtagagccaggggatcctcaagagcg

SEQ ID NO: 245918 - DNA, 1560 bp, Homo sapiens
  misc_feature (1)..(1): n is a, c, g, or t
  misc_feature (771)..(771): n is a, c, g, or t
  misc_feature (783)..(783): n is a, c, g, or t
nctgtgactggcggcgtgttgctgttgtcgctgtccgcgtctcgtcctattattcttcttgtccggcacgcggttcatcataagtttctgccgtgccgttgtggtctcgtcctcactcacgtgtgtgcttcttcatgatcaggcttcctctcctcgtgttggcccccccggcggttatatcatccgtcattgtcggctctctctcgattactgcgtttctgttgtcgtctcccccgtgttgtgttcggctgccccccttggttttttcgttgtgtggcttgtgttgttcgtttgtcgtgctttgtcgtgtgtggtgatcgttatgtctgtgttggttggtgtaaacacattgtgcggagatttatttgtgccccctgaacaagtcccttggaccactggtgggtgaccgcggtatactcctacacggacaaagtttttgggcgcatatgggagaaagggggccgcacagtcgaaagtggctcccaccacccgttgatcccccgcaccttttggtgagtttctaatgttggaaggattccctttgaggtccccccgaggttttgagagcccccccttgggccaacagatgcgggatccccttcactgccgatgtcccgagattatgcccaggcattgtggggcaacacccgtgtaggtccccgctatctcacggagaggcttaaggtgggagaaatttccttgggcccccggaatttcacacggctatagaagtgagaccctgattcaccccccggcacactctttacctcngggcacacacanaagaaagaccctgtctcaaaaaaaaaaaaaaaaaaaaaaagaataggaagcttctgatatttgtctttctggagtactatttgctttgtgattcccacaatgcaatgcttcacctagtacatcatctggttctcccagacccttttaggactgaactgtgctttaaatagttacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgcgtctgcagcacagcggaaaccgaggttgtctgaggctgaatctggagtgttgcccatcctgc

SEQ ID NO: 245919 - DNA, 1854 bp, Homo sapiens
aaagtgtaaatctctgtcaagggcaggacatctctgctgcagcctctaatctgggaccccccatggggtgaggggccccccgaggccatctgtcctctgcactcccaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctctttaggggaggcccagagttactgacactcaggctttcttccctttagggtcacagggtgaggatcaaagacacaaatgtctgagatacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggaagccaccatgcccggctaatttttgtatttctttctttttttttttt

SEQ ID NO: 245920 - DNA, 671 bp, Homo sapiens
agagctggatccacagcatgtcactagtaatcatctgtctccaacctttagatgacgtgctaaattacatgtctgcctgttacacagtggaaactagtttccttcagagggacacgaaaccacagatgaggccacaaagaaagcattctccttccacagcaactggctgagaaaacagaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaacacctggcccccagccatcgtcaacacacattgggccccttctccaaaacacaggaggctgagtcctctcctgccctggtgagaggcgcctgccacagagggatgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgcgtctgcagcacagcggaaaccgaggttgtctgaggctgaatctggagtgttgcccatcctgc

SEQ ID NO: 245921 - DNA, 450 bp, Homo sapiens
atctcctgacctcgtgatctgcccgcctcggcctcccaaagggctgggattacaggcatgagccaccgtgcctggctaattttgtgtttttagtagagacagggtttcaccatgttggccaggctggtctcgaactcctgacctcaggagatccacccacctgggcctcccaaagtgctgggattacaggtgcgagccaccatgtaccagaatttctaggtcttctgattcaaagcctggagctcttccctagatatcaatctacatcttgtgagactgtgatagagaagtcagccttaattagccgggcatggtggtgcatgcctgtagtcccaggtatttgggaggctgaggcaagagaattgcttgaatccaggaggtggaggttgcagtgagctgagattgcaccactgcactcgaccctgggcgacagagtgagaccctgtctca

SEQ ID NO: 245922 - DNA, 554 bp, Homo sapiens
gtttctaaaacaaacaaataaacatccgtgaaatgagccaagcatggtggtgcacacttacagtcctatctactccagaggctgaggtgggaagattacttgagtccaggagctcaaggctgcagtgagctattatagcaccactgctctttggcgtgggcaacagagcgagactccatgttttgttttgtttttttttaaaggagtccatgtgaagacatagagacatagaaaggaaggcaatgtgaagatgcaggcaagaactggagagacacattcacaagccacggaatgccaaggattgctagcaaccaccagaagctaggaaaaagcaaggaggaatgttctacagctttcagaaggagcatggccctcctgacaccctgatttcagacttccaggctccagaaccatgagagaaaaactgctgtttggtactgttatggcagccctaggaaactaacttactacataacccacatgaactaacagtaatgtatactgtaagagtataataatcacaatcacaagaactaccaaaacaacaataaatc

SEQ ID NO: 245923 - DNA, 719 bp, Homo sapiens
aaatgccttggaaggggggaaaaactattccagagagatgaaagtgggtgggatggaggaagtgtaataagattgtgactcgtgtatagggagaaatttagtgtttccggtaaaattgtttacaaaaaaaattataaaggcctacaaagaaacttactgttctgtgctaaattatttcccactctccagtactatggaaggactgacttcaaggtccctaagacaaatggtcacattcacagaaagacacaagaagggttcaaaagaccaccatttttgcagtgtaaagcagtcacccctgcccttcccactgcagcccttggcctttctcactttgagaagtcttgcaaaaagggtcttcatattaggctgtgagatagtgttgcagatgtaagttggttttgtatgaaccaagcgtcagcaagttttaggtttgatgtcggggacttggagtacatcttggggtacacttcatagctgaattagacatgcgggtggaaaggtgacaacactgttttccccttgggcaattctcaggttggtgtgtcgtttcagagttgctaaacgctgaggagttaagaagagaggagggtaaaaggacggaggaggaggaaacagatggggtgaatagaaacggtgtaagaactagaacacagggaggaggactcagggcagagcccagagcccactgcagcaccgagtccacggagcagccagag

SEQ ID NO: 245924 - DNA, 602 bp, Homo sapiens
gagtttattgtccagtagtcgggcaggcttgtgcctttccttatttgtcagattctttcatttgctgattctgtttaagctcaagggtcagtcactgtgaaatgaatttgcacctcgttttctctttaggctccaagactcccaagaactccagggctcccactttccccattctgtgggactccttagggcccagaagagtgtgctgtgcaaagttggcttttagaaaactggctagctagcttgctggctcctccactttcctctccaaaacttcagaattcaccactcactgtcctaccagaaatcccctagaattttaaggtcatgcttactcacaaagtcttgaacccttctaaacacacttcccaagagactgacttatctggaatctcatctctatagagaagcagcctcttcatctcccttcaactatcatcccatacttctctgaacaatttttcttgtcctgccaattcagtgtgattgaaaacctgaaaaccacttagcagagaatctgggcttacatagtgcttgcctgtgcagttggagacagaggagggagaaggaagcaccgcaaatactgcatgctgcagattcat

SEQ ID NO: 245925 - DNA, 305 bp, Homo sapiens
gggccctaaacatcgcagggccttacctggcatgaaacagatactgaattaatatttgttaagtgaatgaacaaatattcacagcgtgtgccacctttgatgccatttttaagacctacaggtacctgacccccgacctctggaaggagactgtattcaccaagtctccctatcaggagttcactgaccccctcgtcaagacccacaccagagtctccgtgcagcggactcaggctccagctgtggctacaacatagggtttttatacaagaaaaataaagtgaattaagcgtgaaaaaaaaaaa

SEQ ID NO: 245926 - DNA, 566 bp, Homo sapiens
gcatgatttcattctttgtatggctctatagtattccatagtgtggatgtaccacattttctttatcgaatccaccattgttgggcacctatgttggttctatgtctttgctattgtgaatagtgctgcaatgaacatacagatgcgtgtgtctttttggtagaacaatttatttttctttggtatacaccaagtaatgggattgctcagttgaatggaagttctctttctaattctttgagaaatctccaaactactttccacggtgtcctttggccaatctttaacagtagatctgctagctgcaaactcttgtagttctccttcctttcagaatgtctttatttcctcttcattcctgaaggacagtttcacatgatataaaattcatggttgatagctcttttctttcagtacttgaaaaatgttttgccacttccttctcacttccttgttttctgatgagaaatctactgtcacggctaaccagttttcccagcaccatttattaaatagggaatcctttccccattgcttgtttttgtcatgtttgtcaaagatcaaaa

SEQ ID NO: 245927 - DNA, 361 bp, Homo sapiens
cttgctctgtcacccaggctggagtgcaatggtgcattctcggctcactgcaacctcagctcccccaggttcaagcgattctcctgcctcagcctcccgagtagctgagattacaggcatgtgccagcatgccctgctaatttttgtattttggtagagacggggtttcgccatgttggccaggctgctctcgagctcctgacctcaggtgatctgcccgcctcagcctcccaaagtgctgggattacaggtgtgagacaccacgcccagccctgtccttactttcaaaataaagtatctgatggtgatggtggtggttgttattattttacttcaatgaatcacatatgtttataagatt

SEQ ID NO: 245928 - DNA, 187 bp, Homo sapiens
ctcacccctaacctttcaacaataatgagaaataagctataagttatgccaaattgtatgatggttttcatgaaatagcccaaacttagacaactcatttaggctttgcagatgcaaactgtgatagatcttccttctctttcattcttggtgatttatgtgtccggtacattgttgtgttttctat

SEQ ID NO: 245929 - DNA, 393 bp, Homo sapiens
ctgttttttccttttatgctttgtacttttggtgtcaagcctaagaagtctttgcctaactgcggttacaaagattttctcctacttttcacaaaaagatagtcttatattttgcgttgaaatacaagatacgtttatttatattaacttttgcataaggcatgaggttaaggtcaagactttttttttggcctatggatatcttgttgcagcgataccatttatttgaaaagctatgctggatggatgtggtggtttatgcctgtaatcccagaacttttggaagccaaggtggaaggattgcttgaagccaagatttcaagaccaaacttgccaacatagtgagacccttatttctacaataattttttttaaaaataaattaatcaggtg

SEQ ID NO: 245930 - DNA, 681 bp, Homo sapiens
gacatttcaggaggccgcttggcagccattttagatcctgcccgcgcggagagctcctggctgccaaaaactgcagtcgctccgtgcccaagacactcttggcagtggagataaactttgtagagatacacagtccagaaatatcttataattacaaagcacagggggcagaatgtttttacaatacagctgtgctaatgtaaacatttaatttggcagccttctccacccacttttcaattaaccgggtttatgcagatactttaggtctgtaataaactttattgctaagagtacagtttatgaaacacagatttgaggggcttttttgaggggttttccatccatttaggaaagcacattgtgaatgttatgttgccgtgaatggaaagggtagctttctgtctcaaaagatgccatgggcctggcttaactgaaacaattgctttaggaaaaaaaaaatgtgggggctgtttcctttggcttctaaagcatgcaagaggatattaatagaaggaggtaaaaatcacttatatagctacaaaaagacactcgtgttgatgatcattaaaaaagataaatgtcccctgcaatgcatgagactgtttcagagataaattcccagtaacagttcttacagatgtaattgtaataattgtgtgatcgtggtaattattctta

SEQ ID NO: 245931 - DNA, 479 bp, Homo sapiens
agacttaaaatgggtgaattttattatttgtaaattataccttaatagagcaggaaaaactgtaaagcttgttatttgtttccattctgaccatgtgcgccagggtaaagtcataattagtcattagttatggttatgaacgtcgacagtaatcacataatagtagtgtcatgctggctgtgcatcctcaagccactctctccccagcactcccacttaactcctggggaagacattcacatgagtcaaaagcagcctccaaggttctcatctcattcaggccaggacccctaggaagacttcatactgatttacagcaaagcacgtgttggccagtaagtgtgcattcagatgttgtgtcatcagtgaggtgggtattctcctggaagctgcagtgttgccaagcaatgaataagaacaacgaatcccagcaatttctctctgcgtcttggaatcatgattcagatccgggcagacaa

SEQ ID NO: 245932 - DNA, 432 bp, Homo sapiens
cctcagggaaggtctggctctattgcccaggttggattgcagtagcatactctcagctcactgtaagctccacttttcaggctcaagctaccctcccacctcatcccacccatgcacagctaacttttgtatcttttgtagagacggggttttgccatgtcttccaggctgctcttgaactcatgagctaaagcaatctgcctgcctaggcccccaaagtgctgggattacaggcgtgagccaccatgcccagtcaggaaagggatgtttctttgaatgttgagtggtagaaaaatgtattgtataatgaatgggtacctggagtctgtatggctgagcttcatttggagctttttaattttgttcaatgccacaacatttatacaaacaagttcaattgttgatgcaaataaacagaggcatttaaattca

SEQ ID NO: 245933 - DNA, 307 bp, Homo sapiens
tgtctagtggttactcccgcttcaaggctaaggaagggaaggacctgttttgctttcaaaggctttttccttccagcccttgctgtgtggcccgttgtgtgtgggagggaccatgagaggcctggatattgtcaacaaaagacttgaacaagccaaagagctgatgatgttgacaagaaggggaccttaacaaggcagataatcaaaagttgatgactgacagcccctttcgcatcccttcaccctctgctaaatcaggtctcttacatgatcttgatgacaaataataaaaattataaacacatta

SEQ ID NO: 245934 - DNA, 705 bp, Homo sapiens
catggcaaacggaggtggcaggggagcgcatgtttcagctcgtttgtgttacagctcattccgtccctctaccctgcttcagtctgcttcagtcctgggctggcccagccccactcctgcttcctgttgggtagctgcccagtgccagcggagggctgaagggctacaatgttaagagttcctttcacacccaccattcagcaggttctgagatcttgtcctgcgtttaagaagaatgaggttatgtggacactggggagtgagcaaggtggaagagggttttcttgagcaacaaaacagctctcgacacgagaggggacccaacgtgagtagagctccatgtgagaggggattccaaaggcaggtagtccccatgtgtggttgagtctgaggttttcatgggctcagaatggaggtttttatgggctcagagtgcaggctgattggtccatgggtgaacctggaaaaagcaccatttgattggctatccagttttcaggcttcagactgtctttggcttgaaagttgtcgggtttcaccgggtaccctacccgtctgcttgggagtttgtctcctgctcttatcaactgtatttctttattcatattttctatgttgtgagagattattctcataattttctagacgtggattcctttagtttttccaacttatttaaaattgcttatttaaagtctcaagtct

SEQ ID NO: 245935 - DNA, 445 bp, Homo sapiens
agtgtcaagaacttgagactaaagccacatgtaacaaaagatgcttccgttatccctatcaggaaatagcaagggttctaggagctctatgccaggaatatgggacaaagaattatggttaccaaaggctggaaagggtattggggatggggtataaaaaggagttggttaatgggtacaacaatacagttagaaggaatatgatctagtgttcagtagcacaatagggtgcctatagttaacaatagttattatatatttcagtataattagaagaatagatttggaatgtcctcagtgcaacaaaatgataaatatttaaggtgatgtatatctcaattacattacacattctatgcttatatcaaaatataatttataccccataaatatgtacaaatattgcatatccatgtgaattaaaaattttaaaaaattttaaaaa

SEQ ID NO: 245936 - DNA, 383 bp, Homo sapiens
cactccaggcaaacacagaggtctccgccacttacttcgtcactaagtccggcatgttcaccattgcctaaggaagaacagagaattaagaattgtgaggccgggcgcggtggctcacgcctgtaatcctagcactttgggaggccaaggcaggtggatcacctgaggtcaggagttcgagaccagcctggccaacatggtgaaactccttctctactaaaaataccaaaaattagctgggcatagtgacgggcgtctgtaatcccagctactcaggagactgagacaggagaatcgcttgaacccgggaggcggaggctgccatgagctgagatcgcgccattgcactccagcctgggcaacaagagcgaaactccatctca

SEQ ID NO: 245937 - DNA, 424 bp, Homo sapiens
catgatccagaagggagaaaataagatcaaatgttaaaatgctatactaatcccctagcagataacggatgggagaggaggccttggctttcaaacagtgactatcttagataatagaggaaaaatttgaaatccatacaggtacatatcaggaagttaaagtacctaaaaccaaatgtttaatgttgttatatctccttttatttttacagccatagtgatcagcttgtaacatccactttgaaaatttccaaggccaacatcatctcagtcatgaagtatggtactttggggaatctattggatatttgtttatgtactagagtgaacctggaactgcttattcctttgcttccttaaaaatgtattttctaaagtcagctgattagcaaaaaaaagaaataaaatttattgtcttttaatt

SEQ ID NO: 245938 - DNA, 692 bp, Homo sapiens
tgctaagtggagaatgcattgcaaaggtgaagagaggaagacctaatggcagacaaccacagtagtacaggcaggagatattggtggcttgagtggagccctcagagagaaatgggtagagatattgtggagatggatcaggctggacttgctgctggttgggataccattgggaaaggaaaggagaaatcaagtgtgcaaattttgggtttcaacttgggcaagtgaagaagcgatagtatcgcagagatgggtaaaactgcagagaggaacaagttgagtaggaaaagcaggtttgagagctctattttggacatgttaagtctgaaatgactgttactcatttgccttctgttaacaccttcttcagataaggcagagtgcaacgcaagttatgaggttttagctttcatgatatatgcatagtaaaattgaagcctgacagaggttcaaatagattgagcagttttgcttttgtgagattaaatctccttaaacacctcaatcactcataatttgggatgagtcattcctacagattattcaactaatctattacatgatttttcattgtgaatgtaatacatgcaattgcaccccccaaaattaagcaacagtgatgcatttacattttttgtatgtatccttcctgacctgttcctaaacacatgcaaacatatgtgtgtatggtt

SEQ ID NO: 245939 - DNA, 894 bp, Homo sapiens
gagcaccctcatcttaaaatgttgttttatttggaaataatttcaatctcatagaagagttgtgtgaatcatacagagccccacatatacttcatccagttcactgtttgtcaatatgtctgcattcgccttgtcatttcttctctcttatattattgatgtgttttaactgtttgaaaattaattgcagacatcatgtcccttttcccctgaatagcaaatattttcctaagaggaagacattctcgttcataaccatggtagacttaccagattcaggaaatttcacattcttacaacattattatccagtacatttttgaatcttttttatagcagtttgcccccacttccaggatgtcttccaggactgaaacaaggatcatgagcaccgcatttagatgcaacttctcttcagtcttccctcagcctttctttgctttcacggccttgacggttttgaagagcacaggctgtggaacaccctctctaaagtgtttctaaagtcacttcttacacagccattgctgttagaacctaggaggggtgcgtggttgggttgtgagtggtaagggccaaagttgcgaatgtctgcattggcgaaagagatttgatggaaaaggaggttgctggagtgtagacagctacatcgatccatacttgggttcagcaatcctaggagggtcccatttgtagagagagggatattttctccacatcattcccatgtgtttctcatcatcagtgaaatgatatttcatcctgtttttaccattaaccgtgtttgtggtgacctcccttttagagctgattcaaagttcccttttgggaggctttccaggatttcaccaaactgaatgttatagtggaattgagtgttttaagctgggaata

SEQ ID NO: 245940 - DNA, 441 bp, Homo sapiens
ctggaggcctcaggcagagatgaaggcccagttatgatttccttcactggagtccatcattaatgagcgccttggctggggggatgcctgctaagagggcatggagtacagatcctccactgacacccccacactcctagcagcaagcaggacttagtggccccacttactccctacagggtaggaaaagacggcagtgccctggtgaggagctgtatagggggtccttcaggatgcttgctgggaggggtggggagggcacaggacgtgctgggaccccactgggatctaagcccctcccagctgatttattcttaggatctgtaatgctcgcctgcatgtgccccgaacttcagaaggcccaagaatcaaccctgacaaatgtctttttgtcctgtattcagtagagataagattaaaaaaaaaaattagtagagggca

SEQ ID NO: 245941 - DNA, 995 bp, Homo sapiens
tatggggagatgaagcagagaaacatgcatcgaagctggggaccaaatggatctttaaataaatgaaactataaaatgtggatgaacatgtcttaattaagtaaattaacaaataaccattgcacccctgtttgaggtgctccaacaatatagacagcaatatccagttgagtgtagccattccaatagaatataaccagcggataataactcatggcatcacaacaggaatctttcaatttgcacttgcaggatggtagtgaggttctttattctataggcaagaacacaagacttacaacaggtgcagctcattataggaagtcttgggccactgcccatatttatttctgtgggttggatggccccaccttagactaaggctcctaggcatctggaatttgcctctacttcccagcaggcctccacatgctatctcctttaagatgtctcattctgttcatgatccaatttattttgtctggtttcaatgcttgtctctttcagggtgccactttaagaatatttacattctcaattataatgtgcagaaatccccgtggttttccaatcctgactacattccccaacattaactgcttctttacaggtaagagtgagtctgcagttgtcccagtggccaatacaatgcctcctcttctctcgtctgcccttccaccaagcctctggcactctcaggcactcttttctaaggaatcagtgacaagataggaagcaataaggtcaggttagagtagctgctgcaaatgatcaaacatgataaggacaatgaggtgaactgtggttgcttttctcatcctgctcttctgacacctcccactctgcacaccaatccactatggaaaccaataagccttctttcagacccatggcaaacatgctgtaacagaaagcacagctacagagggcatgcattggaggcctgtgagctgaatctggcccacagatgtgatttgtttgaccccaacagtgtt

SEQ ID NO: 245942 - DNA, 792 bp, Homo sapiens
tatggggagatgaagcagagaaacatgcatcgaagctggggaccaaatggatctttaaataaatgaaactataaaatgtggatgaacatgtcttaattaagtaaattaacaaataaccattgcacccctgtttgaggtgctccaacaatatagacagcaatatccagttgagtgtagccattccaatagaatataaccagcggataataactcatggcatcacaacaggaatctttcaatttgcacttgcaggatggtagtgaggttctttattctataggcaagaacacaagacttacaacaggtgcagctcattataggaagtcttgggccactgcccatatttatttctgtgggttggatggccccaccttagactaaggctcctaggcatctggaatttgcctctacttcccagcaggcctccacatgctatctcctttaagatgtctcattctgttcatgatccaatttattttgtctggtttcaatgcttgtctctttcagggtgccactttaagaatatttacattctcaattataatgtgcagaaatccccgtggttttccaatcctgactacattccccaacattaactgcttctttacaggtaagagtgagtctgcagttgtcccagtggccaatacaatgcctcctcttctctcgtctgcccttccaccaagcctctggcactctcaggcactcttttccggggcgcccggcgcgccggcggctcaggagcgcgaagggactgactgaccgaccgacggaccgcagcggcagaagcccgct

SEQ ID NO: 245943 - DNA, 385 bp, Homo sapiens
cattagtttataaaccatattgtaactgaaatgtgatagaaaaattttctacttaaatgaatatcaagatgacgctgcaatgcatatttacgcacacaagctcattttcataaatgaagctttcctcagaatgatggctaacatctgttgaggtcttaccaagtgctgggttttgggctaagtacttatattagtaaaagtctagcaaatactgcccatagtctagcaaggactccttacctggaagttgctgaaagccttggtaatgttatctttgttctccactctgcttttggggaggatgttttccatgactatacgagatgaggcttggggctgggtggccagagttagcaaataaaaatacagaatggatactatttta

SEQ ID NO: 245944 - DNA, 403 bp, Homo sapiens
attcccacaaatattttttcagtaccaactatgtgacaggccctggtatccaggattaaagacagttatacagagtcctatagaattcctttatctgtttttttttggctgcagtaaatgtgaaacagactagaaaagagatgaggcatgaggacagtgacattgtctctcttactgactgtcacatctgcagggtgagcacagcacctagtaggagctcaataaagatatgttgaatggatgagtgatattagtgaaaagtaataactaggagagagaatcaaatatgaaaaggatataaaataaaaactataattgccttggaccatttagtgtttgaataagccccgtaatgatgacctggggctactaagtgaccatggtgacccaggccctgtgcagc

SEQ ID NO: 245945 - DNA, 499 bp, Homo sapiens
ctctcaactgttgatggcattgcagaggagataacctaatagtgtgagagaaaagccttaacaaaaataccttcatgttgaaacagaaaggggaataaagggcgaacaagagtatgctagccagacaaaggtagaagattgtatttcaggcagaagaaatagcacgtgtattcaggatatttcaagtcctggtcagatgttaggttgcaagtttggggagaataggatatgaagctaggaaggagacagggatataagcactacaggctaaagtacttgccatttatctgggagggaatggggagtcattgatcactgcacagagatgagattttcatttatgaaaggtcacgatgggattgtaaatgatattaattctccttgtcatttttggtgcgttcaaaattgtcattcaactttcgtttttgaaaatgttatataaatgttgtgtaattatatttttattaaaaagattaaaaaatttagaaatatatggaga

SEQ ID NO: 245946 - DNA, 381 bp, Homo sapiens
gtgagtctaaggacattcattattccaaggttagtatttgcctttaaaaaatggggctaaatacttttgaacagaataggctgttagaaaaattgttagtggaattgactgtttctgaaacacatgatgtgaagcgggggaaatgtaaatgtgaaacagcagctattagagcgtttgtagaaaaagctggatggcaagaagataagtgtgtgcaaaacaagcagcattccattttacaaagcctcgggacactaatgtcacagagaatgtgacatatgaaaggtgaagcccatcaaccattaatattccagacccagggcccttgatttttgtagtcagctcccactacaagcttgacacaactcaaggacacagggtgga

SEQ ID NO: 245947 - DNA, 412 bp, Homo sapiens
agaccagtgttaataagcaggcaagaaatgaagacgtaaattactgcagtaggcatggtttctccatcacagtgaagctatttgcccaaggtgccgtagccagctaaattgggtctagaaggcagggccctagactccacatcaccaagctgcatcattcataatcctgttgaacatggaataaagagaaaagaccctctctcctaatcttcagctgggacccagggccacagaacttagagttggaagaaaacttgggacgatttaatatatctgtcatttctagtcagggatttcttgcggaacattgctgttggatgatggtccatcctctgcctgaattcatcattaaaaatttctttgaaattattaacaacatttactcaataaacatttattgaatatctactgt

SEQ ID NO: 245948 - DNA, 448 bp, Homo sapiens
caattcagtaagtacttactgaatatttctgtgagctcagtctagtaacagctaatagtggtgatgttgaggagggtgtgggggaaggataggtagagtaaggggttgtagaggctgagaaggaagatgaggggaggcttgtataagaaatgaacacctgggcacagtggctcacacctgtaatcccagcactttgggaggccgaagcgtgtggatcacttgaggtcaggagttcgagaccaccctggccaacatggcgaaactccatttctgttaaaagtacaaaaattagctgggtgtagtggcaggctcctgtaatcccaactacttgggaggctgaggcaagagaatcgcttgaacctgggtacaggggctgcagtgagccaagactgtgccactgcactccagcctgggccacagagtgagactctgtctcaaaaaaaaaaaa

SEQ ID NO: 245949 - DNA, 458 bp, Homo sapiens
aatgtgggatttttttttttttttcggcctctctttttttctctctctgcacatggatgaacagtgagattctgaatactcccttgctgaaccaagcgatggcaggtcctgctggacccacctggggaagggagacagctgtgcgacagctttcagagctcaagggtcacacctaaatccccgatttccccactgccagcagccccagttggagggtggaggtgaaggttgaaaggagggtggctgagttgacagtttctttgctagctcctctacaatcagtgcttcaggtgttttcaaaatgccactgttaacagaaggagggccttttagaattttccagatggtagatgtgattttcttttaacctgatggttttcctcctctgccttgtaaatgaataagatgttgccccaagaacagtgaggtatgttgaaaagccaaagaacatttgtgaa

SEQ ID NO: 245950 - DNA, 464 bp, Homo sapiens
tgatgctgcttcagtaggataacacagcttcaaaatcctttccttcaaaacaccgttactgaaccaaacttaggtctgcccacccaatgaaacaaagccaaacgctaatatcaggatttgcagcaagagaaaagtgaggcatttattgcagggcgctcatgcttaagacctgaactccccaatgagttacatgtaagggtttttaaaggcagtgaggcaggggttccaggcaaactcataaatctatacatggaggttatatattgattcgacttaaaaaaaaagaaaaacggacattttgaagcgggggcctacaggtcctgggtggattcaaagattttctgacttgtgattggttaaggacaaaaagatttgtctaaaaatttgaggtcagcagaaaataatgttagctgtggcccgtgggttttaccccctccaggcccctcaggaagaaatttagaaga

SEQ ID NO: 245951 - DNA, 212 bp, Homo sapiens
ctgaattctattatataaaatcattccaaccatgtcatatggttcttcggattcatgaataatttggaaaagagagccatatccatcttattaagggacacattcccaataaattttcatctttcatgtttaataattatcaatattcataacattttacattttgatcaaatatgtgttaataataatagaaataaatgtccaacaacgat

SEQ ID NO: 245952 - DNA, 190 bp, Homo sapiens
ttcttactcttagcagctcactgtaaatatccttttgaataccatccaccccacccctccaaaaaagatactgaatgcctgcagagtcagctggtttggggatacaaatatgaaaacgatttgaagcctggcctcaaatcagatcgtctagcagactctgagacaaggtttcgtgtgctcgcgatttata

SEQ ID NO: 245953 - DNA, 685 bp, Homo sapiens
caggttatggtgtttatggctaagacatgattctaccactcccttagccaattttgaaaattgtttcaaactattcatttgaggtggaattaatttttctctcccctaatgggagtagtcatggagtaatgtgaccagggcccactggatgggccatgccacttgagggcagccatcccaaaatttccagattccatccttatgggtaaaacatctcttgattgctaacattgttttttaaagcaggttaagctaataactgtgagttaattatagcatgtctaaattgagctagtttttataggaacataactcatttttgtatattgacttttgtttatttgtttgtcttaagacagggcattgctctgccaccacaggctggagggcagtggcacctgggttcaggcaattctcccatctcagtctcccgcatagctgggtctgcaaccaggcgtcactacacttggctaatttttttaattaatttttttagagaaggagtctcactggtctcactggcccaggctggtcttgaactcctgggttcaagcaatcctcccacctcccaatttggcaacacttaatattagctggggtgtttttaaaaaaccaaaaaacttcacttagcatgtaaatcaacacaaagacattactatttccttctgggatgatcactagactg

SEQ ID NO: 245954 - DNA, 264 bp, Homo sapiens
cccttagcgtggtcgcggccgaggtacgcgggggcgtcactacacttggctaatttttttaattaatttttttagagaaggagtctcactggtctcactggcccaggctggtcttgaactcctgggttcaagcaatcctcccacctcccaatttggcaacacttaatattagctggggtgtttttaaaaaaccaaaaaacttcacttagcatgtaaatcaacacaaagacattactatttccttctgggatgatcactagactg

SEQ ID NO: 245955 - DNA, 1161 bp, Homo sapiens
aaagagtgggacttctagcttgcagagaagtgcactggattttacagactgccttcaggaggcagtgtctgatttacataggggccaaagattggctggatcaggtatggatgtttacacagcttaggaggaagctagctaatcttcaattatgcaaatggagcacttgccagcaccatgttgcctgttcgttactctacacgtggtttacaaagaaaagggaagatggagccaccattttgaacatgtgtcctttccaggtagctccttttcctattagcagagctgcaggcatttattcatgcaagcttccagctcgcttatctatgtctgcagctcaatcttacaggctgctctttgttaaaaagaaataatttgggggtttttattaaaaggaaaactttaccaaggactgtttttgccctcactcactatctgcctaaattatttatttatttattcatttttgtttttgttgagatggattctcgctgtcgcccaggctggagtgcagtggcgtgatctccgcccactgcaggctccgccccccaggttcatgccgttctcctgcttttaactcctgtatcaataatagttaatgtcatgggaaacatttataacgtatttgtatgtatgaataagcaagatagcaagttttaactagtggttgtgtttaatttatttatacaaatgtgttgggtgcaagtataatttagttacatgcatagattgcatagtggtgaagtcagggcttttatggtatccatcactcgaataatgtacattataactattaagtaatttctcaccatctaccccaccctaccttcttactctttcatgtcaggtgtgctggccctcaatgaccaacacaacaaagataaatttattgttttctgagacttagacttagacttagaattcaaaatcaacctaagagaaaagatgaccccgagccaataaaacatttgttttatatatatatgtatttataaacacacacatacacagacatgtatatatatgtgtgtgtgtatgtgtgtgtgtatatatatatatttgtttatactgaagaaactcatacagagtctttcccactgcacaaacccaaaagtaaagccacatggccctatgcaataaacattatggtaataacttcaa

SEQ ID NO: 245956 - DNA, 1036 bp, Homo sapiens
tcttaagttcagctgttgctagagtagatcctgtaaggttgttttcaagctggtatacacacatggaaattgaatgaaaaattcaaatgataatgtaaattagggtatatgcataaagaagtgaaagagacagagagagactactttgaaagagagaaaaggtatgctcttatacaggaaatgtcttatgggaaggatttgttctaaacatgcttaaaaatgatagcattgagtctagggactgtcagtgtcctgtgaaatgggaaatcagaagagatgtttaaaagacaaatttatttagtactggtcgagactttcactttggtaaggggacaatacaattaacatgtaaataaaatatatagtattgcacataataatataactatgggaaaaattgaaagggaagtgctaagacagtgtttgggttggaggtcatcttggttcattttctgttgcgtgtaacaggattcctgaaactgggcaagaaaaggaatttatttcttacaattatggaggctgagaagtccatggtcaaggggctgcatctggtgagagccttcttgctggcagggactctgtgcagagccctgaggcagcacaggccatcacatggcaagtaggctaagtgtgctagttcaggtttctcttccttttataaagcctacccagtctcactccatgataagtaatagttcatttacccattaatccattaattcatgaatggattaaccgattcatgaagacaaagcccccatgactcagtcacctcttaaaggccttacctatcagtattgccacatttggggttaaatttcacatgagttttggagaggacaaatatgcaaaccatagcagaggtcatattacattttttaatagcgtggtcagagaagtcctcacttaaaatggtggctttctaggaaagacctgaaatagggaagggagtgagccatgtctgagagaggagctgtcttggcacaggaacagcaaatgcaaatatttggaggttggagcttatttagcatatttg

SEQ ID NO: 245957 - DNA, 411 bp, Homo sapiens
tcttaagttcagctgttgctagagtagatcctgtaaggttgttttcaagctggtatacacacatggaaattgaatgaaaaattcaaatgataatgtaaattagggtatatgcataaagaagtgaaagagacagagagagactactttgaaagagagaaaaggtatgctcttatacaggaaatgtcttatgggaaggatttgttctaaacatgcttaaaaatgatagcattgagtctagggactgtcagtgtcctgtgaaatgggaaatcagaagagatgtttaaaagacaaatttatttagtactggtcgagactttcactttggtaaggggacaatacaattaacatgtaaataaaatatatagtattgcactttagcctgggcaacaagagcgaaactccatctcaaaa

SEQ ID NO: 245958 - DNA, 543 bp, Homo sapiens
ttacttgtgtaagtgaaagcaagattaacataccttttaacttcttggatgtaagtcctataaggattgaaaatatacatagaaataaatttatgattttatttcttttatactttaaaactattacatgggattaaaacttgcttctacttcaatcagtatatcaaatttgtatatatatttaggtatattttaaaaaatgaattacatcaggatttatgaaataattactacttgtatacaattagcatgacacatgttgtgtgataatgtatatatggggaataaattctcattaaaactgattaatatagagaagctcacttaacagtaaaatctaatataattgctactaaaaacattgcatggcaattttatttttagtagtatggaagatttttataaacattacatatcaagaattcccacagtgaatagtaaaatttatccctcattagagatccatgtctagtctgcattaaaaattggcagtatatgaacattcatgtttataaggcagattaattaagatgtgtttgcttt

SEQ ID NO: 245959 - DNA, 438 bp, Homo sapiens
acagccttggctctcgaaggctgtcctctcccccagcctcactctgactcatcatgtaggtcccgcatgggcctcagttctcctggccatgggctctccccataccttaacctgggaaccgttgtgggcaggaccatgtgggacaaaaaggtcctgtgcccaacccagcaccaatcacagggaggcctggggataagcaggggctcttggaaagggggcagaactcagctcaagtcacagaacctgggaaggaccttcagtggaaagccgcttcaaatgtcatctgggatgagcatggtggctcacacctgtcgtctcaacactttggtgaaactgaggctggaggattgctcaaggccaggagtcgaagaccagcctgggcaacatagcaaaaccttgtctctctgtgtatttttttaatattaaaaaaaaaaaatt

SEQ ID NO: 245960 - DNA, 867 bp, Homo sapiens
ctggtggggacttggagaacttttacgtctagctagaggattgtaaatgcaccaatcagcactctgtgtctagctcaaggtttgtaaatgcaccaatcagcaccctgtcaaaacagaccaatcagctctctataaaatgggccaatcagctctctgtaaaacagaccaatcagctctctgtaaaatggaccaatcagcaggatgtgggtggggtcagataagggaataaaagcaggctgcccctgcttagcggcggcaaccctcttgggttgccttccatgctgtggaaggtttgttcttttgctcctcacaataaatgttactgctgctcactgtttgggtctgcgttgcctttatgagctgtaacactcaccgtgaaggtctccagcttcactcctgaaaccagcgaagttaccaacccactgggagcaaagaacaacttcggatgggaggaactaccaactccagatgtgccatcttaggagttgtaatcctcttggcgaaggtctgcagcttcactcctgaagccagcgagaccacgacccccccaggaggaagaaactttgaatacgtctgaacatcagaaggaaggaactctgggcacactatctttaagaactgtcacactcatcgtgagggtccacagcttcattcttgaagtcagtgagaccaagaacccaccaattccggacacacaactatcaccacagtcaattttagaacattttcgttgcgtctaaaagaaaccatatgtttttcagctgtcacctcctaatccctcaatcctcccaacacctggcaaccactaatctactgtctttgtagacttgctactcgggacatttcatataaacagaattacacagt

SEQ ID NO: 245961 - DNA, 437 bp, Homo sapiens
tcttttttaatggaaattcccattgaccctctagcaaccattaacacaggtacatccaattaagcccctaggaaaagaggcctggaacaggtaacttttgataggtctaaggagtggctggaaccccaaagcgcataacactcctgtgcattttaagaaagggggtaacaagggaatgggtgctcaagtagtaaagagaaatgaaaaatagcctgagaaggccaaactgcttgtaggttaacaccactgctaaaggcagcctttttattacaatgcagtgacatttttcccggtggaatctgactacatcagtactgctatttgctacagatgctgggttattctatttgctgatttcaaaagcatgtcaactgttctaatttccttcgtgaaaaactgcatcccatgatgcattattatattcaaaattttccttg

SEQ ID NO: 245962 - DNA, 357 bp, Homo sapiens
ccaatagccactggtttttccaaatcaactatgtttctagcatctgagataaaggatggctgtatcataagatgcaccatgataacctccagggtggaattcttttttacaaagatgttacctttagcaagagatgcctttgaaaaggagaaaacagtagcactgaaacagtattactggttctgttttctgatttatgcttttttgaaagacctgatgtttcccctattgatataattttactaattaaaacatgttttatttgatgtcttgagttttgaagaaacgtcgaaaatgaatgactgttggtgggattacaggcgtgagccaccatgcctggccaaaagcagaatctta

SEQ ID NO: 245963 - DNA, 705 bp, Homo sapiens
tgagacagagtctggctctgtcacccaggctggagtgcattggtgggatctcggctcactgtaacctccgcctcccggattcaagttattctcttgcctcagcctcctgagtagctggaactatgggcatgcaccaccatgcctggctaattttcgtattcttagtagtgacggggtttcaccatgttggccaggctggtcttgaactcttgacctccattaatccactgtctcggtctcccaaagtgctgggattataggcgtgagccaccgcacccggcctaatattcttttaagtgttagaagtttataaaaagagcaataagtgaatagtcatcttgtacccatcgctcaacttgagaaataaggcattacagatacagttgaaactctttggggcctctcttttattgcccttcatttccccagagatacttactatcctgaatttgatatttcttattcctatgaacttattcccatgaacaatagtgcaaggctgctgaattggatatatgagaaatatcttccaaactaagatttaccagtatagaccagaattgcccatagatgcaaaaattcttttctatcaaaaaattatttccacagccaggcacagtggctgacacctgtaatctcagcactttgagaggccaaagcaggaggattgcttgaacctaggagttcaagaccagcctgggcaac

SEQ ID NO: 245964 - DNA, 718 bp, Homo sapiens
ctttaatatttttggagggaaagactgagtagcacttaaactttgcatcatcaattagcattttgaaaaggcaaataaaaacacacaggtggctaaaatgttacctttgacactttcttaaagtactaaggcaccgcagtaatggatattcatcactttcctgccctaacacacacagacgcacgtgtgtgcaacaacataaccaaatatgtatatttatatgcacctagatagcatctacacaagaaaatcattcacacatttgttaatcacagctttgtttatatagtacttatacagggtggagcaataatttgtgagtcttttaaactgatgtaagagacatttttcagtttattctatgagcaaatatgatgagcccaagtgcctactagaaaattcaagcctggagaactggattaataaatataaatgaattcatttgacagagtgacattttcatttaattaaggcagaaaatcagctctaaaacaaatgattgtccctgacaaagaagcagaaattggttcttaataaatttctaatagctcttccatgggctgcggaaggtcttcagtgatagagcactttggtgggggtggggagtgggatgaagggagggacagtgaagagaattgaaaagaaaaggagaagaaaaggaacagggaagcacaaaaggtagtgcatatttaaaatttcaaaaatagcaagaaaatta

SEQ ID NO: 245965 - DNA, 927 bp, Homo sapiens
cttaacgctctcacatctgttctactcccaccctaaaattaactcctctccgaaaagaaatgttttcttcttcctttttttattataataggcaaggtctctctctcccttgctcaggctggagtgcagtggtgcagtcatagctcactgtaacctcaaactcgttggcccaagcgatcctcccacctcagtgtcctcagtagctgagactacatacaggtgtgcaacaccacacttggctaacttttaaattatctgtagagaaaaatttttctcactatgttgcccagagtggtgccaaactcctgggctcaaccagtcctcccgcctcagcctcccaaaaagctaggattacagacgtgagcatcctcacccagcccaagaaaatattttctataaataattttttgtgtgatacaaaacctagcttgttttattaggtaacctctaaaaaactgctaggcacgtaccagttcattcattggacacatctcctcctacagacaaccatttggtccctcatccagctctcctgcaccctggaccaaatgggatatgcccaactttcaacatcctctaagtccaggatactatcattctttaagtctctcttcagttataacagacccttgacatttgaaatcaaccaataatttcctgagcactaatcactgtgtgtgaaacaccataatttttttttaaatctgtaagaatgaaaagacaaataagcacaaaccacctatagcctcttgattagtaatccaaacagccttctgtccgagcaattcagcatgtaatgtggcagtcactgacaatgcacaccacagaaatcagtaataccaactacctttacagtaatgtctcagctttttatatacttcactctacacacacacatcactgttccagatgtcatgagtacagttg

SEQ ID NO: 245966 - DNA, 417 bp, Homo sapiens
aatatactaaaaacactgaatttgacaatttaaaagggtgaatttcatggtgtgtgaattatatctaaatttaaaaatttgtatttctatacattggcagtgaacaatctgaaaatgaaaatttaaaaatcacaatagaataaaaaaagttcttagcaataaatttaacagaagcaacacaagacttgtacattggaaatttcaaaacattgctgagagaaattaaagaagatctaaataaatgaagaaaattccttgttcatgaattggaagacaaaatattaataatatggcatttctccccaaattaatctatatatcagtgcactctctatcaaaatcctaggagacatttttatagaaattgataagctcatcctaaaatgtatatgcaattgcaaaggatccagattagta

SEQ ID NO: 245967 - DNA, 354 bp, Homo sapiens
aaatctaataggactaataaattagttcagttaggtcacagtatacaagaacaatttacaaaaatatggttttcatacaatgcgattattattcagccataaaaatgaaagaagttccgatacatgttacaacttggatgaaccttcaaaacatgctaagtgaaagaaatctaaataaatgaagaaaattccttgttcatgaattggaagacaaaatattaataatatggcatttctccccaaattaatctatatatcagtgcactctctatcaaaatcctaggagacatttttatagaaattgataagctcatcctaaaatgtatatgcaattgcaaaggatccagattagta

SEQ ID NO: 245968 - DNA, 169 bp, Homo sapiens
attttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagt

SEQ ID NO: 245969 - DNA, 1011 bp, Homo sapiens
tattgcttacttggcagttaaactttattctgaatttcctttaatatattttattttttattttattttatttttatttttagcagtcttactctgtcacctaggctggagtgtagtggcacgatcttggctcactgcaacttccaccccaggttcaagtgactcttatacctcagtcttccaagtagctgggattacaggtgtgcaccaccacacccagctaattttttctatttttattagagacggggtttcaccatgttggccaggctggtcttgaactcctggcctcaagtaatccacccacctcgacctttcaaagtgccggaattataggcgtgagccaccgctctcgggtaatatattttgattctacatagatgctctgttgaagctgtttttggctcagtcctttgacatcatatcacttcattgtttaataaattattttgtaatctgtatgtttggacaaatgtaatgtcacattagcttaaaatatacacacctgtgtttgatgcttacttacagagaaggacttacgactcccacttgtcctgagttgtttaaaattaatgattaaatttatcatgcttatgtatgattgctacaacagctatgtattgcggaatagtaaaccttgaccagactaagttttcaccttgttttgatatataatcctgtgttcttttaaaaatatgtttaaaagcagcttttactcttattaaggcttctgaatcctgaaaacttggtttggtctgcatcagtctcgtaacaaattcgaatttatttgccgaatctttccgtatttcctttttcagccttagtgttgttttgttttgttttgttttgttttttttgagatggagttttgctcttgttgcactccagcctgtgtgatagagcgagacttcgtctcagaaaaaaatctaattttaaagtcttaagattttgccattcctcctactcccaaacaaatctttggggaaaaaaaaaaaaaaaactaccaactgt

SEQ ID NO: 245970 - DNA, 1501 bp, Homo sapiens
tattgcttacttggcagttaaactttattctgaatttcctttaatatattttattttttattttattttatttttatttttagcagtcttactctgtcacctaggctggagtgtagtggcacgatcttggctcactgcaacttccaccccaggttcaagtgactcttatacctcagtcttccaagtagctgggattacaggtgtgcaccaccacacccagctaattttttctatttttattagagacggggtttcaccatgttggccaggctggtcttgaactcctggcctcaagtaatccacccacctcgacctttcaaagtgccggaattataggcgtgagccaccgctctcgggtaatatattttgattctacatagatgctctgttgaagctgtttttggctcagtcctttgacatcatatcacttcattgtttaataaattattttgtaatctgtatgtttggacaaatgtaatgtcacattagcttaaaatatacacacctgtgtttgatgcttacttacagagaaggacttacgactcccacttgtcctgagttgtttaaaattaatgattaaatttatcatgcttatgtatgattgctacaacagctatgtattgcggaatagtaaaccttgaccagactaagttttcaccttgttttgatatataatcctgtgttcttttaaaaatatgtttaaaagcagcttttactcttattaaggcttctgaatcctgaaaacttggtttggtctgcatcagtctcgtaacaaattcgaatttatttgccgaatctttccgtatttcctttttcagccttagtgttgttttgttttgttttgttttgttttttttgagatggagttttgctcttgtcgacccagactggagtgcaatggagtgatctcagctcaccacaacctctgcctcccggcagcaattctcttgcctcagcctcccaagtggctgggatgacgggcgcgtgccatcatgcctggctaattttgtatttttaatggagaacagggtttctccatgttggtcaggctggtcttgaactcccgacctcaggtgatccgcctgccttggcctcccaaagtgctgggattacaggtgtgagccactgcgcccagcctagaaaataattttaataaaatctaattttaggccgggtgcagtggatcacttgaggtcaggagttagagaccagcctggccaaaatggtgaaaccccgtctctactaaatacaaaaacttagccaagcgtgggtggcgtgcgcctgttgtcctagctactggggaggctgaggtgggagaagcacttgaatccaggaggtagaggttgcagtgagctgagatcatgccattgcactccagcctgtgtgatagagcgagacttcgtctcagaaaaaaatctaattttaaagtcttaagattttgccattcctcctactcccaaacaaatctttggggaaaaaaaaaaaaaaaactaccaactgt

SEQ ID NO: 245971 - DNA, 547 bp, Homo sapiens
agacttcaaaaatatataagctgaatagaccgctagtaagtgaagagactaaagcagtaatcaaaatctacctgcaaagaaaagcctaggtccagatggcctctgggctgcattctacctatcactcaaagaagaattaataccaattttttacaaactcttccaaaaaatagaagagaagggaacagtttccctgttattctatgaggccagtattaccctgatgtcaaaaccaaagacatcacaagagaagaaaactatggaccaatatcgcttatgaatatggccacaaaaatccccaacaaaatactagcaaatgaatacagcaacatataaaatgaattatacatcttgaccaagtgtgatttatcccaagggtgtaaggttggtttaacatctgaaaatctattaatataatatatattataattacataatatataatagcatataatataatttcaatagaataaaaacaaaaattacatgattatcttaatagatgcagaagaagcattcaacaaaatccaaaaccctttcattatta

SEQ ID NO: 245972 - DNA, 461 bp, Homo sapiens
aaggatatttctgtctcattttaatatttcagataagaattggtcaaatttgtattcaccttataagtgaatataaataagaattgatcaactttatattcacctggtaagtttttgagaagcctttttgtcgcctttgtgaaccgtattgtttgtttgcttgtgttttgagacagggtctcagctgtgtcaggcaggctggagtgccatggcgccaccatgggtcactgtggtcttgactttccaggctcaagtgattcctcttccacgagtagctgggatcacaggcgtgcgccaccatgcctggctaattaaaaaaaattttttttttcaggagagacagggtctcactacattgcccaagctggttctttttctgtttttaagattgtactgatttccttttgttttcagcagttttattatgatggaaataaacattagttttctgtatgttaatc

SEQ ID NO: 245973 - DNA, 443 bp, Homo sapiens
cagtgacactataaagcaagcatacaaacaagtctgcataataactagctaacgacacaataacaagatcaaatctacacatatgaatagtaaccttgaatgtaaatgggctaaatgccccaattaaaaggcaaaatgacaagctggatagagaaacaaaaccaatcgtatgctgtcttcaagagacccatctcacatgcaatgacgcccacacattcaaagtaaagagatagagaaaaatctacaacacaaatggaaaacagaaaaaagtaaatctaggagcaataggccataccatatagcctaggtgtgtggtatattatgccatctaggtttgcgtaagtacacgctattatgttctcactataaaactgcctaacaacacattaagcaatgtatgactgtatatctttacttatatataaaatatattaacccttggc

SEQ ID NO: 245974 - DNA, 685 bp, Homo sapiens
ctcagcagggaaagtgcgcatgtgtgagctcttcctggtggcaatgacctgaaggggcggcccctggaatctgagggccagcatttgctgtcctttgaggtcaggcctcagggcgaccatccacacagaatcactctgctgggctgctgcaggtctggttctgccattcagcatgagccctgggctcgctgcaccaccatctcctcatccgtttatgggatgagaataggaagaccctgccttttatgatgttgccctcaggattcgacaagtccaacaacttagccaagcgttgatttagtacttcctggcacacaggtggtagtcaacgttagctctcagcatcccctgacccaactcctccagcggtctccagctggaagagtccaactgctcttcattcctttatgaaatggggtggtcactgtgtaaataaatcacctgaaggatgccaatcatcttggaggagaggctagttcagatctgcaacggactcatcaccagtatttgcacttaaataatgtaatgtaataatgtgttcttcgaagtcacccctgaattgatcccatgtgtaaggaaaattgttcattctaggactacttgtaatagcacgaggtaggaaacaacctgaatttccttcaaaaaggaactggttaaataaattagactactaagacacgtgtat

SEQ ID NO: 245975 - DNA, 699 bp, Homo sapiens
gcttgtaaatctgtggacacaagcaaaatccctagctaacagtccattgtcaccatttaattactctcaggccctcacagaaaaacaaaacttcaaccaggctctagtccttgaagtctggtttgtaattgtaaaggcagctcttgtttcaatgaagcttggctgaatgtgggacaaggtgaggaagaccccaaccctgctgctgaattcaatctgcaagacactgaaccccacaagatccttttctgcacttttgtcatttaagactcaagtctcacctgtaatcccagaaccctgggagaccaaggcctgcagatcgcttgagtccaggagttcaagaccagcctgggaaacatagcaagatcccatctctacagagaatacagaaattagctgggcgtggtggtgcacacctgtagtcccaactactctggagactgaggtaggagaatcacttgagcccgagaggttgaggctgtagtaagccaagatcgcaccactgcactccagcctgggtgacagagcaagacggtctccaaaaataagaaaaggatccaagtcttttggaggtggaagttcagtaacagattaatgatgaaactaagaggggtagtgttagtgagttcctggatggccagcacaaactgactctgttttggaaaaaaaaataaacgttggtttaccttcatcctgagaggc

SEQ ID NO: 245976 - DNA, 588 bp, Homo sapiens
caatgatccaagatcacaccactgtactccagcctaagcagcagagcaagactgtctcaaaaaaaaaaaaaaagttagttattacacttccaatgagacatgtatctgtgtgcctgccacgctctgcaggggttgacctaatccctgcccactagtctggtcgtttgtctgtggggcatggggcagagaacacaggcaggcttgcaggtcagcctgttgtagggagagcaggagaagttgggagagagcctgcgaaacaggaggacgtggcctgtggggcaggcggaggccgcttaggcaccaaagcagtgcttcctggctgagcacggtggctcatgcctctaatcccagcactttaggaggccgaggcgggtggatcacgagatcaggagatcgagaccatcctggctaacacggtgaaactctgtctctactaaaaatgcaaagaattagccgggagcggtggcgggcgcctttagtcccagctactcgggaggctgaggcaggagaatggcgtgaacccaggaggcggagcttgcagtgagccgagatcgcgccactgcactccagcctgggcgactctgtctc

SEQ ID NO: 245977 - DNA, 342 bp, Homo sapiens
actggtcctatcattccttagcatgaagcctaagaatatattcactttcttgctcctttggattttttctcttcatttgaatctttgagaaagatgccttacatgctgacctcctctttctctacattgcctcttgtttaaaaaattatttcttttttgatacatgatagacctgtatgttttcagggtacctgtgataatttgacatattcgtataacataaaggtaaaatcagggtaattgggatattcattaccatatttatctattctttatgctaagcacattcaaattattctcttctagcaactttgagaggtacaatagatttttaactatagt

SEQ ID NO: 245978 - DNA, 508 bp, Homo sapiens
tacaatcaattttgaaaatattctatattaatttgaaaaacatgtatattctctatttgttaggggcagttatctatccattcactggcttattttgttgtttaaatctgctaattgcttattcaattttgtgtgatttttatgtttttgctaaaaatgtgttgagatccctcacttaagattatgaattcgtctcctttttccttataattctattttgctttatatatttcagatctatagcatgaaggtcatacaaattcatgattgctacatctttttggtgaattattccatcagttgttaatgactatgcctctgtatcttggcgcattttgccttcagttgtttttctgtccgacggtaatgttgctgcaccatgttttctttctctagtgcagtattagtgagttatgctttataacattcctttagttttgcactttctgtgtggcagttttgttttaggtgtgtcttctgtaggttaaatatagctgaatttttcaaa

SEQ ID NO: 245979 - DNA, 404 bp, Homo sapiens
catagtaagctttgttttcttctacaagcttctgccatctccaaaacaaacaaacaaacaaaatgctgttttgttgctgttgttgttttacaccaaagcttgggattcatttattcaaagcttccatattttttcacagaaattctaattccttatgatattccattacccagattcagccccagtatatacttttattctactcaacatacctctcctctaccaaaaacaaaacgaacaaatccaaacagagccatccacaattccaagaagtcttaatgtctttatctatgctttcccattacatgataatcttttccttagacattagctcatattagtgtgatttttttattcaagaccaattaaatgttaaaatattcctcgatctctgtagttaaaaa

SEQ ID NO: 245980 - DNA, 323 bp, Homo sapiens
gctcagaggggaatctgggcaaaatatataaaggaccctctgtggtattttgcaacatctcatgaatatgtaaatattttaaatataaattttttaaaaagcttaaagacagacccacgtatttaaggtgagttgatgtattataaaagtgatacaaaaaataaattgacaaaaagactgcttagttgattttgtggggaatattgatcactaattggcaaacaataaaaatgatttctgatttaaaagaagatgtaattacagatgccaaataaacaaaagagaaaaatataaaagacaatgctattttgcatcaatattca

SEQ ID NO: 245981 - DNA, 709 bp, Homo sapiens
tttccaaatttcctcttaatttaaacaggttataaatttttttcttctaaatgtgactgtttaaaacagtcaaactgtggtgctgcagaaatacctttatgggtacgaggcttaaaatctaagataaaaagacaaaaaaactctagcatccatagagaaaattagcaggatgtagaaaaagtatattataaattaaatgcaaaagaaatttttcgttgattcatgaatccatgtttattgtttggtttttcaaaaatctgtttctctgttttctcggcaatcttagtaaggcctttatatgtttacatggttaagaatctgtattgtagatcggtacttaaggtttgaagtcaatgtatgattatgtgtatgctaattctaaatgcatatttgatgctcctaaagataaacattaaaaattgttcctgagtacacctaagactttagtgataatgtttaagtagaaatgtaactcccaaaaagtttatatcaagtaatgtggatgaaagaaaggaacatgagaaaagaatcaaattttacgtgaaacagaagtggtactgtatacacaacctaacagcttctacagtttctttttttaactatcatcttagcttcaagggtacatgtgcaggtttgttatatggctaaagtgcatgtcacaagggtttggtgtaccgattatttcctcacccaggtaatgagcatagtg

SEQ ID NO: 245982 - DNA, 430 bp, Homo sapiens
tttccaaatttcctcttaatttaaacaggttataaatttttttcttctaaatgtgactgtttaaaacagtcaaactgtggtgctgcagaaatacctttatgggtacgaggcttaaaatctaagataaaaagacaaaaaaactctagcatccatagagaaaattagcaggatgtagaaaaagtatattataaattaaatgcaaaagaaatttttcgttgattcatgaatccatgtttattgtttggtttttcaaaaatctgtttctctgttttctcggcaatcttagtaaggcctttatatgtttacatggttaagaatctgtattgtagatcggtacttaaggtttgaagtcaatgtatgattatgtgaacccacctatcaaaaacattctcacgcttccccaggtaaacaataaaaaaagataaaaaat

SEQ ID NO: 245983 - DNA, 1262 bp, Homo sapiens
gcgggtcgctctcacttgtccctggaccgcagccgccgcataagtggtggccaacgctgggcctgggtgtggccggaagcagaggccgctctgactacacacccaccccccaaaggcttctgggagtcgcgcaggcgcagcggcagaccgggtgaggcggggcttgcggcgaggggtgggaccgcagggccggagtaaaagggtgcttggctgtgacaggtgctaagggcctgggcgtcagctccttgcgggagcgtcactgccgaccgggaagggaaaggcaatcttgggggcctccggagtccggaggatcactctgatgggtgatgtctcctggcctcagtgatggaattaagatgacttctatctctgaatccaagggtgactgaaagccgcaagctgcagaaaggacaagaggcatcacctatgtggataaagacagcatcctgagttgatggagaaatggcatagaaggaaccaggtcctttgatgacatcatggagcaaagctgtcttcttgccttgacctgctacctacctacatgggaagctgttacttgagaaggcaataaaatctatcttctttattgaaaaaaaaaaaaaaaaaaaaaaaaaaaaaaaaagcccgagggcctcatatgttgccggggggcggggaaaaaccagaaggggtcacgagcaaaggggccgggaggtggctcaaggtggcgtccccgcggacccgcaccttcgtgtgatcacgaagggggcacaacatggcggggcccccccaatgagaggagggatgcgcctggttaacggctgcgcaaaaagaccggggtaaacccggatttaaaataaacggggaggaaaaaggctggcacggtgaacaggcacgctgcgctactgttgctggtaacgccctcattcccttgaaacccaaggaggacaactggcacataggacctccgcacctgtgcctgacaaaagctgctccatgaatgcgccaggtaatcgaatgaatgatggcgatcgtcaagccggcggttgcacgtgccaaccgtggggccaagttcgcccaagggccaccttgatgccatttctaaagaactacagttggctgaaccccgacctctggctaggaacaatgtcatccccaagtctccctaatcaggagtacatgacacatcttagaccaaccaagctccgtggcgtgattcagccactgaggccaaccacggctttcacagcaatcgtgcatagcgcgaaacgacacgcgaagcg

SEQ ID NO: 245984 - DNA, 1772 bp, Homo sapiens
gcgggtcgctctcacttgtccctggaccgcagccgccgcataagtggtggccaacgctgggcctgggtgtggccggaagcagaggccgctctgactacacacccaccccccaaaggcttctgggagtcgcgcaggcgcagcggcagaccgggtgaggcggggcttgcggcgaggggtgggaccgcagggccggagtaaaagggtgcttggctgtgacaggtgctaagggcctgggcgtcagctccttgcgggagcgtcactgccgaccgggaagggaaaggcaatcttgggggcctccggagtccggaggatcactctgatgggtgatgtgtgtgggctaggaagggggatgtagagagcttgtgggattgttttgggtgccccctcaccttctcccattatctctggctacacgggcctcccatcctccaaaataccattttccattttgtaacctatgtatttgcacgtcctgggtcgaaatagtctaaccccaaattttcgtctgggctggctcctttatgccattcacttgtcatcgcctcagagagggctgcctaacgtctcaaaaataccagccctggcgacctcttaaagttcccttcctgtgtgaatcacggtctgaagttagctgatggatttattcttgaacatgtttaggaccggtctctcccccaggggccttatcagaactggagagcttcatcctgggagccaagggccttgctggctcacaggcagtgatgctgttacaccagtcatcacagatgcactgacctctgcacgcccagtcacactgcacgcctggtctccttactcttgaattgatttctttcaggtctcctggcctcagtgatggaattaagatgacttctatctctgaatccaagggtgactgaaagccgcaagctgcagaaaggacaagaggcatcacctatgtggataaagacagcatcctgagttgatggagaaatggcatagaaggaaccaggtcctttgatgacatcatggagcaaagctgtcttcttgccttgacctgctacctacctacatgggaagctgttacttgagaaggcaataaaatctatcttctttattgaaaaaaaaaaaaaaaaaaaaaaaaaaaaaaaaagcccgagggcctcatatgttgccggggggcggggaaaaaccagaaggggtcacgagcaaaggggccgggaggtggctcaaggtggcgtccccgcggacccgcaccttcgtgtgatcacgaagggggcacaacatggcggggcccccccaatgagaggagggatgcgcctggttaacggctgcgcaaaaagaccggggtaaacccggatttaaaataaacggggaggaaaaaggctggcacggtgaacaggcacgctgcgctactgttgctggtaacgccctcattcccttgaaacccaaggaggacaactggcacataggacctccgcacctgtgcctgacaaaagctgctccatgaatgcgccaggtaatcgaatgaatgatggcgatcgtcaagccggcggttgcacgtgccaaccgtggggccaagttcgcccaagggccaccttgatgccatttctaaagaactacagttggctgaaccccgacctctggctaggaacaatgtcatccccaagtctccctaatcaggagtacatgacacatcttagaccaaccaagctccgtggcgtgattcagccactgaggccaaccacggctttcacagcaatcgtgcatagcgcgaaacgacacgcgaagcg

SEQ ID NO: 245985 - DNA, 1085 bp, Homo sapiens
gcgggtcgctctcacttgtccctggaccgcagccgccgcataagtggtggccaacgctgggcctgggtgtggccggaagcagaggccgctctgactacacacccaccccccaaaggcttctgggagtcgcgcaggcgcagcggcagaccgggtctcctggcctcagtgatggaattaagatgacttctatctctgaatccaagggtgactgaaagccgcaagctgcagaaaggacaagaggcatcacctatgtggataaagacagcatcctgagttgatggagaaatggcatagaaggaaccaggtcctttgatgacatcatggagcaaagctgtcttcttgccttgacctgctacctacctacatgggaagctgttacttgagaaggcaataaaatctatcttctttattgaaaaaaaaaaaaaaaaaaaaaaaaaaaaaaaaagcccgagggcctcatatgttgccggggggcggggaaaaaccagaaggggtcacgagcaaaggggccgggaggtggctcaaggtggcgtccccgcggacccgcaccttcgtgtgatcacgaagggggcacaacatggcggggcccccccaatgagaggagggatgcgcctggttaacggctgcgcaaaaagaccggggtaaacccggatttaaaataaacggggaggaaaaaggctggcacggtgaacaggcacgctgcgctactgttgctggtaacgccctcattcccttgaaacccaaggaggacaactggcacataggacctccgcacctgtgcctgacaaaagctgctccatgaatgcgccaggtaatcgaatgaatgatggcgatcgtcaagccggcggttgcacgtgccaaccgtggggccaagttcgcccaagggccaccttgatgccatttctaaagaactacagttggctgaaccccgacctctggctaggaacaatgtcatccccaagtctccctaatcaggagtacatgacacatcttagaccaaccaagctccgtggcgtgattcagccactgaggccaaccacggctttcacagcaatcgtgcatagcgcgaaacgacacgcgaagcg

SEQ ID NO: 245986 - DNA, 1153 bp, Homo sapiens
gcgggtcgctctcacttgtccctggaccgcagccgccgcataagtggtggccaacgctgggcctgggtgtggccggaagcagaggccgctctgactacacacccaccccccaaaggcttctgggagtcgcgcaggcgcagcggcagaccgggtgaggcggggcttgcggcgaggggtgggaccgcagggccggagtaaaagggtgcttggctgtgacaggtctcctggcctcagtgatggaattaagatgacttctatctctgaatccaagggtgactgaaagccgcaagctgcagaaaggacaagaggcatcacctatgtggataaagacagcatcctgagttgatggagaaatggcatagaaggaaccaggtcctttgatgacatcatggagcaaagctgtcttcttgccttgacctgctacctacctacatgggaagctgttacttgagaaggcaataaaatctatcttctttattgaaaaaaaaaaaaaaaaaaaaaaaaaaaaaaaaagcccgagggcctcatatgttgccggggggcggggaaaaaccagaaggggtcacgagcaaaggggccgggaggtggctcaaggtggcgtccccgcggacccgcaccttcgtgtgatcacgaagggggcacaacatggcggggcccccccaatgagaggagggatgcgcctggttaacggctgcgcaaaaagaccggggtaaacccggatttaaaataaacggggaggaaaaaggctggcacggtgaacaggcacgctgcgctactgttgctggtaacgccctcattcccttgaaacccaaggaggacaactggcacataggacctccgcacctgtgcctgacaaaagctgctccatgaatgcgccaggtaatcgaatgaatgatggcgatcgtcaagccggcggttgcacgtgccaaccgtggggccaagttcgcccaagggccaccttgatgccatttctaaagaactacagttggctgaaccccgacctctggctaggaacaatgtcatccccaagtctccctaatcaggagtacatgacacatcttagaccaaccaagctccgtggcgtgattcagccactgaggccaaccacggctttcacagcaatcgtgcatagcgcgaaacgacacgcgaagcg

SEQ ID NO: 245987 - DNA, 357 bp, Homo sapiens
tctacacacctagctctcaacattcctctctaaaatatatgactctgtttactagtgtaaggatcaaaaggatcacatgtggcttccatgaaaagaaaggtatcttaaaattgttgtgcataaaatatacaattcaaaggaattacatagagttataaataatagagaaaataaaaagatcaatggtccataaggcgatgcaatgataaaccaccaaaaagtcctgagattctttctatgctagccacgtatgaagaactccaagccaaacgctattccttcggttgtatttttccttgaatctaaagaacaaaaatagggcctcacagtttgagagaatcattcactttgtctagc

SEQ ID NO: 245988 - DNA, 725 bp, Homo sapiens
ttattttcaaattgattaaaccaataaactaaaaactagtgttgataccatcatcatatatgctttgaaagtgttttccttttttgatagtagcagctcattcaaccaatatctcttgagcctctaccacttgtctatcacatagcaacattgtttcagtaacattacggtggatagaaagggcacaccactagtatgctttataacatgtattttcattattgtttacttcaaatgaggagaatatagtcttttttgataatgagcttgtgatagtttaattttcaaaagtataattatctaaagtgtcctaatgtcttctgaactgtagctaagtgatgaagctttatcaatactcaaagccaaaatgagattttgtagtaaggccaccctagttgtctaggttcagcatccttctgattggtcagtacctactcctgctgtgtggcagccccacaggacgagtgggttaattattttgagtcatctctcctacttatatccggaatatactgtgttccactgtaatgaaagcaatgacatttcaaacaggagacgatttatactaataatacaaagttttacttgtgtagagttagaacatatatgagagaagatattttaccaaagcacatatttccaagtaaacacctaaatcctgttactgaagagaaaaaaagtcctcaatgtttctatatgataataggtgatatattttaatttca

SEQ ID NO: 245989 - DNA, 583 bp, Homo sapiens
cattatgttgcccaaatttgtcttgaacacctggcatcaagctgtcctcttgcctaagcctcccaaagtgtttgaattacaggtgagagccaccatatccagcctatttaattttcctgtggagtcttttcccattcagcaatggcagttgcaaaaggggacctgaggatcaggtagttgtttgtttcaacaaagtgatctgcaaaattatttagttagttagttagagacagggtctccctctgtcacccaggctggagtgctgtggcatgatcatggctcactgctgccttgacttcccgggctccagcgatcctcccacttcagcctctcaagtagctggggccacaggcgtgtgctaccatgcccagctattttttgtatttttggtggagaaggggtttcaccatgttgcccaggctgatctctaactcctgagctcaagcaatccactcacgttggcctcccaaagtgctgggggattacaagggcggtggaagccaaccaatggccctgggcctaaccaaaaaatttaaactttttaaaaaaaaggcccgcctaatattgggggtgggtaactaac

SEQ ID NO: 245990 - DNA, 347 bp, Homo sapiens
ccataatgcgcaaatgactactgttaggatgttacagaatcatgcatggataaaagatctattcaggccaggcgcagtggctcacgcctgtaatcccagcactttgggaggccaaggcaggcggatcacgaggtcaggagatcgagaccgtcctggctaacacagtgaaacccagtctctactaaaaatacaaaaaaattagccgggcatggtggtgggcgcctgtagtcccagctactcgggaggctggggcaggagaatagcgtgaacccaggaggcggagcttgcagtgagccaagatggcaccactgcactccagcctgggcaacagagcgacactctgtctc

SEQ ID NO: 245991 - DNA, 553 bp, Homo sapiens
ttttttgggtgaagccttggagactggccaggacagtggcgggccgggtggattggatggaaacccgggccctgccgcaagactggggcgataatgggaaagtaaacaacgccgtggctttgttcctttcattcaggctttcttcaggtgggtggtgaatgtacaaggtacttctgaatttgttatggggaagtttccattctgcgcttgcaggcaggcacttctgccaaggtgagaagctggcgtcttgcgccccccagcggcttcctggcagaggagagctgcaaaagcccggcccttcctggattctaagaatgaagagcttgctctcctagcatttctgaactccagaggtgtctcctaaggacggggggagaggggagggggaagcggagccaggcggcattatgccccgtttgttcgctagtttcttttctttcttgatgtataaaatgatgatatgccttgattggataaaatatgttaattttaagtgattggaatataggtattactcttttaaaactattaaacttttcttttcttttctttt

SEQ ID NO: 245992 - DNA, 349 bp, Homo sapiens
agaattaaagaattttctatcaggggagcagggaagacactactgccggatgttttctcttgactttgactttgcttccaagaacatacttttttttccaaagctaaaaaaaggagaggagacagttctctgaagggaaacaccactccacgcatgggaggaaatcatttgcttcaatcttacactacttgagagcccatttgctccaattttaaaactcatttgttctgatatagctcttcatcccttcccaaatcccaaagcagtcttctgaaactaccctccttccatgaagcctggacccaacccctacatcatcacatgggcagggcctcccataagctccaag

SEQ ID NO: 245993 - DNA, 495 bp, Homo sapiens
tatacatctctggaatgcacacatgtcgaaactcgttgtgcaacccttgctgacatcaaggcaccaaaatgtctacaaatgtaattatttattatggcctaggtgggtaatatggcccaaattacccttaagctccctcttcaaggtccataaatgcccctaaggaaaaatacatcgtggtgtgctcagtcctctcttgctgaagtgccccactgcactctgctgcagtgttctttctatctaataaaactttccctttcaaacctatactgctgtgggtaaattcttctttctacctccgagcctaccaccttccattgccggggctctgacaccttgcgaaacaaatataaagaagcttttatcaaaaaaagcttgggaatcaatcacagcattatgcaaattggccataaaagctgcaagaaaaatttgaagaatcctgttttgatattggtaaatttcgagttgattttcaatttatgcaatacttctttg

SEQ ID NO: 245994 - DNA, 201 bp, Homo sapiens
ttcaattttgaaaacattatacacacacacgtgcacgcgcgcgcacacacactcgataaaagaataggtctaacattgactataaaactaaccaggaaatacaaagcctagcattggaaaataacagaatattgattgaaaatattatccttacagtagaaactcctataaaacagtaagacttcactaaacgaaactata

SEQ ID NO: 245995 - DNA, 415 bp, Homo sapiens
caaacactattatatcttataacttactgatttttttgaatatccaaaaaattcaagtaagacagcttttcctactatttggagttcatcagatcatccaagaggttaatttttggaccagcagcatcagcatcacttgggaacttctaggaaatgcaaatatttgggcaccaccctaggtttactgaattagaacctataagagtgaggctaagtaatccatattttaacaagccctccagggtattattattcactagtttgggctgaagtaagaaaaggcccaaattccattttctaagatagctacttttcattgcagttggaataaaaagtcacctgcagggccttccataatagctactccattattaatgtatttaacagaatattaagcacctattcccccaaccaa

SEQ ID NO: 245996 - DNA, 564 bp, Homo sapiens
gctgtcgagggattaatgctaggattacaggtggaccaccatgcccagctaattaaaaacaattttcttgtaaagatggggtctcgccatgtggcccaggctggtcttgaactcctaggcttaagctttcctccggcctcggtcttccaaggggttgggattacaggtatgagtcacctcaccttgcagaaagctgtgtgggtggaacgtgcctctgctgcccacccaggggccctgatgtgggaacctcacccatgggtaaggcagcggggacccaggtgtgcacccacaggctggccctgccgccccgatggaactgctgcttgtgccccccgcccacccagggaaaacagtgagaatccacagatgagcctgcatctcctccagcgtcagggtttgaggacttatccgttactgtccacgtgtagtggtgtgatctcagctcactgcagtctccgcctccaagttcaggagaattgcctaaacctgggaggcagaggttgcagtgagccgagattgcaccactccactccagcctgggctacagagcgagactccatctca

SEQ ID NO: 245997 - DNA, 411 bp, Homo sapiens
tacatctctctatttactcatgtcttctttgatttctttcatgggattgaaatgaactgtgcttttttttggactatttgcaagagggtcctacattgggggatgggccagagagtatcctaagctagctggttttcacaacataaaagctctcttcagctactacaggacatattagttcctacaaacatgatttgcctgtgtgattctttgcgtgccttctctcctaactgaaccttgctgcgttcaggtgggccttctacagccacaaaacgcaactgtgtttccataccctctttgcaggcaagagctgtaagtcccaccccactccctcatgtatttttgttggtgctctatgaaatttgctactcggcctctctcctctacttatttccatgtggctcctacaga

SEQ ID NO: 245998 - DNA, 429 bp, Homo sapiens
catcaccaccactaccatcatcaccatcatcaccatatcattattattatcatcaccaccatcctcaccatcaccatcaccattaatacaccatcatcaccatcatcacctagtagcttcagtcttagagtaagcttgtgctttcttctagctgttggtgttgtccaatatagtaaatcattattctttatttaaggcatttcctgagagatatttaaaacattgtcatctcaaaccatctatcttctctgttctttgagaattttgcagtgcggtcctccagctctccagagaacgttaggatatatttgaggggaggagggggagaagttgatgtcatgtcctctgtctgcagcttctaggagaggactgaccagcaacagtgtagtgactggtcaatcctgtagtctggagtttcatggctgaagt

SEQ ID NO: 245999 - DNA, 726 bp, Homo sapiens
acttgcacacgaacatgcaggaagttgcaagtttgttactcagacaagaaaaactggatggagcagccgctgaatcatgtaaatcaggttgaacttgactctggaaaccaggatttgtcctgaagattttcttcacagcctggactctccgccgagatattttcctctgacatgcacaaaccaggggttataaatttgtgcagagccagtgtggtgatgctgatacaggtggccctttccaaagtaaagaaatgttgccccagttcaactgcaatgcctacccaccactggcttttagaaggcacagcaagcttccagaaagcatcagcaggttcacagacttgttgaggagcattaagacacaccataatagttttaactctgactccaaaggagcacccatgatttaaaataaaaaaaaaagacaaaaaaaaaaaaaaaaaaaaaacttaggttatccccatttacccaccccacgtgtataggaatcttaaccctaagtaacacttacccatagctgcctgaagctagggtaggctcacagttctggagtacacaatgccatcatatataataaaaccaattgcccatacaagtgtgtggaaatgctcttgcttctgataacacctttacaaccaaaagttggctaagggaagctttgaataactttgtatgaaaaatttcttttaaggtactgtctaataaaagggttcacccactgcatgt

SEQ ID NO: 246000 - DNA, 1000 bp, Homo sapiens
ttcagtaagtacactaaattttaattactaattattatatagtttagaaatgcccaaatgcaaattaagtatcttcctgactaaactaacttcctatattttttcccctatgctaatggaaggagaaactctcacttatattttgggcatagaaaagcttgtacatcatcccttacacaccagggacctctgaggcatcagagcggctggaggtgggggtagggaaccactaggagctttaaccttcagcagaaggcaacttgtgtatcttaatctctgaaaaattgaatgcaatttaatattacaggactaggcctttggagttcaggacaaggaagtgaatggtcccaatacactctgcacatgtttaggcttcatttagactgttacattcagttgtgaacaccacgttttaaaaggacatcgacatacaaaaacacatgtagagcaagactgacacgttgctgggggatcaaaaaaggtgttataggatgatgaaaggaactgaagaagtttgctttggaaaggaaggcttagagagggtctgagcactgttttcaaatatttgaagggctgtcatgttgtaagatgaattagatttacttggtgcagctccaaagacctgactcatcaccatggtggttagaagttagttcaagacagatttgaggctcaagagcaagaactttccaaaaagtagagaggattacaaattgaccggaaggcagtgaactccctgttattgcaagaattctgacttcacagccaaagggaggtcttaccagggtgacccctggctctcaaagcatatcttctgcctgactgtactgcctgcaaagtgcactgatgcttcttttcctaaggggcaactcacttacgtccccttgtgactttctttacttcgattctgaagctgatgagagaactcaagaagcagaaatgcagggcaggccttcctttgaatggcctttttccaattagtaaaatgtttccctggtga

SEQ ID NO: 246001 - DNA, 799 bp, Homo sapiens
aggctcttctagccttcctgtctcatctaagagagaaaaaaagctgtgaagtgcttgtgaaggttacaggctggagacacaggcacactaaaagattgagacttcatcataggattagagaatgcctccccttccacaccttgctactacatcaacagagcttcagtataataatcgtggattatagctgaaagacctgcaaggatcagactctatttaaggaggtttttttgttgctgttttgttttgatttgttttttttttttttttgtaaatccaaaggaaacaagggagacaaaaagacagtagaagaaacagaaacttctgacacctacagctacatcaaacattaagcacagcccaactcctggccagattaacataaaacctcatactaatggtctctttggattagttcctattacttgatagatcatgtccagttttcaacaaaagaaattataacgtatgctaaaaaaaaaaaaaacacacattctgaagaggcaaaacaagcgtgagaaccaaattcaggttttggaattatcagatatggaatttaaaataaccacgattaatatactaagtaggctatgaataaaagtagataacatgcaagaccagatggctaatctaaacagagagaaactctaagaaagaatcaaaaggagttgctagaaatcaaaaacactgtaacaaatgaagaatgcctttgataggctcatcagtaagttggaaacagccaaggaaggaatcagtaaggttgaagacatggcaataaaaacttcccatgctgaaatac

SEQ ID NO: 246002 - DNA, 498 bp, Homo sapiens
tacattcacttggaaatcaatgggataaaagaaagtctacatttacatgaaaataaaaagatttgctttaataaaagaaaattaactttttaaaatccaagaataaaatagcgactgcatagagaatgggtttcatagtagatgtgtgcaaaagattggattggtgagcaacatttaaaagagccaactaatttgaaattctaacgagagggcaggtgcccaaagcgagaagcacattaacctttgctttggtaggctctagtagattacggtgttcagtttttccatgtcagagtgtcagagaccatggcccatgactatttgctgaaggagctgggaatggatgcttagaaaatattttttgaaaggtattcatttactcattcaaccagtatatactgaatgtctactatatgacaggactgttctaggcactagggatatggcaatgaacaaaacatcaaaatccttataagaatggaacttacatttagggga

SEQ ID NO: 246003 - DNA, 661 bp, Homo sapiens
tgaaacggggtttcattcttgttgcccaggctggagtgcaatggcatgatcttggcgtcggcttactgcaacctccacctcccgggttcaagcgattatcctgcctcagtctcctgagtagctgggattacaggcacacaccaccatgcctgactaatttttgtatttttagtagagacgagatttcatcatgttggccaggctggtcttgaactcctgacctcaggtgatccacctgcctcggcctcccgaagtgctgggattacaggcatgagccaccatgcctgaccttacaattcttaaaagagtagtgtacacatactacaaccacttcacctctccttcacaactcaactctctgcaatctggattcaatcctgacatttctcatgtcttatgggcacgaatttcacctctatgcagcatttagcaataagtaacaacagctggtaattattgagtgtgcacattctgccagtcactgtgttaagcacgtcacgtgcattttggttgatgcttcccaagctacaaatcaaacccaatcttttttccaagctctagactagtatagtgacaggcaccacaaatccatacagatgaaaacagagctcattagcaaaatcccactgctggatgtctcctgcttgcccttctagttcca

SEQ ID NO: 246004 - DNA, 741 bp, Homo sapiens
taaatcatgtgctcctagggacaaaggtggttggtggatcccagtggctaccacaaaatctggagtgattagatgccaaatatgattatgttgtattttaacaaatgcagaaagtataatacaatcatcattggcctttatgactaaagtatttataagactttaattcactttctcaaaatttcttgatgcctgcccgccacctctgataagcataaatatctctgccactcagtccctgtggcagactttagttttttccccagccctctatcagtgactgacacacatataacactgaacatttgtacatcccacagccaggatgattttgtttattttctttagtttatagtacaagacaatagatttttcttccatgtgcttgccttccacagataaaatattacttttgcaaattacaaatgttctcaccccaagattctggaacaacctacaaggtaggaatgccttgatctaattaaaacatttgctaactgctgattttaggggaaaactgtctttagcagcatctgtatgtgtaaaacatgtaggtccatcaataattcactgctgtctctacatttggtcactgactctcttctcacagggaaagaggtttcaaaccagatcctcttaggtctctgcactcagacccagccaaagctgggttccatagccttcagcaaaggcttgaggatgaaaagtaatggttgatgtggaataaaacatttgacatgc

SEQ ID NO: 246005 - DNA, 477 bp, Homo sapiens
gagagaagaggaactagagaatcctagtaagaaaggatcgaacaatagggaatcatgccacattctcccagaccttcactccctctctgaatcaagccgcctagactttattctgttgacaaagaagagccattggcaggtattaagtgtttcaaatctgctctgtctaaagggacgttccactctgtgagttgaatcatatacagatacttgcatgcatttaataaactatccaataagtggtgcttttaataaattctgaatacaatcaattaaaagatttgtgcacattattatttaggtatggtaccaagtaaatcagaaacaaatgcaagagcacgaatggtttatttagctacctttccatattgggtcttgatgacattagatactctgctgtattttattttttaaagtaaacatattaaaactagccaaataacctatattttcttttattacattatgatgcctaaa

SEQ ID NO: 246006 - DNA, 396 bp, Homo sapiens
aacagaacgtttttctttctcatctttgcctacaaattctactatatctcctttttgcttctctctctaatgctgtgggattttttttttctacttttcaaagaaagaaacctgagcaggtgtggaggcttatgcctataatcccaggactttggggggccaaggcaagaggatcacttgaggccaagagtttgagaccagcctgggcaaaactgggtgaccccatctctacaaaaaataaaaatatttgccgggcatggtggtatgcatcttgaagtcccagctaatttggaggttgaggtgggaatatcatttgagcccaggagttcaaggctgcggtgagctatgatcacaccactgcactccagcctcggtgatagagcaagaccttgtatc

SEQ ID NO: 246007 - DNA, 243 bp, Homo sapiens
agacactccccagactcaagctgagagacggcacccacacccactcgccaacaaggcacctgccccacgcctgccccaaggccccagaactgatcagaaaagggcctggttcctggggcggggggagcagccaggtttgtgcctggcctcaggagagcaaggcagatgcagccgggtggctggagggagggggtgaggccaggccagagcctgggcagccaggcagcctggggaccctgggga

SEQ ID NO: 246008 - DNA, 661 bp, Homo sapiens
tgagatggagcttgctctgtcacccaggctggagtgcagtggcacgatcacagctcactgcaacttccgccacctgggttcaagcaattttcctgcctcaacctcccgagtagttgagattacaggcacgtgccaccacacctgactgatttttgtatttttagtagagacagggtttcaccatgttggccaggctggtcttgaactcctgacctcaagtgatccacccacctcagtctaccaaagtgctgggattacaggttgtgagccactgcacccggcctctgtctgacttttaaatgatggagtatcccagaggtcaggctttagagctcttctttcttccatctacagagtgctcatttctttggtgatctcattcagtctcacggctttgaatgttatatgctgataagtcccaactttctctgtctcgcctaaacttcccctaatagcagaacctgatatcaaagtgcctatttgacatctccacttagatatctaataagcatctttaatgtaaaatttccaaaactgagctcctacaattccctcccacacttgttcagttttccccatctaagctaatggcaactccatccctccagttgctttggccaaaacttttgagttgcctttgactgctttttttctcccttct

SEQ ID NO: 246009 - DNA, 298 bp, Homo sapiens
attcattcagcacacattcctggaacatctctgtgcaggcacaaatgatacaggggagaattagatgagttctgtcctctccagaaatgctccatgaggttgagaggcagatagaaaaccccaatcccataccatcgttggtgccaagatgaaaggattggcagggcactggtggggctggaggcgaggccttcttgaggaagtgacctgcctctctttccctccctgcaggcccggttaccagcttgtaccgagtcaccctcagagctacagaacttctggcaattggcctttttta

SEQ ID NO: 246010 - DNA, 650 bp, Homo sapiens
cctctttctgctgacatccccatcacaacattcctcagaaaagcctacaaagatctgttaccattctgatgacacagaggatcttcattttatttctttaaatacctaattttacatctttatacttctttggacatggaaaggtttccttttccttttttgtttttggtaattttattgcgttgtattcagtgtacatgaattttttttcctcttctgttcttttttcttttttattgttatttttttatttatttattttattatactttaagttttagggtacatgtgcacaacatgcaggtttgttacatatgtatacatgtgccatgttggtgtgctgcacccattaactcgtcatttaacattaggtagatctcctaatgctatccctcccccctccccccaccccacaactggccccagtgtgtgatgttccccttcctgtgtccatgtgttctcattgttcaattcccacctatgcgagagaacatgcggtgtttggttttttgtccttgcgatagaggcattcagttagtaaagaggttggagcaacaactctttttttttttttttttcacaattgtaatcgaacaggtaatgaagccatttgttaaaatatttgcctttttaagtaaaaaagatttcag

SEQ ID NO: 246011 - DNA, 465 bp, Homo sapiens
agacacagcataccagagtctccaaagggctaagctcagcaatctgttctcaagctcccaacaggagtcttatatagtcaggcaggcaatgatcatatatggggaccattagaaataatctaatgcataccctctgaacttcaaatttttagtattctcattttctgctcaagctcaatttcaacacagttcacagtttctcatatccaccatggcattctgccaaggaactacaactcgtgttctctaaacccatctgttctaagaatgctgggctggttatcaatttctaatgtacctgcttaaactttcctctctcaatatgtccctgactgaactgcagaagacagaacaactgtactagccatctctttctgcatatcccatgtccccacagaggccactgtgtcttcataaagctaactgccacgattttcacaagtgatatttttccttcatgatttt

SEQ ID NO: 246012 - DNA, 491 bp, Homo sapiens
agttaacagagacttgaaaagcacttgtgccttaggattgcctatttttttttgctctttggaatgctgagaacactcggtgaagaaggccaagctagcctgttgaatggtgagagacgtgtgcagcagagataatttataccagattcaccagcctgccaatggccagtcactcagatggagactgtcctagaccatccagccctggctgagcctccccaggctatgagagccaccctgctgacccagagagtcatgagaaataataaatccttgcgggtttaagctagtgaacccagtgtggtttgttacacaacaaaagctgactgatataggaccttggttatttattctgtgaaatgaccatggtgaggtagaatgagagttgcagaaagcctctcactctattcagctctgacttcctcggaatggaatcctaaagagacacttgttctggagaaattatttcacactaacttcaaaaaaaaaaa

SEQ ID NO: 246013 - DNA, 479 bp, Homo sapiens
aatgattgatccacacggaacacagtaaggatgctgcaaagactgatgctacaacccaccagaaggctagtagatgcctcctgccacagaagcagccccacccctcgtggtgctttcttggctttaaagcaatacttgatgtccactttctagaggacatcataggaatatcctgcttggagttagtggaaggattccagggagagatctgccattccttcttccatagatcaagctgctttggccagccctctgcctttggctcagtcagaagtattttccctaacttagctgtaggagggagaggaacttgtggcagtctgagtaccaggctcctttattatctgccttccactgttaacggagaagggactgtgtaccgtttgagagagattttgatattgtttaaataagcttctcttgtaaaagtggtttttttttccaacttcctccagtgcttattagctaaatatatattt

SEQ ID NO: 246014 - DNA, 835 bp, Homo sapiens
tcccatggtttcctttgctcccagcggttgcgcgggctgggtttttggagcaaaggcaacggatactgctgaggctcctgagaatgtcccgttttcgaggctgcagtagctccggtgtccggttctgcagtgccgagagggaggcctcgggctccgggcgggggaatgtgttgcagtttgtccaagagccccaagcccagcaaagccgcccgttccccgctggggcgcaactctcactggaactcttgttctctgactggggaatggaatgggctcagccaaggctcccgaaaccagccctgccgctcccagttgtggtcgcattctcaagagcggctgactgcgccgtggaccatcactttcgcttctgcctgctcttgcgcctattgcggcaactactcacgctcctacgggacgaggagagggaggtgaatccgtggcagagaaaaatagtagtctagtcattcaagtgaaaggtccaagaaaggaagaaagaaaaatttatcaaaaagaaaacacaagaagtattctgaagatagcgacagtgactctgattctgaaacagactccagtgatgaagacacaaaaatgagagcaaagacagctaagaaaaaggaaaagaaatgcagatggccagattttttcctttaatttttattatggaaaaggtcaaatgtgtataaacatacatagaatggtataatgattcctcaggcacgtagcacccagcttgaacaattaacaacttgtgggaaattgccattgccccctaattaatttgaaaccaatcccaggtataatgtcatttataaacaattcagcatgtttctctaaa

SEQ ID NO: 246015 - DNA, 757 bp, Homo sapiens
cacgctggcgactcccacagaacccttcacgctgacgagaggaattggaaaacaggcccctgtagtccaaagagcatgagggaaatccctgctccactttggccccaagctggacctagtcataggaatgggaacagcacagagaggctgaaacctgggcttttaagtcaaaggacacagcagaggagttaagagaccccctaaagctccacatgaatggcactgacgtggggaaaacagcaaaggctatttgagctcaactcctgtgtagactggcccctgggtgaacagcacgacacagacttggaagactagcctgacaccagagtcacagctccaggaggcaggctggcacatgcaatcagaacataactgggttacttgcctgctgagacacaactcagcatcctgcagagggtttcatggacttgggagtctcaaggtatgccgaatgtctagaatacaaaattactaaacgtaaaaagagccagaaaaatctctgccctaaagtgaaaagaccgaatgccaactctcacatgacccaaatattgggaatatcagataaagaacagttattataaccatgctctgtgaaataagggcaaatgctcttgaatcaaagaaatgaaaaaattcagtgaataaacagaaaaacatttggaaacaaaaatgaactgggacttgtaggacaagattgaagggtctactgtgtatgtcactagattcctataaaacagagaaacaacgtatacaattt

SEQ ID NO: 246016 - DNA, 1010 bp, Homo sapiens
ggttttactgcagcagccggagtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggacgtgttgcagcaggcattctcttctggaaggagtcgttgggagcagtgcggttggacacaagtttgcgtaggagtgttttccttttgtcaataattaatcaccggaattagccaggtagaatttgagttttagcaagagtcctgagggcggggccgaacacctaactccgggaggctcccaggcgcccggcgcagtgggaagctcgcagcagctggggaggagccaaagcctcggcgctcacctaagccgcagggagatacacccaactgggagtaagaactgcaaacaattgtgatgcttgaaccacaatatatttccccaccctctccagttgagtgtgatgatgttccactaaggatgggtgcagccactaacgcagggccccctctcaacctagatcctcgtctacagtataccctgagagaagcaggccaccagcattactcatcatccccagctttgtgtttcagagctctattctagataagagcaactgagagctctgaggctctcttcctccaaccatcctccactcttaagacagaaaatgaagaactcaacaacaagaacacaactcatttaaaagtggacaaaaaaatttgaatagacatttctccaaagagcaggtagaaacagccaatttacacatgagaaggtgtttactagccattagtggttggggaaatgaaaatcaaatcaaaaccacagtacaatcccacttcacaccaaccggaatggctatcacaaaaaa

SEQ ID NO: 246017 - DNA, 2452 bp, Homo sapiens
ggttttactgcagcagccggagtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggacgtgttgcagcaggcattctcttctggaaggagtcgttgggagcagtgcggttggacacaagtttgcgtaggagtgttttccttttgtcaataattaatcaccggaattagccaggtagaatttgagttttagcaagagtcctgagggcggggccgaacacctaactccgggaggctcccaggcgcccggcgcagtgggaagctcgcagcagctggggaggagccaaagcctcggcgctcacctaagccgcagggagatacacccaactgggagatgaggaaacagcaacccagagaggagaactaacccacacaggatcatttcgcgaaggagcaaggctgaagaaccagacctggactttcttaggacaaacttactgcagcttgaaggagccaaccatggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattgatcctgttcacattcagtgaaatggcattgcatatttatatgttgcttacagcttattgatttaggtaactattgtgtcttccttcactatctgacctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagactcctaacagacctaccagaatcatgcttaaagtgctcccttgacacttattctatactgaaggataaattttaaaaaatctttataggctactgtcagaagtatcctatccttgtttacgatgtataaaaagatgtgaataaattatatggaccccctaagtcttattttctagtaaactgatgatactggaaattcttttacttcaaatgcaaaagaataagctggaggcaattatttcctttcatacagagttcatgaattgttttaaatgcttcttaaagtctggctttataaccgtttaaaatcaacaatgttgattttagataaccaagtaagtattataatacaaaataattttaagtgtaagaaactaaagtataatcaaagtaaattcagttattgtatttgtggtgttgccttgccttgcatgatgctgggggaaaaagagaaaagaaatggttttctttttgtactttcattcagtgtagagggaaaaaagcatgtattgggccaccggaagacaagctaataaataggctggaagtaatattctaccagcaggaactcaacagctccagttaaatgctttgatatagtggctcctttgcagagccaaaacaagatttattaaatttccttcaaactgtttatctttaaaacaaatataaggttttaattatactgctgaagcaaatgtgaatgccaaagactacgttttgcagttttgctttcctcccaataaatattaatgtatgtaattctagagggtaaaaatgtaaataggtttggacaatatttgcacccttgtttgtgttatgaaaaaaatttttccaaggcgagctagagagaaagatgtttggcatgccaaattaacttgcatgtttgttaaaaaaacaaacacatgttttgaagagaaaccagatctgaacatgtatttgttgagttttgcaaaataaaattaattttgtaagtaaatatctaaaaaaaaaaaaaaaaaaaaaataaagaaaaaaacaaaaaacaaaaaaaaaaatataaaaagtaaaattacaatataaatagacgaaattaaacaacgtaaaagaatggaaaaaccctagacgaaacccaacttagggggcttgcagaacataattcctttttaaaggtggcgttttaaacaaacaggggccgcatttatcaaacttgccaacaggaaaacaccttgaatgcccaatgtcaaattgtttgcgaaaatatctttt

SEQ ID NO: 246018 - DNA, 2379 bp, Homo sapiens
ggttttactgcagcagccggagtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggacgtgttgcagcaggcattctcttctggaaggagtcgttgggagcagtgcggttggacacaagtttgcgtaggagtgttttccttttgtcaataattaatcaccggaattagccaggtagaatttgagttttagcaagagtcctgagggcggggccgaacacctaactccgggaggctcccaggcgcccggcgcagtgggaagctcgcagcagctggggaggagccaaagcctcggcgctcacctaagccgcagggagatacacccaactgggagatgaggaaacagcaacccagagaggagaactaacccacacaggatcatttcgcgaaggagcaaggctgaagaaccagacctggactttcttaggacaaacttactgcagcttgaaggagccaaccatggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattgatcctgttcacattcagtgaaatggcattgcatatttatatgttgcttacagcttattgatttaggtaactattgtgtcttccttcactatctgacctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagactcctaacagacctaccagaatcatgcttaaagtgctcccttgacacttattctatactgaaggataaattttaaaaaatctttataggctactgtcagaagtatcctatccttgtttacgatgtataaaaagatgtgaataaattatatggaccccctaagtatttcctttcatacagagttcatgaattgttttaaatgcttcttaaagtctggctttataaccgtttaaaatcaacaatgttgattttagataaccaagtaagtattataatacaaaataattttaagtgtaagaaactaaagtataatcaaagtaaattcagttattgtatttgtggtgttgccttgccttgcatgatgctgggggaaaaagagaaaagaaatggttttctttttgtactttcattcagtgtagagggaaaaaagcatgtattgggccaccggaagacaagctaataaataggctggaagtaatattctaccagcaggaactcaacagctccagttaaatgctttgatatagtggctcctttgcagagccaaaacaagatttattaaatttccttcaaactgtttatctttaaaacaaatataaggttttaattatactgctgaagcaaatgtgaatgccaaagactacgttttgcagttttgctttcctcccaataaatattaatgtatgtaattctagagggtaaaaatgtaaataggtttggacaatatttgcacccttgtttgtgttatgaaaaaaatttttccaaggcgagctagagagaaagatgtttggcatgccaaattaacttgcatgtttgttaaaaaaacaaacacatgttttgaagagaaaccagatctgaacatgtatttgttgagttttgcaaaataaaattaattttgtaagtaaatatctaaaaaaaaaaaaaaaaaaaaaataaagaaaaaaacaaaaaacaaaaaaaaaaatataaaaagtaaaattacaatataaatagacgaaattaaacaacgtaaaagaatggaaaaaccctagacgaaacccaacttagggggcttgcagaacataattcctttttaaaggtggcgttttaaacaaacaggggccgcatttatcaaacttgccaacaggaaaacaccttgaatgcccaatgtcaaattgtttgcgaaaatatctttt

SEQ ID NO: 246019 - DNA, 1494 bp, Homo sapiens
cggacgcgtgggtcgacccacgcgtctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagactcctaacagacctaccagaatcatgcttaaagtgctcccttgacacttattctatactgaaggataaattttaaaaaatctttataggctactgtcagaagtatcctatccttgtttacgatgtataaaaagatgtgaataaattatatggaccccctaagtcttattttctagtaaactgatgatactggaaattcttttacttcaaatgcaaaagaataagctggaggcaattatttcctttcatacagagttcatgaattgttttaaatgcttcttaaagtctggctttataaccgtttaaaatcaacaatgttgattttagataaccaagtaagtattataatacaaaataattttaagtgtaagaaactaaagtataatcaaagtaaattcagttattgtatttgtggtgttgccttgccttgcatgatgctgggggaaaaagagaaaagaaatggttttctttttgtactttcattcagtgtagagggaaaaaagcatgtattgggccaccggaagacaagctaataaataggctggaagtaatattctaccagcaggaactcaacagctccagttaaatgctttgatatagtggctcctttgcagagccaaaacaagatttattaaatttccttcaaactgtttatctttaaaacaaatataaggttttaattatactgctgaagcaaatgtgaatgccaaagactacgttttgcagttttgctttcctcccaataaatattaatgtatgtaattctagagggtaaaaatgtaaataggtttggacaatatttgcacccttgtttgtgttatgaaaaaaatttttccaaggcgagctagagagaaagatgtttggcatgccaaattaacttgcatgtttgttaaaaaaacaaacacatgttttgaagagaaaccagatctgaacatgtatttgttgagttttgcaaaataaaattaattttgtaagtaaatatctaaaaaaaaaaaaaaaaaaaaaataaagaaaaaaacaaaaaacaaaaaaaaaaatataaaaagtaaaattacaatataaatagacgaaattaaacaacgtaaaagaatggaaaaaccctagacgaaacccaacttagggggcttgcagaacataattcctttttaaaggtggcgttttaaacaaacaggggccgcatttatcaaacttgccaacaggaaaacaccttgaatgcccaatgtcaaattgtttgcgaaaatatctttt

SEQ ID NO: 246020 - DNA, 152 bp, Homo sapiens
agagattccaggtttaataacttcagttctccccactgtgtatatagatgttaagttacacagatttggcattattcccattttcaggttaatatcagaacacttgttatcaagtcaggatagtaattgtgagcctagatgctctaggtttg

SEQ ID NO: 246021 - DNA, 1503 bp, Homo sapiens
  misc_feature (1039)..(1039): n is a, c, g, or t
  misc_feature (1395)..(1395): n is a, c, g, or t
  misc_feature (1489)..(1489): n is a, c, g, or t
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcaggagaattgcttaaacctgggagaaggaggctgcagtgagccaagatcgtgccattgcattcaagcctgggtgacagagcaagactcattctcaaaaaaacagagcaagcttccggagctatggattgggtcaaaggttctggccaggcatactctaaggagcgctaaagggtctcttgatacgggacctggttcggtctcgctcttctccgccctttcttcgcccaagcctgcgtccttgctgccgccatcttctcttagcacacaccgcttgtcctgaccatacgcgggcgcactctttcacatttcacgttaatagacacctgcgggcggtattcgtccctcggcggatncaacgatgcgtctcaccgtctctaccctctcacactactcgcgctttgtctccatctctccgcggctcttgtcacggctctctgctgtacaacgtctgtcgactctctttatctccatctctatggcgcctccttttctacatctcgtactctcgctctctcccctggtctcttcatctctgcgtgcggtcgctcctttatgcaccttctatctcatctactctctctctctcgtcacctctctactctgcgctctcgtacttactctcatcatgtcactatctctatccttcgtctactgccaccttcgcgtctcggtctgtcctctctcctcattcacgtcaccatgtctctcngcttcccctcgggtggccacgatcacactcgtacggtcactctcttctcatatctcatgaccctcactttgctcgcatcatcccctcctctctngtaggcttgacgcc

SEQ ID NO: 246022 - DNA, 1354 bp, Homo sapiens
  misc_feature (1192)..(1192): n is a, c, g, or t
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcaggagaattgcttaaacctgggagaaggaggctgcagtgagccaagatcgtgccattgcattcaagcctgggtgacagagcaagactcattctcaaaaaaaagacttggaaaggcttcttggttcgggatttggagggcctcaagccccttaccgccctatttatcgaagggtaagaaaacctgtttgagcggtttatatttaaccaaaggttccccgtataacacgtggcacctttcattttcctgcacctgtgagtcatatcccgggccctctgtgcctcccacaccatattggggccccctggcgcctcaataccctcagcaacactctctttctataacaatagggggtcttctttactaccatgtgggccttctatatccgctctactctcttcttgacacacactcactctcggacgcgcttctcgtcgcctcttctcgcctcattacctcgctcttatctcttctcgtcatttctctcgcttacacacacacctctattntctctcactcctgccctttgctctccgacacgctcctctaagctctacgactcgcgtcgtacccctcatccctcctctagttgctgatcatggcatgccatctccactctccgcattattctcatctcctcactccgctgcctccctgtctctcctctcttc

SEQ ID NO: 246023 - DNA, 1279 bp, Homo sapiens
  misc_feature (1073)..(1073): n is a, c, g, or t
  misc_feature (1078)..(1078): n is a, c, g, or t
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcaggagaattgcttaaacctgggagaaggaggctgcagtgagccaagatcgtgccattgcattcaagcctgggtgacagagcaagactcattctcaaaaaaaagctgagaaatgactactagagtaaggaatatggatggtactaaagaccataaacaagactattttagtagaatggtagagaaaaacttgattgaagcagcttcaattaagaacaaaggtgtgccgtgtaccggagggccacttccacatttctgtcaaggaactgtgggagtaattacccagggtagttttaggggcacaaacgttaaatcgtggaaccagggccggttaaagatcctttggaacccgaacggttgttcgtaaggaccaagggtgtctttttaagnaaaangggcggattttggacacggctaatcgtggtctcaaacaaaaacctttgtgcgggccctcacctgtgctcttgacccccaaaacctctgttcaacttatctgcgatttccatcgcataacacaaatctttaagcgtggacggttaacagctcttttttctttcaacatagggcaagtggctcgtttatttatctctcgtgct

SEQ ID NO: 246024 - DNA, 1268 bp, Homo sapiens
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcaggagaattgcttaaacctgggagaaggaggctgcagtgagccaagatcgtgccattgcattcaagcctgggtgacagagcaagactcattctcaaaaaaaggcttataaatgcctccttggttagggaaattggtggtctctaagccttaacacggactattatgtgaaaggtaggaaaacttggtggaacaccttaatttagaacacagttttgccgataaacagggggcccctttccaatttcttgtaaaagaaatctgtgagggatactcccagggcattttagggtcaccacgcgttatatggtaacccaaggcgttattaaaaacttatggacatagatctcttttctaaaaactcaggggctcttttttatcaataccgggtttctctaacaccgcaactcctgtttataactcaacactccttctgtcttttcccgtgctctctgttcccctatcttgtatactttcttcgcgttctcccccttcaacacatactctctcttatcacttctcctccatcttttcttctcgtacatcactttagtcctcggttctcttcctcatcactctcgtccg

SEQ ID NO: 246025 - DNA, 1222 bp, Homo sapiens
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcaggagaattgcttaaacctgggagaaggaggctgcagtgagccaagatcgtgccattgcattcaatgttgcacggccaggatcctttcaaacacaaacaccggcccggcgtaatggtatggccaaggttctgcccggataccccataggcggcaacggcctccctgggcgcggaactcgcgtccctaagcccttctcagcgcctttttagttgatcgcgcgcgctctcttggcgacgcttccctcaacacccgcgtgtctccctcacacggcggccaccttcacacttcctcgtctctcctgagttgtcccacgggcttcttgggctcactaccctactctgccacctccggcctcctcgctttctcggctaccaccagcttctttccacccaccagcctctcttatcctacacgcccgcgctccttcacccttggcgtgctcttcttacccctcaccctcggctatcccttcacgccgtcaccctccccactagccttcgcccctctcactctctgactacccgccatcgcccccc

SEQ ID NO: 246026 - DNA, 799 bp, Homo sapiens
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcaggagaattgcttaaacctgggagaaggaggctgcagtgagccaagatcgtgccattgcattcaacgcctgctggccgagcaggattcatctctccacgtgccggggttgggcg

SEQ ID NO: 246027 - DNA, 719 bp, Homo sapiens
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacaaattagccgggcatggtggtgcacacctgtaatcccagctatttgggaggctgaggcacgtggcgctaacccttggacgtaggcttgcccc

SEQ ID NO: 246028 - DNA, 1301 bp, Homo sapiens
  misc_feature (1139)..(1139): n is a, c, g, or t
aagcaaatgtttttttggccggggcaactggtattaagtgttaataatggactatgtagaaattttatctacatttaaatcctaggatctacacctcataaagttattgaattattacccccactttacagatggaaaactgaatattaatggcagcgattcaaatctacacaatctagatgaaaagttctagaacaacattgccactgactgattaaaaagtcaactgaaggaaaagccagtgagaaacaaggcaatcaattactgtacagtatttagctttggatatgttaattctgagatccctattagacctccaagatattaaaagggagaaatttgggagagatatggggactggagatacaaatgggagagtcaggtacttaaagccactggacttaacagaggagaatacacagggagtggctactaataaagacgttgtaggactgactgagccctgggagccttccaacatttagaggtagggacgacaaggaagaatgggggttgaggggaatagccagtgaaggaaaagagacaagaaaatagtatgaagaaaactaatgggtccaggcacagtgactggccaacatggcgaaaccccgtctctactaaaaatacgaggcaggagaattgcttaaacctgggagaaggaggctgcagtgagccaagatcgtgccattgcattcaagcctgggtgacagagcaagactcattctcaaaaaaaagacttggaaaggcttcttggttcgggatttggagggcctcaagccccttaccgccctatttatcgaagggtaagaaaacctgtttgagcggtttatatttaaccaaaggttccccgtataacacgtggcacctttcattttcctgcacctgtgagtcatatcccgggccctctgtgcctcccacaccatattggggccccctggcgcctcaataccctcagcaacactctctttctataacaatagggggtcttctttactaccatgtgggccttctatatccgctctactctcttcttgacacacactcactctcggacgcgcttctcgtcgcctcttctcgcctcattacctcgctcttatctcttctcgtcatttctctcgcttacacacacacctctattntctctcactcctgccctttgctctccgacacgctcctctaagctctacgactcgcgtcgtacccctcatccctcctctagttgctgatcatggcatgccatctccactctccgcattattctcatctcctcactccgctgcctccctgtctctcctctcttc

SEQ ID NO: 246029 - DNA, 343 bp, Homo sapiens
ctcagccttggatgcatccgaagtgtgaccctgtgagctgagcatgtgagccgtggtgccctgcctgctccctaagcttttcatctgtggcccatgtcagggggtgggaggcgggggtagtgcatgttttgaagcacacaatttcactcctatccataaagagatccattagttcaattaatgaagccagtacactgaggtgttgaagggcagagactccgccagtctgccaggattcagatcccagctctgcctcttcctggctgtgtggctttaggcacactccttaacctttttccatcagtttcctcatctataaaacggggataaccacatgatcaaa

SEQ ID NO: 246030 - DNA, 411 bp, Homo sapiens
cacatgcaggcttcctgtttgtcaatcaagttttcttggaacccagtcataccgcttccttcaagtattgcctttggctgtggctgctttacatgacaacggagtggagcagttgaggcagagactacatggcccacgagcctaaagtttttactatctgaagctctaagaaaaagtttgcctgcccagaaccccaagctgttatttcaggacccacaaaatggattacttacagacatttacagcaccaacgccctcacacaaccttatagggaaagcaaagagacagaaattagttgtggggagcaaagctggtgaaatctgtttaacctgcaaattctctcctccaattagcgttgatgcacattccaagtaaataatatgcagacatgctcctgggtgttgaagcac

SEQ ID NO: 246031 - DNA, 453 bp, Homo sapiens
aaggagtcagggagcagaaagtatatgcatcagtaactcacagtgaaagcttgtttaatgaagctagcttcaatgctgtgagctgctctatagacgcccatgtaggaggaaactcaaggggcccccagccactagccattgaggaactgaggccctcaatccaacaacccacaaggaactgaatcctgccaacaaccactgagtgagcctggaagcggatcctgcccagctgaaactcgagaagattgtagctctgctgccctgaccactattctaactgcacccttgagagagaccctcagccagctaatctgtacctggattcctaacctggagaaactgaaatagcaacgcatgttgatgtaagtgctaagtttgggagtaatttgttatgtaacaataaataactaataatacttattatttaggcaataaaaccatagaaaataattc

SEQ ID NO: 246032 - DNA, 574 bp, Homo sapiens
ggactgttcaactcacctggcagccactcccagagcccctggaactctggcccaaggctctctgactgactccttctcggcttagcggctgaagactgttgctgcccgatcgcctcggaagccccgtagaccatcacggacgccgagcttccagtaactcacagtgaaagcttgtttaatgaagctagcttcaatgctgtgagctgctctatagacgcccatgtaggaggaaactcaaggggcccccagccactagccattgaggaactgaggccctcaatccaacaacccacaaggaactgaatcctgccaacaaccactgagtgagcctggaagcggatcctgcccagctgaaactcgagaagattgtagctctgctgccctgaccactattctaactgcacccttgagagagaccctcagccagctaatctgtacctggattcctaacctggagaaactgaaatagcaacgcatgttgatgtaagtgctaagtttgggagtaatttgttatgtaacaataaataactaataatacttattatttaggcaataaaaccatagaaaataattc

SEQ ID NO: 246033 - DNA, 350 bp, Homo sapiens
ccaccccaatgagaagagacctttcccacctcagaaccccatctgcacttccttggtctacttcttcagttgatgagtcatctgaaatacagacatgtcagaatctaaaaaggacaccagaaaaggccttgtgggcactaaagggtcccagagaaaccccatgttgtcaaatcccatgtttttcctcccaacagtcaatttggattatagcttactgcatttttgagagaggagagctgagatttgaatccacatcagactgtgctggaaacagaatacagagcccatcgtaggatgtacttccctctgtagcctagtttctgaaagtgtcattaaacatgtgggaacca

SEQ ID NO: 246034 - DNA, 168 bp, Homo sapiens
aattgcaaattgagacttgctgctctgtaaagaaaggccatggcttttctcaaatgtttgcttttccacacttgcacctgcacatcaccataatagtacagattaatcgagtttaaataaagatgtgtctaattcggaacacagaagcttaaggaaagagctctgttt

SEQ ID NO: 246035 - DNA, 316 bp, Homo sapiens
gatcctatttttttaaatccgttctgtatcacaaacatgccaaacagctaaaagatgagataaaacagaactacaagaaagaagtttaaatttccaaggcaacagacagctctgaggttcctggttttaaaacatcgtcaccatcatcattctttatttatatatgaattgagtcttaacagtataacaaatggctaaatacattacaataatctagtatttacatagaaatctctttacagtttgacaactgtatagaagtacctcttttagaaatgatattcaaacaagactgatcaccagaagatgtctagtg

SEQ ID NO: 246036 - DNA, 312 bp, Homo sapiens
atttaagaattcaatatcgcaatggggcatcgtcattttctcttgtgcaagaatgctgtagaatgctagcagaacatgacgtctaccagagcaacatggttgatttctaacaaggatcagataagagaatgatgaaagctaatatagatacaagataaatagagttacagataaatgtatataatacctctatttggatataattatcagatataatttacatatcataaaatttaccattttaaataatacgtttcagtggttttcagtatattgaaatgcaagatcatcaccactctctcattttgaaca

SEQ ID NO: 246037 - DNA, 788 bp, Homo sapiens
cagactagaatgtttctgttcattataaccccatgataaagcacaaccactttagtcagtttcacctgagattccctactattgagatgaaaacattacgcacagctggtctcagtggcgcacttctgtaatcccagcaacttaggagctgaagtgggaggattgcatgaggccagaagttcaagaccagcatgggcaatatagcacaatccaatctctaaaactaaaaataaattagctaggcatagtgatgcatacctctagtcctagctactggagaggctgaagtgggagtatcacttgagcccaggagttcaaggctgcagtgagctatagttgcactactgcacttcatcctgggcaacagaaaccccatctctaaagaaagaaaattaggtgacatgtccctccacctgtcaacccaaccaaaccaagatattagcaggcctatgcagaattggcaaagaaggttgtaaaaatccctgtctgttctcagcccatcagccacctcgaaattttaaaaaagtttaaattaaggtagaagagtgaggagggcaggtctgttcttggtggagcagtcaatatgctgggctttctctcaccccaagtcagataaggggcccccaggattccagtgccacaagagaaccagagaacttggcgtatattttctggactttggagggcccaggaaatggtgacttctggaaacataaaggcaaaaaggctctgccttggtctacctgccatgatgagagaacagaaagagacactaggaggaaacccct

SEQ ID NO: 246038 - DNA, 424 bp, Homo sapiens
gtgtagtgctcttctttccctttcgcctccagtctcagcctaggctgagcctctgacctgcggctagaaaggtcacaactttcctgtggcttaggaactcccggtagtgttgagaatagaaggaacccctaccctgcatgcctaggggtccggttatcttgaaagacttttgcctcctctctgagcaagtacaacacccaaaagatgagatgctccctctcagtcagccttattggaatcttttactgttgacatgatatggctgtacccgctgttctgactcagatatttcaagaatccgtggggccttttcaggccaaatcagaaatgaacaagagaagatgagagttcacactccaactgggtattttaagtaaaacctaacgaatacagtaaaatctaaagttaatgacattctccaacc

SEQ ID NO: 246039 - DNA, 480 bp, Homo sapiens
aacagtcttggcttagaacacatttttctcagattataggaatcaaaattatcttaaatttcaagggctatcagacctatgaagtccttcactagctatgtgacttgagcaagcaccatgattgttcactatcctatggaattagagaataaaataattgtatagcttaattagaaattagagttaaaatgagcttacagaccaagttaaaaatacagatataggatgaattaatttatattctgtgtttatgtgtgcgagtgctggagcttgtcttttataaaaagtgatcatagttgggcgcattggctccatgcctgtaatcccagcagtttgagaggctgaggtgggaagattgcttgagcccaggagtttgagaccagccttggcaacacagggagactccatctctacgaaaaataaaaaaattagctgggtgtagtggtgcatgcacacctgtagtcccagctacttgggtgg

SEQ ID NO: 246040 - DNA, 1246 bp, Homo sapiens
cgagaggtgctacgggcgagcgcgagcccccgagggcggctggaagccccggactgttggtagagtggaaggggatagagatcggtggggcgagcgtcctccgtggccagtcctcccctcaccgcccttcctcaggtatcgggaagagttgccagcggccatcaggggcagagcagagaagcatgtgacagggagctggagcggctgctggcctggcagcttgactgtgaagggcggcccgccccgagggcagggcctccgtagcgcgggtcttcattggggcgtggcatcggcggggcgggtgtctccagtgggggcggggcctccctggtgggtccagcaccccaggcaccctgacctggcctcccacagaggggcgcttccggccacgtctgcagcagctggtggccaccaatccccctgagctggttgtgcactgttcgaccgccaccttctgcctcctgccagatgtgggggctgcagtcaccgagctgtgtgccctctgcggtgtgggcccaccacagcctcgggtgagttgggtgggcacgacttgggtacataggcgttcttgtctgtgaagcgggcagtctgggcccttgcgtgtcgctaggagcaggaaccatagggccctgggctgctgggagcagggtctcccagagcttgtcctgatggggtgtgtctggctgcttctcctcgctgttcacagcagtcctggcagctggagctccagagatggaggccttcatgtcagatgaggcggtggccacagtgcccggctggccggccccacagtacaccctcaggtactacctgctgtacctgggccaggttcaagagcgggccacagctctgagccaaggggaatgaactgtgtgtgggcaggttggggtggcccgtgcccctgggcctgagtccgtgtgcccctccctagccagtgcctcaggacagtggactccctacctagtggagacagcactgtggacctgggctgtggggcagaggctgtgcccagacctgctgcccaaccttggccccagcctggccacccacgaggatgctaggccagccaagaagcatggaacccaggccgagtaaacttggccatggcccaggcctgctcacctgccacagaacctcaggcctccgggtctcactggacggcagggaggctgaagaggaggctggccactacgggagctcaataaacacttcccaaactcacgcctgatcacacacccggcctgac

SEQ ID NO: 246041 - DNA, 336 bp, Homo sapiens
catctaagaaatcaagaggtttcacatcaaaattagaatttctggcctctctcgatcagtcagaacgtatggcaattctcatctgcttttcagaaaaggacaatcaatcgaagctaaataggggttgctccttttggcaagacttgtactctctcacctggcctatttcatttatttgtattatctgcctggtccctgagacgtttgagtctgtcctcccccttacaggtttgggtttgaagatgagaactacaaagctgattatttcttatcattatgcctgcaattttacctagctaccactaggtggatagtaaatttatacttacgtttcca

SEQ ID NO: 246042 - DNA, 197 bp, Homo sapiens
gggaaaactaagtcactcgcccaataagggcattgatttctttctgagggcagatcccttatgacctagtcatagctgtcccacctcccaataccattccactgacaaatttcaacatgagcttttgtggggacacgcaagcatagcacacacatctacactatgagtcagtatttccactcttaagtgtaggtttt

SEQ ID NO: 246043 - DNA, 196 bp, Homo sapiens
tattagtagccttcattttcttatactatttttaaactagggcaataaatctttcataaatggtcacactaagcatttgaattggttaacttaatctgctatttatatatggttgcaaattgatatcacactaacaactatagctgtaaaaatgaaacatgaatgtagaagtccttaatggcaacagcttgagggt

SEQ ID NO: 246044 - DNA, 391 bp, Homo sapiens
agatgatatggcttcccaaaagactaatgctgtcttgagctgcattatgtactcctagatatttgtattttttaaaaacaacattgtaggtgaggctgttcattggcaaaaacatttagaaggcgatctggcaaaattatccaaaattttgtgagttataggtctttttggacatggaatccatcttttattactaagataaaatataatatctttatgctgattccctggtgcacgttactcagcccattgaaaaccttggcaaaatgtcagaccttaagactttccactatcccaaaactatgaactgtagttgcctagttttctcttttgcttatttataatgttattgatatgtttgtgctgtcaataaatgttttgtaaactgtca

SEQ ID NO: 246045 - DNA, 579 bp, Homo sapiens
ttaaagggagtattgacaggaagcgcttactagtttatctcatagaattagtggaagctttctctcagggatggaaacaacaggaccgccctgaagacttaaattgcaggaggtgccattaacatgtgccagtctcagcaagcccagggcctcgttcccctcccttggtcctacagagacaccatctgattggctcagcttggctccatgcctgtactttagccaatcagctgtggcaacacacacattgcttctaggtcctcattcctgcgggtagaactttctcagagaaagcagagtggcgacctggataggcccccactcgccagagtttcttcacccgtacctgcgggtaggtctttctcggagaaggcagagtggcgacctggataggcccccactcgccagagtttcttcactggtacctgcgggagtgcctactcaggacatgccccagaccacggcctcagctgccgccaccgaggctgtatccgtggtctggtgactagcgctgtctggtactgcccatgacctcttttctcctcccaaggatattttcccagaggcaggactgggagg

SEQ ID NO: 246046 - DNA, 505 bp, Homo sapiens
cgacttccactcacattccatcagctggtactcaggcacagagacacagccatctgcaagaagctgagagatataacctgcccgagtgcccagaagaaaggaacccagaatttggagaatacctagcaatctctgccaagggtcatgtttctgtaatcatttcttactatgcacagaataagagttgagttagtgttagcttcttcccttctctcattcctttctcactttttctcttgctatcatccattctactatataaataatatttctcatatcagatattaccattgatcacagaatgaaaactcttcaaatgatatcagaacagcaaaacagagatgagatgatttttataaaaaacaacctcttgccaagaagggatttaggtttacttatatttgttattttaattatgatcataattacctcttttctaagacatcattggctacagaatacttgacttgctaaactacaaaataaagaaatattcaaaacaata

SEQ ID NO: 246047 - DNA, 485 bp, Homo sapiens
gctcaatacagggaggatgtttgaggaagaacttcatatcctatatgtcagtgatgatatgcagtttgctttggtacacacaattgtaactgtttctctgttttggaatatgcctgatggtatttatgccaaaatgatttatagtcgactcctggttgaatctgaaagttgggacaaggaataagaagaaaggtgtatatcttattgtaatttatattgcttttgagatatgctctataacttactgcagcatatgcaacttctctgtaatgttcttagataaattatccaattattcacatttcaactacatgatggttgggtaatgaaaaatggcctgtaagtaagctttaatgaaggggaagggtttggggaaggcacaagaggaagttgcttttctataaaaatgttcctgtaaataacttagagaaggactttttatgttgctagttagtgtgtatattcaatgtaattcagggaattta

SEQ ID NO: 246048 - DNA, 298 bp, Homo sapiens
gactagaactagtttccttaatgttgtctctttgataagcttaagagatatttgtaaattttttactactttcattagaaacccatacggtttctaaaaattcagttaaatttttattgagttactgctatgtgcaaagcactatacttaccactgagcgtgtaaagttgaaactgactcattagtatgcgtgcaccacagagacactttgttcagctaatcataagcactcaatgaaaatatgattattgaagaaaaactgtttcttacccttaagggtttcaaaatctcaataatt

SEQ ID NO: 246049 - DNA, 1088 bp, Homo sapiens
tcacaagaaaatgagaattgcaattgctctggagaataggaaaattagcacatgcaaagaaaaccttaaaagaaaattggcctcttcatggaaactggggatgttttgtcctaaggtcagttatcaacagcaggatttttgtattgccattgcaagcatgtgatagaaatgtttgttattgttggagaagaaaaggctgagacccaattataccctgtactctttattcgaccaagacctcaaaagatgtcaaagaagccatttctccaaagacagcaacatctattgtgaggcactttcatattcagcagtctgtaagtttgtaggagaaaacataagtggttaatttaaaataattttgggctctaaaatggactttgttgccttttttggtgggggtggtgggaatcggattcagcccatttccaagggatagtttcttcatctcagacaactattttgtgatcctttttaaaagacattctgaaaactttaactcctgcccttcttccgtattacagttgtgttattccagaaatattgtctacttttttaatatattagattttcattcagatcttaaacatgcaaacatgtgataggttagctttttaagggagttatcagtaccactgtatctaaatgttaggtaaatgggtagatttctctttgaagttggtattttccttggcagacagcactgtatcatgctcttcaccaagctatgctctgtaatgctataatcaaggaggctactaacttgtgaacctacagtcaacacaccattgctgaaaacaaactttgattaagaacagatttgctagggggaaaaaagagtaaagtgatattttcaagcaaatataattaaaattgtttcattaaaatatatactgagtgtatattgctccacactgaaattttattttgcattaacttgttaagtaattcattttagcaatcctgcatcccattttactagtactacctctgaaatatactgtcaccttaaaaccacatcagactgtaatgtgaatttttgtagagtttttatttaaacttttatagaggcaataaatgatttccaacta

SEQ ID NO: 246050 - DNA, 344 bp, Homo sapiens
gccacccccagttgcaacagagactgggaaggtggagtatcagatggaaatcctattgtcaggacccaggctgagcatgctgcctccccacacgaaaccagacttctgttagcaagaaagatacaagatcgccggccactatggttattgacatgttgtgctgtcatcttccaaaaactgacgagggccaggtgcggtggcacacacctgtaatcccaacatcctggaggctgaggcaagaggatcacttgaggccaggactttgagactagcttgggcaacatagcgagacccccatctctacaaaaaataaaaataaaaattttaataaaaaaaatagccga

SEQ ID NO: 246051 - DNA, 370 bp, Homo sapiens
caagcttcagacagccacatgtgctctttgtcaagccttgggagggccaacaaatacactgagctgccaggaagatgtgaaaagaagcattagatgctggagttccagttgaatcctttggcagtgaacagccctgcaggctcatgcccgcacaaacttggttatgcatctccttccttttattcacagacacagagtgaagatacagctcctggtaatttcagcacaaggctctcaattcttaactggggcagcagggagctggcatccgcataagctggatatggcttacttgagtgaatggatcgcgtgcccggtattgacatcccagattctttagggttgtacctaaataaaaagatggaaaaaa

SEQ ID NO: 246052 - DNA, 402 bp, Homo sapiens
caattcattcttggattaaacttcagttctttagggaagccctttctggtgttcacagatataagttccactgtaataaacttcgtcatcctgaatttctcatcacctttgcaattgtttgtttaatggtcttccccctccatgctgtattctctaccaaaatgtaaataggttccatgagggtaggaaccttgtcttttaacccaaaagctaggatacaatgtttttcaaagggtaatcacatatctgttggaaaaaaaatacctaacacctatttagaatgtaaaaacactgagatacgaaagccaagacttgtacatacacataaaacccacaaagaaaagaggttacttcagaccttacagcttgggtagtccccatctcccataaccccaagaaaag

SEQ ID NO: 246053 - DNA, 1235 bp, Homo sapiens
atttttttatttctttttttggttcctcagagatccctattctgaacatatattcttacattacaaagaaactgggccatatgagagtacaaccaagagaaaaacattgtttgttattatattatgttatggaaatggaggttcaattagcatagagattataaactcctattcaaggctgacattatcttacattgaagtcagagcctctcccaatcttagtttatcaactcagttcttgataacctatttttagcttcagtatttacagatattgtcttaagcaacattcttgtttcttaagctcctgctttaattagccaataccaaaaaactcccacaaaaaaaaaaaaaaaacaagaaaatattgtatttgcagtggggcgttttaagcaagaaggggctttaagcacaacactcataagcttagtcatcaggattaagttaatttaaggcaaattcaaccttacagtcaacaaataagtgtatttcactttatattgtttgctatttaaaagtattaaaattccagcttctaaatgtagatatccatcccccaaacatatgcttctttaaaataggaagaacacaaactttaataagaactcacgtattcccttgcagagtcagaaacccaaacataacagcaattgggcaagtaggtaaatgaggaagtacaattcataacaaatggacagcaaaaccgataagtcaaattagacattttgactataaagcgaccaaacgcctctcctccaaaaccaaaagccaaaaccttttcaaatatacagcaactgaatcagacggtaattttggctttaaaaatctacaatactcttggtaatggtagaaatgatttatccggtaggttaaagataggtttctatcattccacttaacattatttaccaaatgctgcatttcattaatggagctgtcagtttattctgatggtaatgaaaaacaggttttaacatgaataagccctgggtccaccagaaaatatcagtgaatcaagaggtcccgaagcttatgcagtttaagggaacttcgtagattaaatttccaccttccagtcctgagagctgtggtgtgcacacccagtccgaataccttgttgagcatacaggacactaatttccgacactgcagctaactcctgcacaaactcttcaagttgcaggcttctactcaagtacccatccctagtccacatgccctagaaaaacacagga

SEQ ID NO: 246054 - DNA, 745 bp, Homo sapiens
gaaaaaaggaaagccggacaaaactgacacattacgtttaagtgaataatgaaatgagttccactgaattaccatcagaaactgtgggtctagaggatagaagagtaaaacttttagattaaaaaaaaagccagttaattaatccaaaaggaaggaagaaaaagagaggcagagaaacgaaaaacaggatgaacagaaaacaaatgataatatggtacacctaaacccaatcatattataattatgttacaattcaatggattaacactgcaatgaaaaggaagaaattgtcagaatggattataaacaacaggatccgaatatatacgctttaaatatacagtaacctatgtgctgaaattaaaagaatgagaaagttatactatgcaaaatataaccattaaagggaagaattggctatactgacatcataaaggtacatttcaagccaacaaaatattatagttaaaaatgacattttataatgagaaagggttccatttatcagaaagacataacaatcataaatatgcatacaactaataaaacagctttaaaacccatgaagcaaaaattgagaaaactcaaaggagaaacaaaaatctacaattatgtgagagattttaacactcctttctaaagcaattgatagaaaaactaaacacaatcattaaagacataaaagatctgaatactatcaagtgcaatgacataactaatattgatatttaaggagcactctgcc

SEQ ID NO: 246055 - DNA, 427 bp, Homo sapiens
ccaaaacatcttactaaatctaatcaggcctctggatctacaaaaacatagggaaggtgggaacatgtcaggccacacatagaaatgcaattgccaaaaatccagactgtggaaaattgcaaaggacaaacaatatggctttatcaacaaaagaaactgcaatgaaaaagaaattgagggagaaagatagaaattaagagacttaggaactgtactgtcccatgtcccagcatgcaagggcactgactcaacaaacctgccccaaacaaaccagtgataaaaacagagacaatgcaggacatttgaacactgactagatatttgatattttgacttttttatttattttgagatggagtttcactcttgttgcccaggctggagtgcaatggcatgatctgggctcactgtaacgtccatctcctgg

SEQ ID NO: 246056 - DNA, 346 bp, Homo sapiens
gtgagggtctcaacagtctttcaggctgtcatttgaatataagctctgccactcatcaactgtgtcctcttaggtaagttactcatcctctctggaactcattgggtaaatggagaaaataatacctaccacacaagattttgcaaatattcatttagataatatataaataatttactatatacttaataatgtgtagctatatacaaattatataaatgcacatgtaatctgtatatgtgtgtgtatatatatatgtactctgtattatatgtagtttttatacagagactgtataaatgtaagcttctcttatccctatctttgatagcattttcagattctt

SEQ ID NO: 246057 - DNA, 511 bp, Homo sapiens
tgttggaatattacatatatgtatttcctgtctcaccccctataatgttttttcttgttactgttattgaagttttcagaggtaacagctaaggtttccagatgagaagtataaagagtctttcatatcagactgaaagagaatgaaagaacagccttggaaaagtaaaattactagtgtctcctcccttaagaaccataagaagtttgaagtgaaaagacttaaagattatctagtgtgggttccaattttactacaagtaaaattaagctgagaaaggaggattgacttgcctaagagggcacaagtattttatagagaaatagattaaaattcaaataattgtatagttaaaaaaaagaaataggactcttttcataatttgaagtttgaattaagctgttttacagtaaatatttttattttctgagctttcaaaaatgtataaatgttattcttattattaatgtcctcgaaagtagaagagcccaagtaatattagtcatagttt

SEQ ID NO: 246058 - DNA, 336 bp, Homo sapiens
gtcccatccatgtacctgccatccaggttaatagaaattacgaatacccctgaaggcccatatatacccctccctcccgatacaaccactatgctgaattttgtggtaatatttccttgcatttatttattgcttttttttttttttttgagatggagtctcgctctgttgcccagtctggagtgcagtggcgcgatctcggctcactgcaacctccacctcccaggttcatgccattctcctgcctcagcctcccgagtaactgggactataggcgcccgccaccacgcccggctaattttttggatttttagtagacggggtttcaccgtgtta

SEQ ID NO: 246059 - DNA, 607 bp, Homo sapiens
agtaacacacattcctttatcctacatgttcagactagtgttaaaagtgacttcagatatttcctatgctcatgttttttaaaaaaaagtccaaccattctcctcaatgaacatgacattaaatcaagctaagtccagtcacatggtctcaactttactcactaaagctagcaggcaagggcctagtgagttgaattagaggtttaattagaagaacaagcaataaatgctaaatgttctgttgcaactgtgtaactttctgtgggattttatgccttgtatcttttttcctgaattccagaccaacggggctgcactagaaccccagaagcagagaattccataactcagactctttgattcagatatttttcttttcatcaccttgagagagcaaataaatcccccaaactacttttcccacctctcaagcttctagaggatattcttgactggaatttgtccatgttcttaaataacaggttacttcacgttctttgtgtttaaataaatgtaattaggcctgtttttaaaaactatggaaaatattaaaaagaaaattaaaatcatctataaacttaccacttagtggcagccacatgaacat

SEQ ID NO: 246060 - DNA, 409 bp, Homo sapiens
gggtgtacaggttaagagcacaggctgagacctgagtccaaatcttggctcacactagcttgatgaccttcagcgagttactcaaccactcatctgcaaaatcggaatgatagtaagagcttacttaaacagtgtctggcacacactaagtcttttataagtgttggctatcattttttctcatctatttccttgcttctggttttgcacactttaccatccacactgccatcagagtgatcacacctctcttcagtagctcccatcatctactgcataaagctgagactgttagctagactgttaggcacctttcccacacgatctggctctgccccacttcccagcctcagcccacatggctaaacaacctgaagttctccaagattcctgcattctcaccctcata

SEQ ID NO: 246061 - DNA, 296 bp, Homo sapiens
tccttctccctctccctctccctctccctctctccccagcccatttaagcttgtagtcagatgtaggactgcgctgtctgaggaactggcccccagcagcaggtggctctggagcccttgacatgtggcctgtgcaagttgagatgtgccttagaggaaagcatgccagagtttgaaggtttagaatgagagaaaaaaaaaccaacaacgacataacctatctcattgataatgtatatattgattacttgtgacataaaacatttgttcaaataaaatgtattattaagattagt

SEQ ID NO: 246062 - DNA, 860 bp, Homo sapiens
tgtttaggaagagcttcgggttttattgtttgttttttccccctcatctctatttcctttttacaatttctggaaattcatgtctaagaattcttcggaccagtctttacacaggtgcaaataagaaagtgcctatccaggtggaccctggatttatgtttattaagactgtatcttttgacaattttgtttttacatttaaaatacatcatgacatgaactttccaacacctgacccggaatttggttcaacagataaaatttaactctcacgtgactccaattactcatcttctattccgtttaaatgagaaaatgctattctaataatggaattttttttttcagtctgtggttagggaaaaaagggattagtcaaaagagaatctgttgagattactccactgaaatttcgtaattaaaaaactatataatcatatttcatgtaggggatcagatattttacctaaaaactgcctagacacttaagacttactaaaaaaaaaaaaagttaaatgttgatcactttaacgtatttgttttaaacagatttcaaagatgttaactgcattataatttatgacagcaaaaaagtgcctaaatatccaataaaggaatggttatataaatgacatatccacatgaaagatcacatagctgttaaaaatcatgtcatgtaagaatattctgatttaaaaaataagaaaatacccagagtataactttaggttaaaatcaaacaaaaactctacaaaaactctaaaaaatcatcccaaaagggaacaacaaaggaaaaaaacttaaatgctttgttaacagtgtttatctctgggtagtgatatgatgtgattacacttttc

SEQ ID NO: 246063 - DNA, 659 bp, Homo sapiens
tcttatcattgacttgttatgttcatgaaggacttggaaaaccaacgctgatcctcagagtaacagcatagatcctcacaagacagtctatgaagctggagccccctgggttgtaaaatgcctccgcaccccgtctctgtttctgaagaaggaagctctgctgagcagctaaacatgacgtgcttgttaagtgtgcattggttaaagaacagatgaaggtacaggctcagtctccaaaacttcattatacaatctcacagatgagtagcaccgttcagcattgagtgacacctactttcccatctccaggtggttagatatcatcatctccaatttaaggcccatctaagaggtgcaccttttctcgatcctgaggctcaagtgtctaaacagcaactgtaaattttctccaatcagtgtttctcccctgtgtggaaataaattcgcatccttgaagttcagctctctccttcattttacaaaaaaaccaaaaaccaaaaaacttgttttaagcaagattaaaagtgaattttctattagcagtaattttatatcactccctgtcttgcttcttttgcactcactgaattgaagagaacgatatgaaattgcctggaaataaaaatgaaagtgcttctcagagccaacaatcacatcat

SEQ ID NO: 246064 - DNA, 396 bp, Homo sapiens
aactgtggaccacccacgccactctgacgtggtgaaacaaaccatggaccacccatgccactctgacgtggtgaaacaaaccgtggaccacccatgccatggacactactcagcaataaaaaggagctgaccactgatgtgtgcaataacttggacgaagctccaaggcattacatccagggaggaaaacatctccgaaggtctacactgcatgaactgtacgatgtgtccacttatgtcacaaaatgacagcattatagagtggtggtggggttcggatgactaaaaaggggtagatggagagagatttttgtggtgatggaactgttctgtattttgtgaccgtggttacgtgaatgtcctcatgtgataaaatgacagaatgaagaaaacact

SEQ ID NO: 246065 - DNA, 356 bp, Homo sapiens
aggaaagaagcctggttcaagtttggctaaagagcattttgttccaattgatcagtggagacaagcagttaggcttgtcatctatgaggcaaagaatgggaatttggagagtgggtgtctggccttctcataggtaaacaggggacatccgtgacttctaagtcatatggggaaggatggttctttgcagtaagccattttccagaaaagccattttccctttggagtaaggggatttcttgacctgcactgctcaccaggatgaggtaaaattcagtattgccagttggcaccatttatgaaacacaccaccttgtaaccactgaattaaatattgcttctgtcatataagttca

SEQ ID NO: 246066 - DNA, 373 bp, Homo sapiens
acaatttttacgtatgtgtataaccatgtacccatcattctgataaagatgtggaacatttctggcatcccagagggttcccttttatcctctcccagtaaatgcccccccgcctccgccccacctctccaaggtaaccgaaccactatttgactgtaagttagttttggctattcttatacacggaatcatgtaaaatgtaccctttcgcgtctggcttccttggctctgctttactcatccatgttctgtgtagtagtagttcattctttgctgaatagaattctgttatatgaatgtactactattcatcttctttatttttgatggatgtttcagtttggggccaatatgaataaatctgctatgaaca

SEQ ID NO: 246067 - DNA, 390 bp, Homo sapiens
gcaccgtcgacattgaatcctcacaaacctgcggggtcagtactgctctcatccccgctttactaaagtggaaaatgaggctcagaaaagttaggaacttaataaaggagatccagctcctgagaggcagggtagtaagtcctactgcatgttactatatcttcttaaagttctacaggtgaggctgggcacggtggctcacgcctgtaatcccagcactttgtgaggccaaggcgggcagattacgaggtcagcagttcgagaccagcctggccaacatagtgaaaccccgtctctactaaaaatacaaaaattggctggtgtggtggcgcacacctgtagtcccagctgctcctgaggctgaggcaggagtattgcttaaaaaaaaaa

SEQ ID NO: 246068 - DNA, 493 bp, Homo sapiens
tggtgaattcaagttttcatcattgtgtagtgactctcctcatagcatagtaattttttgtctcaaagttgatggactctcatgttcatatagctgactcaaccctttgcagatgttgttttgccatgtattgttttctataactttctttgaaacttttttcgttcttatattttaggggtatcacttatgaatatcatatagatttatttttgttttattctgtcaatcttgtcttttaatgagtgagttcagtctactttcaggaattatgattacagatgctcctcaatttacgatggagtcatgtccgaataaacccattactagttggaaatatagaaagttaaaaatgcatttaatatacttaatctattgaacatcatagtttaacctagtctaacttaaatatgatcggaacacttacatagcccctagttaggaaaagtcatctaacacaaagtttatcttataataaagtgttgaatatctc

SEQ ID NO: 246069 - DNA, 981 bp, Homo sapiens
tatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaatttta

SEQ ID NO: 246070 - DNA, 1581 bp, Homo sapiens
tatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaattttaaagtttggtaaatttgtttttattcctagtatctgttaaccctcaagagtggatttcttaaatcttccctttataattttactagtttctgaaacaaaaattgaaatacaattagcaatagagtggcacatttttccattacctaacatttcatcaattttgacattctatattttaatacaagctgactcaatataagcctaattccttttttaagagtcctgtctttgagtttagaaggaataagtattgtgcagatagacccatttatccttgtgtattatgtttcttaacttggtatcattgtaagtatgaaagttaattttcttctgaatatttccttaaacaaattgaatgaatacaatttgaattttctaacttcttgactgagagatttaaattttggaattttgatttgttaaggtaattatcactcaattacatgtcacagtgatgaaaatagaaaactgtaagccacagaaataatttaagtctatgttttacctatatgaaggaacagtctgtgattcaccaggaaatagtagagacacagtttccaagtactggtgggctcttctgccttgtagaagtgtatgttag

SEQ ID NO: 246071 - DNA, 922 bp, Homo sapiens
  misc_feature (744)..(744): n is a, c, g, or t
  misc_feature (766)..(766): n is a, c, g, or t
  misc_feature (774)..(774): n is a, c, g, or t
  misc_feature (776)..(776): n is a, c, g, or t
tatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaccattagtctttatctaagacaaaatagctctatnttcgggttactagggagtttgntgaggtgngncaaagtagtgtttaaaaacattaagtaaaggggggtgtggggttatacaatagtattaggcgaatcagtgtgatttttttaaaaaaaaatggcgcgttactgggggagtgtttgtgttggagggatttattatcaatagtttaatg

SEQ ID NO: 246072 - DNA, 897 bp, Homo sapiens
tatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaagtaagttttaagtgaaacgtattttccaggttttcctgatgctacacatgtaatacatttttctaaaaccaaatgacttgcaagacttttttgtaaacttaactgcttcttgtaatggaccttctgtctaaataattcacatattcaatttagaatgaagcagatctctaaaaccaattatacttcaagaaggtccttcacttttctctgaaggtgaaaccaccaaaatttcagcctttcaatataatttcagtctttaatggcttctccctcaacctacatgctaagttctaagttctattgattttccc

SEQ ID NO: 246073 - DNA, 741 bp, Homo sapiens
tatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttggtgtgtattttaatagtctttgtaatcagcagctgttaggaaattgtctgattaatatcactttttaaattttaaattctctaggttatggaattttcttatagaacactggtgtataatgtgactcttactcagttttgttttgttggttttttttttcaaagaaaaaatatggcttggctctgagatttatagtttggtctttggtttggttgtgaagattctaaccaaggaactattgtgtagctttttatagaaagatgcttctccaagttgttgtatttatattatgtgataaaacttgaagggtgatcaaaaaattattttgccttaataaaaccagaaaa

SEQ ID NO: 246074 - DNA, 987 bp, Homo sapiens
tatgttgtgggaggtccctgaggccgctgaggtcgttcgtgtctgttgaacggctgtgggcgtcttgctgccttgggtagggggttaaaatcgttcttgagaggaacgtctctgtgcgaagagataatgagtttagctctgagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtggcaatgagagccttggggtttgatgtaaaaaaagctgatgtactgaagattcttaaagattatgacagagaagccacagggaaaatcacctttgaagattttaatgaagttgtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaataaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggtaccatttattattggggacatattgagtgattaaagttcaatgcgaagttccttatgatgagactttcttactaattaaaccatcacgtatt

SEQ ID NO: 246075 - DNA, 1055 bp, Homo sapiens
ataaattggagattcttactatatttataattttggcaaactaaaaattagtccttatccatgattattttctgcctttacatctatatagttactggattactttggtgattaagattacatctgtaatcttttcaaattgccatttttattgatacctttgaggtatggtgacctggttttaattattctttaacataggcttttaagtatataaaagttcaaatctaatttacatgcatgatatgttcaagcttacttgtaaaggaaggatttgctaaatgaactagtagaataaagattataaagagggttgtttaaagaaccttgaaatgtcaagcatttaaaatgttttagcaagtatgtacaaatatgactgtgattgacttttttggtaacattatcttttccccagttaatattatagaatactaatttgtaatgtttatcacattatatgtatttttgcatccaagaagttacatttaataaacatgttccacttcctaacaaagaagtaaaagcaaaaagccatgtcttaatgtaataattttgcataatgtaaaattttttaaatacttagtgtaaaatggtagtcgtggattctgaaaaaataaaatgtttatatttctgactatttcattttctttcttaccacagtaaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaatttta

SEQ ID NO: 246076 - DNA, 399 bp, Homo sapiens
ataaattggagattcttactatatttataattttggcaaactaaaaattagtccttatccatgattattttctgcctttacatctatatagttactggattactttggtgattaagattacatctgtaatcttttcaaattgccatttttattgatacctttgaggtatggtgacctggttttaattattctttaacataggcttttaagtatataaaagttcaaaaaataataatttaacttctttttataattttattatattttcattctttagaaatctaatttacatgcatgatatgttcaagcttacttgtaaaggaaggatttgctaaatgaactagtagaataaagattataaagagggttgtttaaagaaccttgaaatgtcaagcattt

SEQ ID NO: 246077 - DNA, 171 bp, Homo sapiens
gaaattaatctgtaacctaaaacccttgtatctgccctgaaaatatgtctttctaatggaaaatttgacagagtgttccatctgcaaagagcattttatatgaaatggatatctgtgtaactcaactgctgctatctggttaaatagcaattaaacacctcaagactcctt

SEQ ID NO: 246078 - DNA, 489 bp, Homo sapiens
tgaaacgtcatgccaaagtttattaggaataaaaagttataactattatatataagtaggaatgctgtataatctataaaaaaatgaggttgtcatgaggattcagacaagacaatgggtgtctgaaaagtgtcttgaaaactggaattattcaattagaataaagttatatataacagttgggataattttctggatgaagatatgtgaaaatcaactttacgaagtgattacagtaagtactgtgtgagcatttcatatgacctgcaaagagaagaaggaaaccatgtgctttgcaggaggtaaaatgctcagctgactgagatgctggaaggtcttatggggtcatatgaatgggcaggaaaatagaagatgacctttgatgcagacaaagccattatgtgtttagggaaaagtagcccaaacaacatagaaagtggttgcctctgacccagagtgtataaaccagagaagaattttggtcttcgc

SEQ ID NO: 246079 - DNA, 482 bp, Homo sapiens
acatttgtgcatctttattattattggtgtcatgtgcaaatcctgatagtagttaacatttattctttttaatggcttaaaatttttaactgacaaataaaaattgtatatatttatgaagtacaacatgctgttttgatacacacacacacgtagatcatccttcattgaagcttacaatagagatgcgtgtactctgaccttccgattagtttttagtcctccactcttaatcgtgaacaaaaggattaccagacataagaggaaagtctctaaagtggaagatattgatcaacacaaattaacaggaaaaacttggagttagcaaaatatgaagaaggaagaaaactaagaaatttttttgaaaatcctcagaaattacaaggttattaacaatcgtgttctcttctattgtacacactgaaggcttttgtttactacagcatcacaccaactctcaagatgccctacgctttatttaa

SEQ ID NO: 246080 - DNA, 523 bp, Homo sapiens
aaatatagacatatagagggagaaggtctgctgacatatttatgactagttgaatcttaagcacgtatgaattgcttactcacaaatgagtaccataacatttgctgaccgggattggcaagataccttaccaaatgactatgttagtaaatacagtcatgcattacttaacgaaggggatacattctgagaaatgtccttaggtgatttcgtcacggtgcaaacattatggtgtacaattacacacacagtacagactgctacaaacctaggctacatagagtatggcatactgctcccaagctacaaacctgtacagcatgttacagtactgaatactgtaggcaactgtaatacaatggcaagtatttgtgaatctaagcacttatcatgaatggagcttgtaaaactggaagttgctctgggtgagtcagtgagtgagtggtgggtattgtacactactgtagactttataaacactgtacacttaaactacactaaatttatttaaaaattcttcaat

SEQ ID NO: 246081 - DNA, 313 bp, Homo sapiens
gcggggctgggagggatgacctggtctgtcctctgagccaggcactgcacttggaacgggcttcttgaacgcaaagcccagaccaagtgtggcagaaacatgaaaggacaggcaggcggctgctgtgggcaggagcaggacgcccaggcctgtccccacccccgtgacccagagcctccctgggcagtgactccgggatgtccaggagcttcttctctacctcacaggactggaggggctgtggtgagacgcatcctgtgagggctgggctggccacaggcagctccccagggtgcccaccgccatctgctcc

SEQ ID NO: 246082 - DNA, 295 bp, Homo sapiens
cctcccatccagctcggcagcctggtgacgcaggaggccccggctcaggacagcctgggcagctggatcaactcttcccctgacagcagtgagaacctgtcggagatccccttgtcccacaaagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccac

SEQ ID NO: 246083 - DNA, 117 bp, Homo sapiens
gtggtggtggtgggtgataagcaatggtcaggtcacagttaccataacccattgacttgggggttttgcagggtctgaagtgccatcatacccacttctttccatctgggaccagta

SEQ ID NO: 246084 - DNA, 367 bp, Homo sapiens
attctctctggttagttataaagaggaaagtagagagatgtgctctagcaagcctggaagaaagcaagcatcatgtgaattgcctagtggaaccacatggcaagaaactgggtagcctctgggaactgagtaattctcggccaaaaactagcaggaagatagggacatcagtcctatagcttcaaggaaatgaattctgccaataatcagtaagcttagaagaggatccccaacgacagatgagaactgcagccttgaccaacatcttgatttcagctcagtgagactctaatccaagaatccagccacaccaagcatagacttctggtttacagaaactgaaagacaataaatatgtcttgtttta

SEQ ID NO: 246085 - DNA, 485 bp, Homo sapiens
atctccattttacagaagagattatagaaaaagtagtaactttctcaaggtcacacagctagtaagtagtgagtctggatttgaaccaagttgtctctgaagattataggtcctgtgtggtccatgaaggacgcagagccttccaacacccacagttaaatagctacacatttgttgagcctctctagatgccagccctccacgaggtcctgtttaggattcagagatgaacatgacactatggaagtcatcaaagtgcttccaatctattggaagtaaataaaaactataaaagacagactggaagctgtgctgtcaagaaattcaagcaaagtcctctgcaaattcaagattggcacctctatccactggagtatacgttgtttctttgtagcagcactacaaattggggaaaaaaaccactttggcaatctactcataaatcctattcttcccatatccaggaacctcttgggttctaagta

SEQ ID NO: 246086 - DNA, 479 bp, Homo sapiens
gtaggctcacagttctggaagctgtgaagtccaatattaaggtacagacaggtttggcaattctgatttcaagatggtgccttaattgctgtgtcctctgaaggagagaaaagcttcattcccacgtagtggaaggcagaaaggcaaagaagcaataggaggtcaagcttgccccttttgtaatggcattaaacccacccaagcaggcaaaaccctcatggcttattgtttcctaaagagcccacctcttaatgctggtataatggcaattaaatttcaacaagagttttggaagggacagcaccccacacaaggcagaatgtaagtacatgcaaactgtatgcacacacctctttatctctggtcataagaggtaggagaggtcattcctcaccactgcctcccctacctcctgtagaaccatgatatcccacaaattcaacatggatatatttagttataaaatttacaatccatgg

SEQ ID NO: 246087 - DNA, 405 bp, Homo sapiens
tcttctgtgattcagtaagctgattttcttttagaggtggtgataggttctgagataaattaacataatcacaaatcaaacgatttttccatccctaaaagtacctcccctttgaaaaaatcacgatcattaccaattaaaaggatgcaataaaaacatgtgagagagaaatcttaggacattacattcaccatcattgtgatctggtcattgatacaaatttttcctgctgtgtttagtgattactacatagatgaccatgttgggtaataattgaatttatcggtgtctgtgttgtaaaactgaatagctaatatagcttaatgaaggaagtaaacttatcaaaccattgtcgtattgtttttctcttctgtatatcattttcctctaaataaaagatttaca

SEQ ID NO: 246088 - DNA, 330 bp, Homo sapiens
cagagcccaggaaacaaggacgcctgcacaggcccccgagcacaaggactccttcctcctctgctggcagcatccggtggttaagtgacccctgcccgctaggccagtgacccggaggtcagcacgggctggcatcagtggggacagtgaagctgttgctgccgcctggccagtcaggcctcctgcaggtctcatggccgctccacagtaggggtcagaacccgggagctgtcgccagccaccccccaccccgcccttgcggggacctggctgtggccgcggagctcccttttctagccctggtcggtttcagtgtggtaggagttatta

SEQ ID NO: 246089 - DNA, 399 bp, Homo sapiens
cacaaatcaaatttcctactattcagtttcttagtaacaaaaatgaaacaaaatttagctatcccaagcaaatttaggaacataaaacaataaccaaacagacggggtaaaaagtaactataagaacccccaggctgggcacagcagcctgtgcctgtagtccaattgtttggcaggccgaggcaggaggatcccttgaacccaggagttcgaggccatcctgggcagtctagcgagactatgtctcaaaaccaaaccaaacaaaatacacaacaacaacaaaaaagtttttgaagaaccctcagaaacataaattaggaccctaagctaagtagactttagtgcaacagctctgcaatttacaaggcaaaaattacaaccctgaaaagcaggatgaca

SEQ ID NO: 246090 - DNA, 402 bp, Homo sapiens
taatttccaaggactagaatcccagcttggttggagttcagagcctgagagcagaattttctccaggacaaggcagaaggaacttgcgggaagcttcccctatcacccctgctccccacacctgtagagattaaatgaagatatctgtttcttaagcacctgtacccccaccacagcctctggaatgtgataggcatgtatttgatgaatgaatgaatgaatgaatgaatttcactcagctgactctctctaaattccagcttccagtctgcctcttctgttgcacagaaagctttgagaacccaggctaggtttaccagttgtttcttctgagtctaacacaaaagacatgcttattaatagctgtggaattgatttgaattacatgcaaactccctcaga

SEQ ID NO: 246091 - DNA, 625 bp, Homo sapiens
aggtattgtgttttcagttcttaaatttccatttttaataagattcttcatttgttcattcatatacatctttttaaaaaatcaataaatatctttataatagctgtattggaataattatttgctaatttaaaactctttggatctgtttctattaaccacttcctctccccaggctatgtttatattttcctgattctttccaattattttcctagttactgactgtatgctagacattttccaatagttttctcaattattgatcatatgctagacatttagaaaagtacattattgagagtcagcattctgctatttttcaggggtcagatctcattttttttagtagacagttcaattactggaagatcagcctaatttttttgagactggtttttatgatttgttaggttgagtctactacagtctttaatctagggctagagtggacttaatcctaatgtgcatctttttggtttctttattaaatgtaagggacagcctgtgagctttctccattcttattggtcagaatttctatgtctcccagcattgtgtggcttctcaaatcacatttattttacatctcccctcgtgccgctcgtgccgaattaggcacgag

SEQ ID NO: 246092 - DNA, 322 bp, Homo sapiens
tcacggcagcagcaaataaacaaacaccttattggatggcattatcaacattttaccaataaggaagcagaggcatagccatttccccaagctacacagcaattaagtagcagtagagcccagtaaagttcagatttcccaattttaggtttttctacattgtcacagaaatgttttgagttgctatgaaaaatgcttgaagctaggctgggcgcggtggctcatgcctgtaatcccggcactttgggaggccgaggtgggctgatcacgaggtcaggaggtcgagaccagcttgaccaacatggtgaaaccgtgtctctac

SEQ ID NO: 246093 - DNA, 480 bp, Homo sapiens
ccagtgtttaaaataaatcaactgtggttaagacatgggggtcctagcacacagcaaaccaaccatgttctgtaatcacaggtgattgaggtagcctgcaatttgtaaggggtactcgggatttctaagttgaaccacttgtcaagaatggaaaaaaaaaaaaaagaactttaacagacagatgatcaactttatcccgatcaatcacccagagtcttctggtggtactgttgcattaacaatactttaatgtactaaggagtcttcacagagacatgtttagtgattattacagacacactggaagaaaatcattaatcctatcagaatgttcaaaggtccttcacagttacagaggaatatctctccttacccagaatcattgacaatttcagaactagtccagataaataaacatgaacaactaaagcaaagtacaagagatatgaattctcaagaatgctgacgcattccatggtt

SEQ ID NO: 246094 - DNA, 464 bp, Homo sapiens
tgagtcgacaagaaaaatcaccaatgtggaaagaatgtttgagaaactcagaaaaaggaacagactaggaatgaattcaaggattgcccaagccacatggcccaagccaccaccagattgcccaattgcctttaaaaaccaatagaaagacatgaaggtagggagggcaggaggcgattttagagggagccattaggctgatttaaaggggtggagtggacagagaaagatgcagatcatctttaatgaggatccagaaccacctggcaagagcctcaaaggagaaggaaaggagggcccaagtttagagaagtccgtgtcctacttctgtatcccaccattgtgcacagttacctttcctaaggagcccaagtatagaatcagagaagccagaatgagagcttggtccaaaaatggagacatgagggcttgatccagatttgtatggacctaccattgattct

SEQ ID NO: 246095 - DNA, 355 bp, Homo sapiens
tactactactaaattcgcggccgcgtcgacgccattcccagctgtccccgtggatgcgttatatatttagctgatctcttggaagcgagacgcagcttcgaaacaggtgagcagatttcttaggaaaggcacatgagacatgaaacttaatggacaggtgttctgattttaaaaagagggcaggctctcactcttgtatttggcttttaaaaaattctcacgtcggccgggcacggtggctcatgcctataatcctagcgcactgggaggctgaggggggtggatcaattgtgcctaggggtttgagaccagcctaagaaacatggcaaaacctcaactctaccaaaaaaaaaaa

SEQ ID NO: 246096 - DNA, 731 bp, Homo sapiens
agatacatctgctgtttggaatgagctgttttctgtttttgtttttgtttctgtttggaatgagctggtttaaaaacagcatttggggtgatccatgataccctgtccctttgctgacaagctgacacttccttttttgggtctgtagagtgcagttagggcccagagttctttcgagcaaatacttttgcaccacttgtttcagggcaggaaatcactctgtctggcacagctgtccgcatgttttattccagcaaagaagttttcactgtcaaactgcttttcacttgggggggagaaacatgagtctaaagtttccatcgaagcctctgctgggctccatcacatgagcaggtgggactgtggctggggaagggtgtgataacagctttgattttatgcaacagccattcccagctgtccccgtggatgcgttatatatttagctgatctcttggaagcgagacgcagcttcgaaacaggtgagcagatttcttaggaaaggcacatgagacatgaaacttaatggacaggtgttctgattttaaaaagagggcaggctctcactcttgtatttggcttttaaaaaattctcacgtcggccgggcacggtggctcatgcctataatcctagcgcactgggaggctgaggggggtggatcaattgtgcctaggggtttgagaccagcctaagaaacatggcaaaacctcaactctaccaaaaaaaaaaa

SEQ ID NO: 246097 - DNA, 997 bp, Homo sapiens
ggcccagcccggtggctcacgcctgtaatgccaacacttgggaggctgaggagggcagatcacaaggtctcgaactcctgacctcgtgatctgcccgcctcggccttccaaaatgctagaattacagacgtgagccactgcgcccagccaagtttgactagtttttaaaagtattgtatgacgagatgccaaaatatatgagacactcactgtaatctgcaagaaaaaagccatcaaccccatataaaaaacaaaaagcaaaaaacaacagtgagatttccactactaacattgctctgtattcactgaatcagggcaaatttcttcccattggtcccttttgaatgtggtggaattcattttagattgtaaaccaaataggagaaagaaatgaattaggtgtgttagcctgtaatataaaattgctttttgtttaccaagtttggtttgagtgttctgaaagctgattaatgaattagagcaaaatgttaacttctcttgttaatggaaagaaacttgatgagtcattttccctggttaactgggactaggagcgatggagaagatcagagattgtggtaaatgtgtgtgtgtgactcattcctccgggaattcaagcccagactttggacttacacagtcaatagatctattaacagtgcctcaattctatctctgatgaacaaagtcagagatgacagcttctcttgttaacaaattaggcccttggaaaatactcagcgggtgaactttctttagtatttgaatcactgcaataggttcaaagtacatctagtatattacagttgatgaatagagataaataataggactttttttccctgattaaaaaaccctgagtgcaaagtgaaaaagactcacgttccaacagtaagtctaaaggaagaagggctttattgttgtttacctttgattatttctttttaaaaataaataatgctacattattttttatgatttaaaaataaatcatgct

SEQ ID NO: 246098 - DNA, 441 bp, Homo sapiens
gataaataggctggctgactgtgagtgatgctgacgggcaaaggacagagacaccaggaaggagaacaggacacgaaagataactgtctcagcccttggggagtttctgacccaggaggatgggaacatcaattatcaatagttacagatcattaaataattgcaagtgtgaggcgcactataaagaggaggctcagagtccccgcatgctcacactcacacctggccacagacaggtgacacccctggcttgcccaggccagcgggtctgcaatgaggccaaggacctgggctcttgagaagttttaagtttgaaaacattgctttttaagcttaaaacaatgaaccttaataaaagtaaacacttccattgagctttgaaacacttaataggagttaaaagtaattaggctaataaaatagtcttttgttccaattcaa

SEQ ID NO: 246099 - DNA, 336 bp, Homo sapiens
gggaaaaatgacaaccctctgtattttcatttttcaatttattgtctacataggttttattattttggggacatgtatatacaaaatgaattttcatgctttgctcaattttctttccatgtattttagtatgtgttttaatttctgtggtttttatttctttcatatgccctgatgtcttttatttcaggttatacattttttaattgtaagacaaatctttcatttataccttctgatttttgttgtgcctttgtttgtttcatcttgatttggaaggccttgcatgattatgaagtactaagtttcatttaggaataaagttttgttgtttaa

SEQ ID NO: 246100 - DNA, 416 bp, Homo sapiens
gttgaaatgttgaagtaggattgccattatggaataagtatcttgcaagtttaacaaataagagggacagtcttggtcagttaaaatattttagacttagtgtcttcgttttgaaagtatcaagatcattttcccttaccctcttaagcttaaacttgtttcttgcctgggattcctgatttaaagttaggaattaaaagaatccagttttcttgttttttcatgaggatataagaatagttaactgattgtcccattaaaaattctgaataggtattttttcgtagtcacagagttcacaaaagatagtcagatttttcatgtgcagtctggaacttatttgtaagctttttctaatgataagattatttcccaattttttttttttttttttttgagacagagtctggctctgt

SEQ ID NO: 246101 - DNA, 787 bp, Homo sapiens
aatacagaaaaaaagagcaagacataaaaggggaatgtaaggcctggatttggtttagcaagatgtctattaaaatagaaaggactcagttcataagaggtcgggcctctggacctgaaaaaaatccatcctaaattcaatactggataacaggaaggcaaggtgaaaaagaggaagggaaaatattagcaaggttgaaatacacagaattgaaaatggcttaagacacttctgcattggatgtcacccatttaaacaatggacaaatgcagtgtgagagaagcaactcccaggaaacattctgcgtatgtggtggacgttccctctggcatatcagaatcacatccagcgaaccttgatccatttctcccaattttcttctaagttgtgggttgaattctgacctgaaaaacgtcagctggcaatgacactagaactgtgtcaaaagaatataatagaggataatattatcagactctgcactcaccagcctattcccaactcacagaaaagcactggtcagaaaaactagaacatttaaggcacagaggccaaggcagcaggatttcttcacaaaacaaaggaaaatgaggctgcaaccaaagtaggttatcgggcggctcattggttagtgaagcaaggaaagctgtgcatcaacggtgagttaatcaacagcagcaaccaaagaggcgtgtccagagaatacacacttgtttctcacaattagccttttggggagaacacttgctagaggagttaaggacactgggagcaccctcaacagtct

SEQ ID NO: 246102 - DNA, 307 bp, Homo sapiens
aagagcgaaactccatctcaaaaaaaaaaaagcaaggaaaaatggcatcatgaatgccatatcatatctctaataatgtatcccagtgtaaaagaaatcaacagttaccagaaaaggaattcaaaataatgatattacggaaactcagtgtgacaaaagaaaatacatgtagacaattcaacagtctcataaaaacaatacgagacttagataagaaattcacaaaggggtataaatcataataaaaaaataaaaaccacacagaaatcctgcagcttaattactcaatgaatgaaataaaaaataa

SEQ ID NO: 246103 - DNA, 456 bp, Homo sapiens
cttcgtcaaaccacacttgcccatattggcacatagcttgatgctacagccacacctcctctgtttattatctacttagtgcttggtaatatactgtgtactatgagtaccctctctgggaaccccacaataaccctttgatgtggtttcaaacccattttacagatgaggggctattacagaacttgcaccaggtcctcagaaaccaagtgagggagttgggatttgaaccccttcacctgaacacttgcacctgcctgcagttaatacatcacattggagcagataacctgccacatttcctggagagcagggttctctgctgcaactgtgctccccagggaacttttttttttttccaagacagactctcactctgttgcctaggttggagtgcaatgagctgagatcgcaccactgcattccggcttgggcgacagagtgagaccctgtctc

SEQ ID NO: 246104 - DNA, 341 bp, Homo sapiens
tcgctcttgttgcccaggatggagtgcaatggtgcaatcttggctcaccgcaacctccaccttccagattaaagcaattctcctgcctcagcctcctgagtagctgggattacaggcacgtgccatcatgcccggctaattttgtattgttagtagagatggggtttctccatgttggtcaggctggttgtgaactcccgacctcaggtgatctgctcgccactgcctcccaaagtgctgtgattacaggtgtaagccaccgcacccagcctagaatattgcaagcaaaggattagattattttcatcatgcagtacagctgtcaaaagaaacagagatgg

SEQ ID NO: 246105 - DNA, 343 bp, Homo sapiens
ggcctgcggttaccaaggcgacgaaactttattgacagctctgcctggctacaaagggctcctcagtctctctccctccctccccgtttacaccgttgcgttttgggagtatccacacgcactctgtgggaccttcccgcgatatgaacggggtcggatggagggaggggaggctgagggaggagtggggacttttgagacaagccctgactcctggggcgctcccctggggcaccccctaattgggatcaccccccctacctcaatcctagaggcaaacgtaactaacaattcatcataattacgccgagaataataagctccacactcagaacaggcggtc

SEQ ID NO: 246106 - DNA, 348 bp, Homo sapiens
tgaagagtggtgtgaggattatggtgtttaatgtccaccacaatgcctactgtcttatagaagctgagtgggaactaacgctatttctacttatttttgacaagctgcacgtgacagtgggaaaagtattgtatttggagtcagataataatgataacaaccacaaactactagcaaatgcttacacaatgcttttctgtgtggtaggtctttttccaaatactttacaaatactaattatttttaatcttcacaacaaccagaggtaggtgctggttatcatgcccatttaacagatgagaaaagtgaggcatgaaggttaagtaaatagatctctacagaagtatt

SEQ ID NO: 246107 - DNA, 557 bp, Homo sapiens
aagcctggccaacaccttgattttagatttcttagatcctgagcagagaactcatttatactgtgcctagagttctgacctacagaaaccatgagatagtaaatgagtgttttaagctgctaagcttgttttattttttaaagcagtcatagaaaactaatatattgtgtgactttggacaagttacttgatcaccctatgtgccttactgtcattgttaaatggagagataacagcacccacttcatagggtatctaggtggattaaatgagtgaatacatggaaaatatatgtggtacttggtaaagcatcaaatgttggccaataatagtagtagtggttgttataagaactcattgtaaagtagaaaatgaaaggaatttccttaaaatgccaaaagatgattatcacaaacctatagcaagcattagacttaatagtgaaactttgtaaggactccactaaaatcagaaggcacataaggatgccagttgtctttacaataaaatattgtatttgtggccctggccaatagaattatatgagaaaaagaaat

SEQ ID NO: 246108 - DNA, 1310 bp, Homo sapiens
caaaatcgtacaaagagtcgaggaagcctattctctcaaaaagaattctatttgactgagagtccaaggggaaagtcacacctgcaaagcccatctatctccatcggtagtatgaagggagaaatctggtgaccttcttatgatttctttttctcaagtctatatgtaaggacacaccaatatagttaaaagaaacaacacagtgaaaaaagaagtatttttttttctttaagttctgggatacatgtgccgaacatgcaggtttgttacataggtatacgtgtgccatggtggtctgctgcacctatcagcccgtcatccaggttttaagccctgcatgcattaggtatttgtcctactgctctccctcctcttgtcccctaccccctgataggccctggtgtgtgatgttttcctccctgtgtccccgtgttctcattgttcaactcccacttatgagtgagaacatagtgtttggttttctgttcctgtattagttggctgaggatgatagtttccagcttcatccatgttcctgcaaaggacatgaactcatccttttttatggctgcatagtattccacttggaaccaacccaaatgcccagcaaaagaagtcttattgatagtaatgatcatgctttcctagggaactcccacaattctcaagttctttatggtttttctgacttctgacttttttctatactcacatggctttatactgttttccactgcagatgacaagatttaatgagaatattgtcaaagaaaaatgtattcaggaaggagaaggaagcaaacaccttttaaaaaatattacaagaacgaaagatctggtaagagggtcatgtaaggaatcactgagcttacagaagacatttagtaaacagaaaaccatctgaaaagaaatcatgatagtatttctgtgtgaaaaagaaagaaggcttatctgtgtaacccttcaagacagaactatgcctaagatttggcataatgcaaagagactttggtttattaaacaacagagttgtctaacattagaatatattggataagtaaggagcgagcttttcaacattgggaatattttaataaagactaaatgagtccttgtcaggactgttggctaagggaatgtctgcttggactgatcattgaacaatctttccaactaaaagcttctatgattctctaagtagcaatcagcaccgacagttatgattaattttttcaaaataaaaaagttggaagcaaataattaaatgtaccccaaattgcctttaagtaaaattgttcattgttcaccta

SEQ ID NO: 246109 - DNA, 595 bp, Homo sapiens
caggaagcctggggacccagcgcctgaccagaacttcctcgggggaggctgcaggggagcaggcgcatcctgcacagaacgctctagagcgcgcaggccaaagcaccaggctgctcctgacacgtgctgcaagagggtccccgacccgggggtccagaccctgcacgcatgatggggaaggtggaggcttccccctcagctccgcggagagaagctgacactgccaggctggaaccttccattccggcccagcctcttcctccctcgctgtgccgaggagggatctagaagggactttccagagagggttagcgtgcagggtgtggaaatggaataaaagcatatgcaaataggccttagctgccttcctctaccccagcaaataagagtctctccagaaagatgctctttctccaagacgcttgaccgctcttcctttcctggatggcaccagcagggccgattggagtggtaaaccctgggccggaaggcatgccaaagggtggacaggatggacaggagacagtagcacaacgaggagggggagaacagcggctgaattggaaatgataaaataaaatgaaattttaggaac

SEQ ID NO: 246110 - DNA, 455 bp, Homo sapiens
tcatggggggatattttatgaataattttaaccttacatgttaaactggtcatatgcagttgaaaaatgtcaaaaccaaagcttgtacttgttttcttttcaacatgcagtttagcaataatggttaagagcatggactctcagaagtcaaactgccggagtttgaatactggttcctcctctccctttccgcctggttttcagaatgttgcttaaacattctacctttgtttccttgtctgtaaagtggagataataatagtacttatttcatagggttgttgtcagggttgaatgagctaatatatgtaaattcttagaatacatggtaaactttaagtaggacttattatcatttatgactaggttgtagatttaattttttctccccccatccatcctgtggtcaaagactaaattatttaacagtcatttacatcccccataaaaaaaaa

SEQ ID NO: 246111 - DNA, 349 bp, Homo sapiens
gtttccactaaaaattttccccataaagtaacaaatgattgcattcttgccagctgatgtaagcagatttgtttctggcctgtttagtagcacttcctcctttgcgaagttctctccttccttgcttggtatttgtaattcagcccatttgattttccaggtgcttctggcttctcaggctcccagtctctccctcatcctttaaagataatttcctcatgattctaccttcaaacaccctcccactctctttctactccctaatgatcttacctgcgctctgaaaacccaaatctaacactggtcaatccccaaacttccagacgttttgaaatcttccctagtggac

SEQ ID NO: 246112 - DNA, 426 bp, Homo sapiens
aaacataattaatggaaggatcatgtgcatggactatcatcttatcagtgatgataataggcctggttgcctagatctttccagtcagccgccatgttctgtcagcatagctttcataatgtcctcttcctgtcattaacaatgtctttgggtttctgggttttctgtcctcaaattcatcctgaacaccataactaggtcgttcatcctggagagatatcttggtactttgcctcccaatgtttaaaggctccctattgccaatgatgaagtcctaacattgtatcctgacatctgcatccctacacagtatgatctccgctcatgtttatgatcttctgtcccactcttcttccgtgggaaccagaccattgagctcttgggccttcagacacctgtctgctcacctctctgctcagagttctt

SEQ ID NO: 246113 - DNA, 558 bp, Homo sapiens
tatttgttcatttaatatttattcattgttaatgaataaattaacatttagtaatttattaaaatgcatatattcattaatccatttaaacgttaaaaataacattttattataaaaataacttttttaaaaaatccaagtgagaagagtgacagtgttttacatttttgcaaatctcttgactgtccggcttaatagaagacagctggattctcatatcggcttctgcattcaatcagctgtgataatgttgttttggataaagtatgcgaaggaaacccagcctcacgtagttattttgttggaaaagggaggaatattttaatagtcttttcagataattgtgaatattcttctttgacattataccaaaactcaaccaatagtagattactaaggttagttgcaatgtggaatctgaaactatatcaatgaactttttgtgctcagttatgttaaaattcagttatctggcttgtactctgaatagatcttttgctcatgcatgattttgaaataatatgcatgggtcatttggaaaatattgcttcactaagt

SEQ ID NO: 246114 - DNA, 442 bp, Homo sapiens
cactagtacagcttaggtcagttagaattctgcagaaagacttcaggcagggctgagttttgtcttttgtggactggctatctgaatttcaagatgaacacaccacagataacgaataacaagcagtggcttttggcgacgctacatggcagtatagtacactggcagccttgtttcttttctattcttttttttacattttctcagagcagtgctatatcattgtgtttatttcctagaaaacattgagaagtattagggttttctttttttttgatccagtttgagtgacatatcttgaatatagaatagacatatgtgtagtattttatgtgaacaagctgaaaaggaagacaaagggtaagaaaacttaggtaaagggaaggaaatggttggagaactttttacaatttctgaagacatgaggaccttttttataagc

SEQ ID NO: 246115 - DNA, 568 bp, Homo sapiens
attagtctggctttaaacttaaaatccacacactgtcttattttgacaactgtgcaaaaaatagaacacaggaaaagatagcccatggaatgtgagaaaatattgcaaaacatatatctgataagggattcacatgcagaatatagttgtcccttggtatatgtgggggattggttctaggacctgcctgtgtataccaaaatttgctcatacacaaatcccgcagaacctgcatatatgaaaagtcaaacataggtttcacattctgtgaatactgtattttcaatcaacatttggttgaaacaaagtctgtataagtggacccgtgtggtttatacctttggtgcgcaagggtcaactgtatgtaaagaactcctacaactcaacaacaaagaaacagtctgtttcaaaaagaagcaaaggatttgaatagacatttctctaaagaagatatacaaatggccaataagcacataaaaaaatgctcaacatatctactcattagaggaatgcaaatcaaacgtacagtgagataccatttcacacccattgtggtggccattataaa

SEQ ID NO: 246116 - DNA, 468 bp, Homo sapiens
tcttcctcctttttctcctgcccccagttagaagtttctaatttgaatcaataaaattgttctcagtgcaaaaaaggagctacttttaaacttcattacattcctgatgtggtctttatttcacagcattgtatcaggacaaatacgttttacattagaagttgaaaaggatattaaggtacaaaaaggtcttgaaaactttccttttacatttcctcccgtgagagagattttaaaattctgaatgagcatataagagttgaagactcgatttgattgtagtgtaattaagagatagttttctttttttttggcaaagagattaggataacattgatactggcttcactttcaaagcaatgttttctatagttttctatacacaattatctttaacccaaaactctaagtatgcacagtgttgtcaaaatgactttcaaataaatggtagcactacatggtaatctg

SEQ ID NO: 246117 - DNA, 399 bp, Homo sapiens
tggttgtaggggaaatctggcttcacatttgaaagcccactgatcaatgttagcattactacaagtggaacaaccagactgtatgctttctgttaacaaaaatgttgatccttaatatactcaggcctttaagtggaatttccagttataggaaagaataaaggggaaagaggaaaaggaaacaatcagacaaatccacaatgtgggatatcctattggacaactgactgtttcttccagttaaaggaaaaagagggaggagaagattgttgtagatttgtaacgatttgagatgaaaaacatggcaacatttaaaatattttaaatcttaacaggtttattatactattctctgcttttatgtgtttttaaataaaatttaaggacacatattcatga

SEQ ID NO: 246118 - DNA, 1047 bp, Homo sapiens
atccgtgtgtctgctcttcagcatcccctagggagagtccacgttatttctaagaagacaggagagaaggagggagaaaaaaacgtgcagatcaaaaggcctcagaaaaaaacaaagtgggatgaaatgctgggctttattctgtacaacctaagcattttctatctttgatgagtcaaggtactggcagttctgtccaccattacttttgcatcatcaatgcaaatatcaacacaacaaaaaggaaaataatgtcttagtattattatgaaaataattttgaccctgtggaccctctgaaagtgtttctgcagacagagttactgcaagtttcctggggacccttggttgggctctgtgtgccacattttgaggactgctgccctagagggagaaccccactatgaagccggtcaggtggggagacagcacttccattctctttaaatgatagaaatgtctaatttctgagactctctgtcttgtggagcactgtcgtcttcatggacacaggcaggatggcaaccatgtgatgctgctttccttcaccttccaccttgagtggaagctccatgaagtcctcaccagatgctgatgctggcgccgttcttgttttatagcctgcagagccatgagccaaagaaatctattttatttataaattacccagcctcaggtatttcctttacagcaacacaaatggactaagacatggtcatgacaaagtctcccatagaaaactgatctggccttctccaaaactgagggcagctgggaggcataaacagaaaaggacattggacaacactgggtttagcctgagagactctcctcactagagaagcagattttcagttgtccaatcaagctgctaaagaaagaggggctgatttgtcagactattttgtctataactagggtagccatatatgccaatttccccaaggcagtcttgattagcttctattttttggcacaattctgaacagtgtcacctcttttattctaaaatgttttctgaaataaaaatgattcttatggccgaac

SEQ ID NO: 246119 - DNA, 710 bp, Homo sapiens
atccgtgtgtctgctcttcagcatcccctagggagagtccacgttatttctaagaagacaggagagaaggagggagaaaaaaacgtgcagatcaaaaggcctcagaaaaaaacaaagtgggatgaaatgctgggctttattctgtacaacctaagcattttctatctttgatgagtcaaggtactggcagttctgtccaccattacttttgcatcatcaatgcaaatatcaacacaacaaaaaggaaaataatgtcttagtattattatgaaaataattttgaccctgtggaccctctgaaagtgtttctgcagacagagttactgcaagtttcctggggacccttggttgggctctgtgtgccacattttgaggactgctgccctagagggagaaccccactatgaagccggtcaggtggggagacagcacttccattctctttaaatgatagaaatgtctaatttctgagactctctgtcttgtggagcactgtcgtcttcatggacacaggcaggatggcaaacatggtctcgctctatcacccaggctggagtacaggagtgtaatcacagctcactgcagcattgaccttctgaactcaagctatcctcccacctcagcctcccaacatgctgggattataggcgtaaaccaccatgcatagcctttaggactgtctttttaacctgaaagctagatggacgcta

SEQ ID NO: 246120 - DNA, 780 bp, Homo sapiens
aagtgcggccagaccgaggctggagaaagagcgcagccagagacggaaaggcagccaggctgcaggatagtgatgggggccaagggccctgctgcacacttggacaggatgaacttggcccacattttgtagaatctgcaaaagccccgggttctctcaaaatgtcacagtggtaacttggagcccctggactcccccaattcctccttcggcattcaccctcctccaggggtttccccataattggcctgaatggtgcccttcccattcccccaacgtgtccctcccataactcctcaaagttcaggatacaccaggcgctgtgattcacaataaagtctgcctttattgatgtgtatcatgtttactatcccgggtaagtggtgagttcaggaaaatggcccacaacctgtcacagcctgtacttcaagagacactcagcaagatgatgacgacgacaatgatgatgatgatgatgatgactcagcaagatgatgacgacgacaatgatgatgatgataatgatgatgtgtgtgtgtgtgtgtttccgggtatccacatactctgctcttcctcactcattcacctcagacccactcagtcctctttagggcatctctttcacctgattctctctaccaaaaatttttctaactctctcctccctctgtccaaaacctccccatccttcagggcctggctcaaaggccacctccatctcctctaagaaagttttctgactactccaccttctccaggactctctgccctttgttttct

SEQ ID NO: 246121 - DNA, 558 bp, Homo sapiens
gtgcgcgcgcgcgcgcgcgtacgtctgcaccgtgtgggtgtcttcactgggggagtctggatgcatatgcacttacttcccccacccctattaaatatggagcagcttttcaggactctgtgactgccttctcctcagggtcacattgagtttgaatctgacccaaggtgcaggaatcctgcaatggggaaataaaagaatatacagaacggggtcaggtcagctgctcagaggccaaaacccctacagctgctttgattttattttttggtgtatattttaggctcctcctgccattgtacaaattgtgcctccccctttcaggtgtttggtctgtggtttaaaggcaccagagcctatgcctgcatagacataggctcccagcaacaacagaaaacccacaataccgaatccaaaacaaaacccgggaggagggggagaaaaaaaccctattgagttcaggcaaataaggttgggtctctagatccggttacaaagcagctttgaatatgcaagacagtgcacaagaccagttattccagttacaacaaactatta

SEQ ID NO: 246122 - DNA, 506 bp, Homo sapiens
acgacaagctcttgaggatggggactgtgtcttattcatctttgtgtctttagcatctaacacagtacctggtacaactgtagtgctcaaaatgtttgaactgaaccaactaatatagaactatcctcttggcgggccaaaggcagagcatagaattctaatgcctgtgtgcctgttttgaatctttgtgggtttgaaggaaggaggaggggaggagaggaagtgtagaaaatcagcaaggaatccctatcctattattgtagaatctagggcatcactgaagggataagggaaccctagttatacgattcaattgaggtttactggtaccataaggagggaaggtagggctggagtccctgcagtgttagaatgaggacactcctgtcaatgaagaaccaagagtactcaatggaagctcttacagtcagaaaacttttaaatcatgttaccattttcatatagctttacgcatcactattaataaaaaacattaaagaagaaac

SEQ ID NO: 246123 - DNA, 480 bp, Homo sapiens
atgccttacgctggacaccatagctcataccctgtagttcaacaatgtatagctaatcactaatcagtgttatttctgtaaaccaatgacaattcctgaaacttttgtaaattgctttctcttttgattcatccttttctttttactttaaaagactcaagactctcctttgctctctgaagcacttcccagtggttcccaaattccagtcctcaaccttggccaaaatatactctttacattaattttccctcattttcttccttcaggtcaatacacatagaccaatgaaatataatagagagcctagaaataaaccctcccatatatgatgaaatgatttttgacaagggtgtcaagaccatccaatgaggaaaggactattttctcaacaaatagaattgggaaaactgcatattcacatgcaaaagaatgaagtttgacccttacattgtaccatatacaaaatttaacaacaaa

SEQ ID NO: 246124 - DNA, 294 bp, Homo sapiens
ctttaaaagaaaagtacaagagcgagtttaggcagattagcaaatggcagaacagccacggccaaccaatggccacaggtcattgcaacctgtggggggctccactgtggagggagagaagtgctccatgcatatgtctctgtcctgccatgcatgctcctaagacacttggagtgctttggaggccaataaacaagggggacaccccagctcctttaagggctggaggaaagaattgagtattgaactcaatgatcttttaaaaatcaggaataaacctacattattgtcctc

SEQ ID NO: 246125 - DNA, 464 bp, Homo sapiens
aactgtgagaagtatatttataatacacaggtattctaaattaatacacaggtattataaatatatataaatatacacaggttatacaacctgtgtattatgaatatatttttatagtctgaaatctgaaaagctccaaaatcctaaagtttttgagtgctaacatgatactcattgtaacatttttatttttattatttttttcttttttgagatggagttttgctctgttgcccaggctggagtgcagtggcatgatctcggctcactgcaacctctgtctcccgggttcaagtgattcttctgcctcagcctcccaagtagctggatgtgtgcctgtagtcccagttgcttgggagcctgaggcagaagcattgtatgagcccaggagtttgaggttgcaatgagctgtgatcaagccattgtactacatcttgggcaacagagtgagaccctgtctgttt

SEQ ID NO: 246126 - DNA, 886 bp, Homo sapiens
agactttaaaatctttttgggattcatagcatttctcttttaaggagtcaaattcagcagggcttatgttgcctcataattgatccctgtttaaaaggcaacgtgaaagaagtagctaagtgcactcattgcagagttagactgtctggattcaaatcctgactcttccactctaacttgttgactttggcaagttacttaacttgtctgatttcctatttgttagctgggagcatgatctacttcatggggttgtttgaagattaaatgagaaaatatttataaagggcttagaagagtacctgaaacatgatgaatgctcaataagtgttagcaattattgtaccaagtaacaaatttgaaggaaacattctgtctaagtaggattgattaaaattccctttgaaataggtaattcaatatgcatttaaagctaggatgctttagaatagctgctatttaaattgtgtggtgtctggtgtagagtcatgtattcactacagtcaagatacagttccatcaccacaaggaattcttgtgttgcctttttatagtcacatttatgtccctcccaccctcttccctttccctgatctctgtcagccactcatctgttttcattcctttaactttgtcattttaaaaatgttaaatgtatgaaattttatatgtgacctttttggattggctttaacatccaagttgttgcatgtatcaataatttgtttcttttcattgctgagtactattacatggtgtggatgtaccacagtttatttatcattcacccactgagttgttttcaatttttggctattatgaataaagctactatgaacatttctaaaaataaataaataaattgtgtggtatatgaaaaagctct

SEQ ID NO: 246127 - DNA, 352 bp, Homo sapiens
ggcaaagccatcaaaatttgctcagtaacgagagtaatatggtaattgtaaagttttaaaaataagtttcggctgggcttggtggctcgcacgtgttatcccagcgctttgggaggccgaggtgggtagatcacctgaggtcgggagttcaagaccagcctgaccaacatgtagaaatcccgactctactaaaaatacataattagccgggcatggaggcacatgcctgtaatcgcagctactctggaggccgaagcaggagaattgcttgaacccgggaggcagagattgtggtgagccaagatcgcgccattgcactgcagcctgggcaacaagagcaaaactctgtctc

SEQ ID NO: 246128 - DNA, 552 bp, Homo sapiens
tttttttttttttttaagccctggacttccttgttttagtctttcacttaccagaatgctatacttccaattttgatgggacaaattcaacaaaagcatattcatttgtatatcagcaatcttgaatgactcaacttctggctccaaatttggcctagagtttcccaacctatatgtagcagtacattagtgtgctgaaggtattaagccttcagcccatgaggcagtcaggcaggcctggggtacagaggccccaaggtatccacctctggagtcagcacctcatctgcttctctatgtgccttacaattatgatcatttgctaggtgggccatcatgtggaaaagagcaagaagcagagcccaggacaaatgagtagtgcaaaaaggtaaggggacagaggacaattaaccttctagcactttagatgtactctaaaattaaaaccctgaaaatgaatgttctccattcattaaaacaggatccacaagacatatccctggaaaacacttaatgagacttgctatacctagacagaggtacaaactatcc

SEQ ID NO: 246129 - DNA, 535 bp, Homo sapiens
tgtccatcttgaagactaaactgccataaacagaaataagggaatattgaacagccttttttatttttattttttgacagggactgttgtatgctcgctctgagctacagagataaatcataaggtccttgtcttccagaggcttatagtataataagggtaataagataaagtatatatttcttggcagagcattgtagagaatattgacctgagataggcacagaagaaggttcgtgggatttccagaagggtgggctttattctaccagggaaacttgaagctgttttgccgagatatttccacacaaatttagttatttcttaagctgtcagcagatcctattcttaaactttaaaacattcattctgcctaaagaagctttctgtaaagccatgctttcattaacaactttggctgggtgtggtggcccatgcctgtaatcccaggactttgggagtctgaggcgagagaatctcttaagcctggtagtaaaggaacagcctgggcaacatagtgagacctcatttctta

SEQ ID NO: 246130 - DNA, 572 bp, Homo sapiens
tttgaaatttacccagccacgtgctgtccattcccttacgcagtggaaactctccttgcatttactcccaagtaatcacctcggccttgtcacatccctttagattccagattgaaaattgaacagagcatttcaaaattaaaaagttttgaaaatccaggtggggaaaatggatctgactaaacaggagagaaatttcttcctcttcccctattctacgtgcttctgtggatatagaaaggggcacccccagccccagcaagggagccaggcatccatctacttaagtaaagttggctgtggtaaggggttagactaaaattctccgcagatgcagaggagaaggaatgaattccagctgagagacctggccgatgcatgggatttgtcttcaaggtccaggcagaggggatggcagatgccaaattgcagaagtcgaagagggcccagtatggttggtctgtaaagtaggtatataatagtatctacttaatctgtgagattgaaagagattaacatgtatagagtgcctagcacggtagtaactgctcaataaacgttagccattatta

SEQ ID NO: 246131 - DNA, 769 bp, Homo sapiens
tcagctgtagtttagtgacactgagcactaattgtgggatttcaggtacagcctgaacaatatacagaaaaataggatttcatttaggcactagatttctggttgtactgcctaaggctgcctttatttttaaggtaactgggttgggggttcccaagaccacccctagtttggtgattaactaggaggactcaacatagagtacgtgtggctgtcatttattccagtgagaggatacaaggtaaactcagcaaagggaagaggccggcctggcgtgaggccaggccaagcttcccagaggcctctctcattaattttaaataaaaaaattttttttaaattattttttaagagacggggctcttgctatgttgcccaggccgtacttgaactcttgggctcaaacgatcctcctgcctcagcctcctgagtagctgggactacaggtgtatgccaccatggccagctaaaaaaatattttgcttatatatttttaaaagttaaaaaattaaacagaaaaacatttcttaagtgctctaaatagcatcctaaaaagtactttttatagctttcatttttatgcatagctctgggtgttttacaaaaagagttcagtagacacagttacctttagaatttataatgggttcactgacatcgacaaacattggaaatagtgagtaaacataataacataaagtctatgtctatagataataatcattagatcttatatttgagaacaactcagctaaaaactataataaaa

SEQ ID NO: 246132 - DNA, 326 bp, Homo sapiens
gagagagagaaaggaaggaagaaagaaagagagagagagaaagaaaagagagaaaatatgagacactttctcaaactctgcagcctgctacagtaatggtcagggagtcaagggaactggagattagaatagatgccctgatcaaccctatgactttggacaagtcactttccctctctgggctgcagtttccccttgtatagaataagagttaaatcaagtagctttgtgatcccttttagctgtgtcactctaagatatatttggttcttgacattttgccctttgatcactaaatcagttattcagttaagaggggaaacatg

SEQ ID NO: 246133 - DNA, 555 bp, Homo sapiens
ttcacctggtgtatgtgaagagctacgctacattttgaaggatagaaagaagtttaatataagtatctgtctttagtttacatctagttgttgaaacaagatacatatactgaatgactgcagataaaaacctttattattttggtggtgtgagttatcacaaagaaagtacaaaatacacttattttctttttacttaatttctgttccatgttcaaatcatctcatttgcctatgtgccctatatttcaatctgtcattaaccctcctaccttctaaatggccaaggtaattatgtctaaccttgcccttctcttacactggcagcatactcacataaacagtaaatggggattgttttatgtcgtaaaatttcccagaaggaacactcttgggtagcttctgttcagtgtagataaggaactccagcagctaactagccttctaataacccaaaaagaaaacaaatagtatgaaagagagaatggtcagagaaaaggcagaagagaaagcagtcaagaggggggaaaaggagggggaattaagttacaagat

SEQ ID NO: 246134 - DNA, 113 bp, Homo sapiens
tcccaacaacctgcttggtttagtaattgaaagcttgggtctctgaaacaaggctaccaaggtttggatactggctctgccacctattgtgtgtgtaattttgggcaagggac

SEQ ID NO: 246135 - DNA, 406 bp, Homo sapiens
ccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtg

SEQ ID NO: 246136 - DNA, 720 bp, Homo sapiens
ttccctgctgacatttattctgcatgcttaccacacaaggggtggattatttcctcctgtgaactttcatttaggtagagagcttagggtctatgagctttgcaaggaaccaggaccttagacaaacaacaaaggaaacaaacattgactctaaaatgcaccaaataaaactgcaaaatccatattaataagaactaactaaatatatattaatttacttgttattactaataatcacaaaaattgcattacatttgaatgtgatttgtaatttgtagcttagcttttcctcattttgcaaaaattttagagtatacatgatgattactgagaaatcatagccaaatgttaattaaatgcattacctatagccaaatcatttcaaaaacaaagtcataaaattcacttcagtttttttaatgcaaaaaaatatatttagggcataggagctaacctgaaagaactcccagcagcaaaaacaaacaagttgaacaacaaaataaaatagtattagattataatctaaagtataaaataaatatccatgagtccatactaacataaataagtcgtttatacaaaattggacaccatcaaacttaagaatgccgaagtctactaatgtcctcaaatatccccattagggtaagtttccattaggttcacatcagggctttaatacgagtttggaaagtcagattattgttacatagtaaacaa

SEQ ID NO: 246137 - DNA, 373 bp, Homo sapiens
ttcttccctgatttgtggaaatggtagtgcctcttggatgctgaaatgcatcttggttctgcatttaaaagttctttaatactggctgggcgcagtggctcgcacttgaaatcccagcactttgggaggccaagtcgggcggatcacgaggtcaagagatcgagaccatcttcaccaacatggtgaaaccccatctctactaaacatacaaaaattagctggatgtagtggtgtgtgcctgtaattccagctgcttgggaggctgaggcaggataattgcttgaacccgggaggtggaggttgcggtgagccaagatcgtgccactgcactccagcctagtgacagagtgagactccatccccacaaaaaatt

SEQ ID NO: 246138 - DNA, 469 bp, Homo sapiens
gtaagtactgtaatagaataacaaagtaatatcctatcacggggcagtcacgggggcagtgagagacaagcgcttgtccatgccaggctctgtactcagtccatcacatacattaggtcttgcagtcctcataccaccataaggtggttaccattatctccaattcacagaaaagcaaacagtatggagtgtttaagcgtcctgtccgagatggcatagctagtggagctgaaatttgaacccaagtaatccaggtccagaatgccccggatgcagaaatgaccacacagattctaccaatgaactaacctgataaggttggaggtcatactcataacccctcacacaggtccacacagacacaggcaagcacacccatgtctattcagatacacaccaattcctgtctatgacgagcgctcagaaaatcctccacaacaccacaccaggaatgatgtgcattttgaga

SEQ ID NO: 246139 - DNA, 198 bp, Homo sapiens
caaccaccccaccactatcaccaccaaaggagctctagggcatatccccaaatgccctcttccctgcctgccagcccactgttcatgtacctggagctcatgtacctggagatgtggagttatcagaactttctgccacccttaatcctcttggcccagtgaaagaagggaagctgtttcagcatggccgctgactca

SEQ ID NO: 246140 - DNA, 244 bp, Homo sapiens
tggtgtggtgggatggaattctgagctcttggcggcattcatggtcccaggggatagttattgcctcaggagaaatcaagtcaaattattggctttaagttccaaaataagttcttaaagctcacagcagagataatgtccttggagagcgaggtttttgatttgccagagaagtattttggaatacagaaggttaattcctaataggatctggtcaaaaagttaatgctagaagttagagtga

SEQ ID NO: 246141 - DNA, 432 bp, Homo sapiens
ctcctggcattatttggggatcaattgtgttctttcattcgctttccctttgatttttcactagtgtgtaaccatttgaagttgcaattaattgatatatattccataagattagaatacaggatttgaacagaggcattcctactttgatttttttttttttaatttggaaagggaagtacctcttttgagctaactagtggtgtttacaacagtctaagaattttttaaacaccttaagaggacatagtcttttaaagagatttggaagcccttcccttgacctatatgctatagatacaaatattacaaaagatgtgtttttctttttctttaaaaaaatttccccccacaaaaaaaaattcccccaaatatcctagtaggtagtgctctgcttagctaattttgatggttttccctgtaaaatttgaa

SEQ ID NO: 246142 - DNA, 267 bp, Homo sapiens
ccagaggattatcgtacatctgccaggactggcgcagggagaggaattgtaggcaagattatttagtaagtttggcttcctatcaggaggaaggctggagttcagcctaggtatttatcccagcctgatcacaccctgaaatgtgctgagtcctgcctcctgcttcctgttaactcttacgaggctaacttaggttcttataacttttttttaaattcttcaaatagggtctcactctgttacccaggctggagtgcagtggcgcca

SEQ ID NO: 246143 - DNA, 514 bp, Homo sapiens
acaaattgagagcattagtcatttttagtcagtgggttatgtagagatttgttaagagagcatttattgtgacagtttgagtctgtacaacatccttgcttagaaaccaattaaaatgcctcaaggaatggatacgtatgtagttacttcttccctttctagatcccaaatgttaaagggtattatatagacccaaggaagttgtttggttttaagcacttagccccatgttgaacaacgactctaggcagacatacttgatgagtgaagcaaaaggaggaaaagcaaaagtcaaaaatggattttgattatgggtagtgatcaaggaatggatgatgtgggaacagtgtgtaaggagtatctggagggaacatgaaggggagtaattgtgtcagacaagtttgagagagtcatttatatgacatttcccccttgagattttcccttttatcttgaattttgtattactgaagataataaatgcatatatttagctaatgtgaaaaaaaaaaaa

SEQ ID NO: 246144 - DNA, 410 bp, Homo sapiens
ctgctgaattgaaagtcctttgtagcagctctgattggtggagcctgatcacatggccccagctgcagagggaggctgggaaggtgagtttcttccttgaatctggggaagcacagattcactaggtggagaatcccctgaagcataggaaggatgttcaaagatgcttaactgaaagaagaacaaatattcacaacaaaattcaagtttactcatggcaatttcactctgaagtgctctgcaaattgaatgtggcaacattgtcaagggataccaccctcagccacttgaggaatgggcacaggagctattggttgagtgactacgtgccaagcactttcccattctgtatctcatcaacttctcataaacctgtaaggaagatattatcagccttcattttctcatga

SEQ ID NO: 246145 - DNA, 260 bp, Homo sapiens
gtttgttttttttgtgtttgtttggttggttggtttttggtttttttgctttttaaaggtcacagtgttgtgagcctggtgtaaatgccaggaatattatatggacttagtatctgcatctcgttaattgtaccacacaacactctgccattcaaataatgaatatctggtcaggatacgaacttataccctctgtgtgttttttttttttaagatacgtgatttctgaaataaactttatatacaatgataagctagtt

SEQ ID NO: 246146 - DNA, 411 bp, Homo sapiens
ctattcagtgctcttactttggtaccatgatccatgataatgataactgtccatgtgttacgcctactgagaagcccaagccacttcagagatgaagcagtgtcttttttctctctctgtccatctctctttctctccctgtcacacacatacacatatgcacacacacatgcactgcttagaactccattccggagcactctgtagaatttttcaaagactcctctgacgctcttgcctttatgttgatgggagactttatgttagcgtgcatgtttccatccatttatcagatacgacatattctttggcaccagttatcgcaagatgcacatttgggaaaaaatatctaaaggctagaatggtggcagaacgtatatggaaataaaatcgttcagagttgaaaagatc

SEQ ID NO: 246147 - DNA, 331 bp, Homo sapiens
taaaaattgaaattaagttaacatttaaaaaaatgcatgtggcttacagttgggcacaagctttgggcagcacaagcttaaactttccccacaagatgcataaatgattaaaacaactgacagcaaccagagtaacataacacacacactgccccttttcctccaatttgaagaaataaataaagcagacagcttcaatgtactaggtttcaactatgaaccgcaaattcttcctgccccattctctaatttccttaaagcagctattaatatcacattctagtttggtcttttctgagacagggtctcattgtcactcaggctggagtgc

SEQ ID NO: 246148 - DNA, 483 bp, Homo sapiens
gcttgggagggctgtggccaggccttgagtccgtggctcagtgggaccttctgaaacagcctccaatccgtgcccccacttcatttgctagtggatgaccccctccagtggctttggtgctgatgggaataagtcgacctgcagcggaagttcagcccaagttttagcccagcagcttctccacacctgtccgtggtctggtcatgccgccgtctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctttttttttcctaatattttgagacagagtttcgctcttgtcacccaggctgcagtgcagtgagccaaggtcgccccattgcactccagcctgggcaacaagagcaaaactacatctcca

SEQ ID NO: 246149 - DNA, 423 bp, Homo sapiens
ttgagaatcaagaaaaagcatcctattttctttccaaagcaatgtccttggaaaaaaatctcccgaggctgttctttcaacaagcagtgagaatgcagttaccttgggcttgaataaccatgaattaaacatgaactctccatgaattaaagaaaactctcgaaccatgagttgttactttcagcttatgtgcctgagtgctcttgttgggccagtttgtttctaaataaactgcagttgcataacagctcataaaatcaagggaggattctgtatctatcttcttagcatggatttccacgggatgtaagactctaggtcatgtttttatttctgaaaacaggtacaaaataagaagtgtaattccttttttaagttctgtcttagttcgtttgggcagctataataaaataccatagatgt

SEQ ID NO: 246150 - DNA, 390 bp, Homo sapiens
tgttctccacatgataggacaggaaagggctgctctgccctgtctgaggtggctccctggggactcagtgggaagaaataatctagaagaacaaagttcaccttggagaaggattaatgcttctgagatggaggtttctttttgctgttagggtgaaaccatgagtgcctgcaactctcttttaatggattctggaagtggaggccgtctgcatctcctgcctctgaaagctggaatctgaaagcatccaggctgagctgtatctagacttcgtagttatgcagcggcttcactgcaaaattcaacctctaattctagttgcttatggcataaacaaagggaaatggcagctatttggtgtggtaaatgaacattttaggattataccca

SEQ ID NO: 246151 - DNA, 424 bp, Homo sapiens
catggatggtcctacttgcaagaaaacctgtaagagattttttaaaaatagcacactttactaatctgacagaacctggattttcttgatatgggaagaagatgagagtggacactggggaagccactagaagtatctgccactcttggctggacagcaggctgcaaacataccaccacttgatggagacatcatgctctggtcacaatgcgtgtaaattaggtgccagtaacaaaccagtactgagaaatacccacatgtcacatggatctaaatacgtgattggtcaagtaggttgtccaaaaggcaattagaacgttatcaaggatgaagctatagtaaaaatactatatataaaccttttgtgatgaggctttagggttatttagaggagtgtaaccttaaaaataaagatgaaaaattt

SEQ ID NO: 246152 - DNA, 315 bp, Homo sapiens
cagcgtgcgcacggtatggctaattttgtatttttagtagagatgggggtctctctatgttgcctcaggctgatctcaaactcctggcctcaagtggtcctcccaccttggcctcccaaagtgtctggtattacaggtgtgagccaccacgcccagcttttgttgggctttttgatcaccagttgtcatgggcacctatcgcctttttgtgtctttccccaggctgtcagatagctaataaaaaaatacatacaaaagtgcacctaggagttttaagggaaaaagtagtcttttgtgataccgtgcggctatgat

SEQ ID NO: 246153 - DNA, 496 bp, Homo sapiens
tgcggttctctgctgttagttaaggggcccatataaaagctctttaataactatgcacatagatattttaaaatgtcaaagtgcatcctttttaaagagaggggtgcgtctctgaggtttgtcagtcagacttttgtaaacttagccatttcctcattgatttaccatctagtttcagttatattgagtttaaatttttaattttttttagtgtttttaggagatgggggtctctctatgttgcctcaggctgatctcaaactcctggcctcaagtggtcctcccaccttggcctcccaaagtgtctggtattacaggtgtgagccaccacgcccagcttttgttgggctttttgatcaccagttgtcatgggcacctatcgcctttttgtgtctttccccaggctgtcagatagctaataaaaaaatacatacaaaagtgcacctaggagttttaagggaaaaagtagtcttttgtgataccgtgcggctatgat

SEQ ID NO: 246154 - DNA, 465 bp, Homo sapiens
cctgaaggagagggacctcgaggactgctcggtgagagggcagagtctgaggggctctggaggcaccattcccctgcgtctcctggagagaaggcccgtttcagccacccgcatccagaattgcacacattttgaatccagtactcaaggaggctctgatccctgcttggctcagaggtgttgcatctttctaagtttatcggagaggcgagcccagtgtcctggcagagggtaggagggtctctttgcctctgctagtttcatggcttatttggtaagatggcctcagggccctcgtctcttcgggtgcttctccaccctgttgcgctaatggaaagaccatgagatttgggttcacgaacacctcccctccctgcatcactctttatcacatcaccctattgttttccaatctgtaatttttttaggtattagttacttgttagcttttcatctccccaaccc

SEQ ID NO: 246155 - DNA, 521 bp, Homo sapiens
ctggattggtggagttttcattggattgagagtcttacgtattatatcagtaaggatacatttggatccttgagtgatctgaagtatagggcactgatagaagatttgaggtatggcaaagccagcagatcaggagatgattgccaaggagagataattattcaccctccccaagagaaggggacaggccacatcacccagagggccacaggggaagctctagggttggtcaggaggtaaaggaggggactgtgggccagagcctttgttgtggtgtctgcagcagatataggattgattagtttgaattattacggacgatttctagttgtctgacctaccagtcaagggtgattagggcagatgaacagtggcctgcggtgtgacagccccttagaggaggttgttgaagtgtgagctccagattggtttgcatttaaaaagcatgctgtgagtgagttgtttactatttctaggaattgcctagcctgggaggggcagtccctctagggtcagcaagg

SEQ ID NO: 246156 - DNA, 376 bp, Homo sapiens
ttagcgtggtcgcggccgaggtacgcgggactttaattaggagtcataaagagtttctgaagagtgagtaagtagtttcatctgcattaaactgataataaacagacatttctaaagcaaggagctgcccatatgcgagccttaactaagcctgaatctattaaccactaactaaactcagcctcataaaatatggtttggggatgttacatgacagcaaaaatgattcagattgcctgtaggtccttaaagaggaaataaattaattgaactttggtagatattaaaggttgcgacttgcctctgaatgtgaacaattcaaccaatattatcctaggctcctagcactgattattaaaaattgtttgattcttca

SEQ ID NO: 246157 - DNA, 351 bp, Homo sapiens
  misc_feature (77)..(77): n is a, c, g, or t
agtggctgtgtccagaagctttagtcactggtttggactaatgtactttttaaagggcctgggttcccaggcccacnccacagggtcttcctcaactccaccatgcccaggcatcccaggttctaaggtctgaggtctgaggatgactggtctctctagctccatctcctcaggtggacaaggagcttattttgaggctcctggagcttccagggaaaaggactgagaaggtatggccacagggctgggccggggcctgggtgccccaccacgtggctactcggagatcacttctaaactcatgattgttctcctttgagtattgctaagacataaaaccctaaaacttag

SEQ ID NO: 246158 - DNA, 564 bp, Homo sapiens
agttcctggagctgggcagtcttctcagagtggagcctggtaaccgcgacctccccgccagttcctgtgtgttgctggctggaaaggggtagttgacaaactcccacccagcacagtatttatgtcggtcaaaaatggaaaactatgtgtccgggcacggcccaggaaggaggattccttcaggccaagagcagcctagcaatatggcgcaaccccacctctgtagtccaacctcagcctcccagctacttgaaccccaagattcaaggctccaatgagctgtgatctcaccacagcactcctgcctgcgagactgagagaccaaagaccaacaaactaccacagccaccagttccggaacctgccaatgatgggcaacggaaagtgagggagttcaactctgttttcagagaagtggaataatcatatcgctgatctatgtaaacaagttgaagaattgtctgacagaaaatatgtttcgcttttgttgttctggccgagatcgcgccaatggcactccattcagcttgagtgacagaggtgagactcccatctcaaggtaaa

SEQ ID NO: 246159 - DNA, 510 bp, Homo sapiens
agttcctggagctgggcagtcttctcagagtggagcctggtaaccgcgacctccccgccagttcctgtgtgttgctggctggaaaggggtagttgacaaactcccacccagcacagtatttatgtcggtcaaaaatggaaaactatgtgtccgggcacggcccaggaaggaggattccttcaggccaagagcagcctagcaatatggcgcaaccccacctctgtagtccaacctcagcctcccagctacttgaaccccaagattcaaggctccaatgagctgtgatctcaccacagcactcctgcctgcgagactgagagaccaaagaccaacaaactaccacagccaccagttccggaacctgccaatgatgggcaacggaaagtgagggagttcaactctgttttcagagaagtggaataatcatatcgctgatctatgtaaacaagttgaagaattgtctgacagaaaatatggtatgtttaaattggaaaagtcctgtaatacttt

SEQ ID NO: 246160 - DNA, 931 bp, Homo sapiens
  misc_feature (101)..(101): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (113)..(114): n is a, c, g, or t
  misc_feature (116)..(116): n is a, c, g, or t
  misc_feature (805)..(805): n is a, c, g, or t
  misc_feature (810)..(810): n is a, c, g, or t
  misc_feature (815)..(815): n is a, c, g, or t
  misc_feature (822)..(822): n is a, c, g, or t
  misc_feature (832)..(832): n is a, c, g, or t
gcaactgtcattgccataggaggctccggatggtggcatgcttgccgcctggtttaggatgaaatatcctcatatggtagttggagctcttgcagttctgncncnatctnganntngggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagcaatggtgaactagaaccctggtcagaagtgggtcactcaagntatcncaganactctgntggcgtcccntctcgaggggccccattgatttcgcgacaagaaggtggatctttttgggtgtaccgcgctggaggtacatacacgaatgggccacatttaaacggggaa

SEQ ID NO: 246161 - DNA, 942 bp, Homo sapiens
  misc_feature (101)..(101): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (113)..(114): n is a, c, g, or t
  misc_feature (116)..(116): n is a, c, g, or t
gcaactgtcattgccataggaggctccggatggtggcatgcttgccgcctggtttaggatgaaatatcctcatatggtagttggagctcttgcagttctgncncnatctnganntngggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcaaaaacattagttcacacacaaacattgttttcagagcaatggtggaacttagacccctggtcaggaggtggagttactaaggatatcacagacactctggttgcaggcaccatctcagagggggcccaccacttagatctccgaaccaagattgcctggatcctatgtctgtgctgtaagccgtccttggagcttgacttgagaatggtccaaa

SEQ ID NO: 246162 - DNA, 885 bp, Homo sapiens
  misc_feature (101)..(101): n is a, c, g, or t
  misc_feature (103)..(103): n is a, c, g, or t
  misc_feature (105)..(105): n is a, c, g, or t
  misc_feature (110)..(110): n is a, c, g, or t
  misc_feature (113)..(114): n is a, c, g, or t
  misc_feature (116)..(116): n is a, c, g, or t
gcaactgtcattgccataggaggctccggatggtggcatgcttgccgcctggtttaggatgaaatatcctcatatggtagttggagctcttgcagttctgncncnatctnganntngggatttagtaccttgtggtgtatttatgaagatcgtaactacagattttaggaaaagcggtccacattgttcagagagcatccacaggtcctgggatgccattaatcgactctcaaatactggcagtggtttgcagtggcttactggagcccttcacttatgcagcccattaacttctcaggacatccaacatttgaaagactggatctctgaaacctgggtgaatctggcaatggtggactatccttatgcctctaactttttacagcctttgcctgcttggcctatcaaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggcctgcacagaagtagtcatgcccttttgtactaatggtgtcgatgacatgtttgaacctcactcatggaacttaaaggaactttctgatgactgttttcaacagtggggtgtgagaccaaggccctcctggatcactactatgtatggaggcatggtcaggaggtggagttactaaggatatcacagacactctggttgcaggcaccatctcagagggggcccaccacttagatctccgaaccaagattgcctggatcctatgtctgtgctgtaagccgtccttggagcttgacttgagaatggtccaaa

SEQ ID NO: 246163 - DNA, 540 bp, Homo sapiens
acacaccaaaaaagggaaatcacaagacaatataaacctcgcttgaagaaacgatcgtgtttaacaagacagcaaagagaaatactctgagttgagccaagtagatgtgtgctgcttttgtagatggaataaatgatcctcacttgcatagacagcaaggtcatttttctcaccctaaatggaaggcattaatcatcagctctgaagaacaacattcaggacaagaagaaacaagccaccgcagcaggaggtattgaattgagccagagaactgggggccctgtggacgggagccagctcagcccaggtagcagctcccagatcagcaggggtgggtggtggagctggtcctcttgagccctaacagctttgttgggaactttctttgttcaagaaatctcctagttaccatccaagtgcatttctgaaatgcctgactgtgctccgggctctgtaggctctggattagctggttctctgtggaccccgtctgcataaaaagcaaagatcaaaggaacatggtagagctctttaaaaaaa

SEQ ID NO: 246164 - DNA, 1309 bp, Homo sapiens
  misc_feature (833)..(833): n is a, c, g, or t
  misc_feature (1082)..(1082): n is a, c, g, or t
tgtattctctaaagatttttaaaatattttaagttctggatacaagtgcaggatgtgcgggtttgttacataggtaaacgtgtcccatggtggtttgctgcacctatcaacctatcacctaggtattaagccccacatgcattagctagttatcctgatgctctccccgctacggcccctgcatcaggccccagtgtgtgttgatctcatccctgtgtccgtgtgttctcattgttcagcttccgcttacaagtgagaacatgtggtgtttggtttcctgctcctctgttagtttgctgaggataatggcttccagcttcatccatgtccctgcaaaggacatgatctcattccttttttaaaaaaaaaaacaaaattatttccataggtgtttggggaacaggtggtatctggttacatgcgtaagtaattaagtggttacttgtgagattctggtgcacccatcacctgagcagtatacactgaacccaatttgtcactattttcctctctcactgtggctataattctgtggcatatgtgatgatatttgtcagaggtagcagtgaattattagaattcacttcatcagaaagccctgatgaagaaagacacattttgttgttaagtttgttctgtttgaaaagtttctagtttcttgcacctagtagatactcaagttatgctttttaattgattggatttactgatcacagcaactgtttcagacttattcctttatttgacatgacattaacaatagtaaatatcagctattatcattattattcttaatggtatgaacagttatgtgataggtattaaactaaaanctttacatgtactgtaatttaatctgtatacctactattaatattgtcaatttacagtgggagaaattaggcttaaaggtttaatcatttgcctggggtcttccaactctgaagaggttaaaccaagatacaaactcatgtagtttttatgtgctacattatgttgcctccataatatgtaaaagtcatagacgtggccaggagcggtggctcacacctgtaatcccagcactttgggaggccgaggcnggcggatcacgaggtcaggagatcgagaccatcctggctaacacggtgaaaccctgtctctactaaaaatacaaaaaattagccgggcgtggtggcgggtgcctgtagtcccagctactcaggaggctgaggcaggagaatggtgtgaacccaggaggaggagcttgcagtgagctgagatagcgcctcaacactccagtctgggtgacagagcgagactctgcctc

SEQ ID NO: 246165 - DNA, 411 bp, Homo sapiens
gaaacacatttacagtcagccctccatatctgtcgtttccacatccatgatcagccaaccagattgaaaacattcaagataacataaacaatagaaagtaatacagatgtgaacatgcagtgtaacaaccatgtacagagcactgacactgtatcagataatcgagatgatttaaagcatatgggaggatgtgcataggttatatgcaaatacaagtgactcttgaacaatgcagggattagggctgtcccctacacatgcagttgaaatctgggtataactctgactccccaaaagctacagatagcctgctgttgactagaagccttaccaataacataaagtcagttaacacatgttttgtatatctgttatatactgtatttttaggtaagctagagaaaaataaaa

SEQ ID NO: 246166 - DNA, 1417 bp, Homo sapiens
atagcaactatgctcttttctaaaactagttttatctcacataattcttgagtaatttctctttctcccctaacccactgtgcgttgcattatttgaggcaccatgatatggctgcagatgccttttcgtgcacctgggtcaggatgggacctgcggaaatccctcctccttcccatatttagacagtgagacataccaaaggcaagtgaagcacatggtaatagagaaagctggcactacgtttgagctagtgatctgctggtgtcaactggcagtgttttttcaggtcatcctgcttgacccttatagatgtagagaagccaagtacagtgtagaaaacgtcaacttcctggtggtcacctaagtatttttttccccttcttttggaggggtatatggagagatttctactttaccaagaatgaagctggaactttaaatggtttatgtgtgttttataaaactttttaaaaacttgcaaaatcatatgttagtatattacagtttttacttgtgtcttgtctgcccagttgccaccacttgtaaattttttttttccataagcaagtaaaagttcagctggaagatatcttcttaattgagggttcaaaagccaggaatttaagcaaaagaggaaattcttctcaatattcaaaatacaaaaactctaaggagcatcttgttgactggtatattttagcattgagcatagtgcttgatactcagtgctccataaatactgattggataaataaaatgagatgtagaggcagtagtgtttattctcatttataaattagaagtaaacaatgtgatcacagtgaaaaatccttagcctgctttggataagaactttcactcgtgcactagagagagagggaatgtgggtatgaaagtgtgtgtgtgtatgtgtgtgtgtttgtggcattggcaaatagaagagaaggatttgtcttatctgctgatttaaaaaaaaagattttatgtttattatcaagaatgtagcacttaagatatatgcaacttaaaaaaactactgagtaaaattctgggttttgtccttgaaagaaaagtggcatttcctgcatgaaaaacagtttctattataaatgacaaaaaattgttagggagccaagctttgatgcatttactacatgaaggtcaaatacttaggtcattataattctgcccccttttgtgcatgcagtacaatgaagctctttgacatggtgctagcacattctcaagatgaaggaaggtcacgtgttttcaggcattaagagcatgatctactcttttttggttccctgttataagtggctgttgagggtaaagttgaggggagaaactggactaatgaatggcttttgtctacctttgtactattttttacttttcttgcacagaagtcaatta

SEQ ID NO: 246167 - DNA, 435 bp, Homo sapiens
agtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccaca

SEQ ID NO: 246168 - DNA, 909 bp, Homo sapiens
aagtgattctcctgtcttgcctcagcctcccatgtagctgggattacaggtacacaccactacacctgggtactttttgtattttcagtagagacggtgtttcaccatgttagccaggctggtctcaaactcctgacttcgtgatctgcccgcctcggcctcccaaagtgctgggattacaggcatgagccactgcgcctggcctggtttatcttttaattttaaaaaaggaaggctaacatgcctattgaaattagtagactctgccagtggtgccttgagttttttttttggctagcctgagaagggggttccatgtgttgtcttgaactgatgacagttcttgattacaggaataataatttgaaatagctctaacttgagatagaactctgtgatcctgcgaccagtgttctaatcgtacccatggtacgttagtgctgttgagtcagttaattcccagaaaaaatgaagtgttttttttagtgggaatgggggagggaaaaggaacacattccaaatatagaaaagtcaaattagaacatctgccatctttggcaaacgggctttcatggtctattgaccaattcttagttattatataaatgactgcaagacacaaatggtactgctgttgggtttggtggctttataagattctgtgtgttggacaactaggtttctcttctgtaggcttttagttgtgttgcagaagttccaaatcacctttgctgtagttgactataggctttttaatacatgaacacttaaggagaaaatctccggacccattgctgtaaaatactaaatgaagctgggcgtggtggctcatgcctgtaatcccagcactttgggaggctgaagcgggcagatcacttgaggtcaggagttcgagaccctgtccctact

SEQ ID NO: 246169 - DNA, 476 bp, Homo sapiens
gcttcagaacttctatttggttgtttgtgcttgacacacaactatttattaatatttattatctatttattaatattccctacagttcatacatcattctcctgactgcccttagttctctgtccatggtttccttcagcatcttgagcacagctaagacagttagtttaaaatctttgtttattaagtccagtgtcttgtcttccttgtgtatatttactgttgattattgcccctgtgaatgggccatacttttttgtttctttgtatactttgtatatttttgttgagaactggaagttttgaatattgtaatgtgctaatttaaaaaatcagattctccctctttcccaggaattggtgatgtttcttgtcgaagggtaaagttgtctgtgtacagactattttaagaatgggacatatggtaagccataaaataattttaaataaattttaaaagactaaaatcatgcaaa

SEQ ID NO: 246170 - DNA, 696 bp, Homo sapiens
cccacccccagctccttatgatccagtataagacaaagttatcttccatgaacagaagagatctggaattttaatggtgcttggtaattatgtacagcaatttttagccccaagaagacttatttgatagggggctgggagcactgggcaccagagtggagagaaaccctacgctggggttttgaagccaggctcaccttccgcagctcacccccttttctctgggccccaggctcctcacctatgaaagggtaatgaaaacaatagcccatctacccagtgagtcatggtgatctagtgaggtgaggaccgtggaatcccttggggaaatcaagatgggaaggttttgaaggtcacaggtcatggccagtgatgggctttggtgggcttcgggtacagataagtccccagctcatgatatttcaacttaatgattttttgactttatgatgatgcaaaagctatgtacatccagtagaaaccatactttgagcacacatataatcattctgtttttcactttcagtattcaataaattacatgagatattcagcattttattataaaataggctttgtgttagatgatttttgtccaactctaggctatggaagtgttctgggcctgtttaaggtgggttaggctaagctctgatgtttggtaggctaggtgtattaaatgtctttttgacttat

SEQ ID NO: 246171 - DNA, 346 bp, Homo sapiens
atggtattattctttaaatatttggaagaattaactgatgaagcaagccatctggggcttggaattctttgtgagaagttcttgaatagattccatttatttatgagatattggctattcagattttacttttttatgtgggctttggaaagttgtatttttcagggggtttgtctattttatccaagttgtcaatattttggtgtaaagacaataatattctcttatctttgttatatttgtgggatctgtactgatattcctttctaatattgaaaatttgtcttttttgtttctgttgatcagtattgtttggagtctatcaatataaataatattttcaaat

SEQ ID NO: 246172 - DNA, 440 bp, Homo sapiens
aggtggtgacaaatggtagccataattatttattgtcctctctgtccagactaaatgttcccttttccatattaaacatttaccattccaccacatccagctgagagtctgttcttaagctagtacaaagagtcagacccgactttgaatctccacttctccatttagctggatgatcttgggcaagttataaaatctgtttcctcttcactttataacgtgggtttcatgatcatacctcgccacagggctgttctgaagactggacatagctattttaaatgccaggaaaggccaggcgcagtggctcaaacctgtaatcccagcactggggagcctgaggcgggagaatcgcttgaacccaggaggcggaggttgcggtgagccgagattgtgccattgcactccagcctgggcaacaagagcgaaactccatctca

SEQ ID NO: 246173 - DNA, 331 bp, Homo sapiens
cactggttcccccagtgcactccaaccataattatcctgaagcctgcaaaagagaataatgagataaaggaagactgattcttgattaaaggagaaaataaagataacaattatgataagcaataatgattgtggtgatgatcagtagagaaaatagcacagacagcataaaactgtgagaagcaagacccacagctattgtaacaactggtgaataaagataaccttactggagatgaagaaaaaacaactagaatggcatttaactcagaagtaaaattccctagtaccctgtttggtacttagccaacgtgggcacctcttggaatta

SEQ ID NO: 246174 - DNA, 434 bp, Homo sapiens
caagtgacagatattggtccgtctggctacaaagccaaatgtcattgtgtttttgactaaggacaaatgaatgaagtgtacatactagtttaaaatatttattgaaaaattaatattcagtcatttattaaatgtaaaagatggcattaaaattcctctgtgttttgttggaggaggaaatacaagaataggtgtatcataggatccaaaggctcctgagaaggggttaacattgagagaaggggtagagaaaagagataataggtgatcagttgagaagatgataaatataatttgattactttaaataatcagtcaacatcagcaggtgtaaatgacatacatcagtacttttcttgttttgattaggcaggaagcagtagagtaatgattcccagacttgcattttgcacactagcaaaataaaatataaa

SEQ ID NO: 246175 - DNA, 588 bp, Homo sapiens
tttttggaatttgaggctgcttttgaggctttagtttactatcggtatttgggaaatgttccacgtgtccttgagaagaatgttttaatttatatgtggtataaaattctgtatctttgagcttcttacatggaatataaatatcattttgtccacttaatctgttattttgtgaggtgggttaaaatagaccaccatactttttgtttattctctttccacctgtagctttgccagtggttgtagtatattttctacattgttaggtgcatatatatttgtaattctttcttctttttactcatagataataaatcgctgtcttaataacataatgttttccatcttgtttggtttctatgttaattaaaatggctactttgttgttttcatattttcttaaaactgtatatacttactcaaatttttaaatgagttgaaaattacccctaatgtttcctaacataataattggtacttactgggtaatcttacatgcttgtaaagtttcttcattaaaactcagaggcatttgcatattagtatattctttattgcacattaatgtgtctttctggaattcattat

SEQ ID NO: 246176 - DNA, 597 bp, Homo sapiens
gaagcaaaagcagctggtcatcaataactcgcacttgctgcttgcctgcagctattacttgtctgatattggtaaagttctctatatttaaaggtgtctgaaaacactggcttatttataaactttgaaaggcagtagttaaaatggactttggtatattctgttcctcagagctgcatttacccctcaaacgcttaagccctatgagtttaatctctactgagattttagttgtatcaaccttgaatagactagactcctttaaaaggaaaagaaataatcaagtcattggaataaccttgatccctagacgccgccatttccctcaagtgagtgattcttattgtcacactaattaagtaaagacataaaggctttcccaatgcttttcacaagagatctttcctcgcagatttcattttatgaaatctgtaaaatgctaggaggcgtattaattaactgcagagatgctaaacatatatggaatacataattaattaccacatgatacacttaatactggaatactaaagagccagttctcagaaatttgtctagaaagggagtctttgtttctcaagaaagacaacatagact

SEQ ID NO: 246177 - DNA, 501 bp, Homo sapiens
aggattaaagagtttatcatattacttcccccccattcatacctataccactatttgtacccgaaaatgttacccaactcagtaaccatagtagtagacacatcaattattcaattcaaaaggaataagtaaggttttaaatttttactttctgtatggcaacgtccctcttaccctattctataacttctgttcttgttttcatttcctttcattcaagcagtagaaaaaatttggcactgtcacattccatcgaaaactcactctctgatgacccaactcttttttaaaactatccaaatctaagtgctctgagcatgttcaccagacaggcagcttcacaactgtaggatatttaggcaatctgttttattctattatatcttctccaaacttaattcttcttagttctgcccttctctttataaattttgcataccactaaaaaggatgatatacaagtttgcgggtattttcttgagttctctagtgctcagtcta

SEQ ID NO: 246178 - DNA, 698 bp, Homo sapiens
ttaataaatcttgccgcagcacactctctaatcgagctgtaacactcgccactgcggtccacagcttcattccttgaagcccgtgagaccacgaacccttcgattgagaagaaccttcggtgggaagaagacttctcgtctcagtaacaataacaagaaaaacagcctagactagacgcacatcaggaagacagtgtcggccacagccgcagaataaacatgtggagaaggtcattgatcaccttgactgaagcactgcagacaagataaagacagcctgatgcagaggaagattgaggactaaggggcttcatccacagatggcattttccagacagggtggctctctctgttagcgggcaggaccttctgttacttggatcattctataacaacatttagaagcagtggaataaaattgcaaaatgaaaccaagtccatttattcagcggaatcgaattgcaagatgaaaccacgtctgggaagcatatttttttacagaagaatctgcagtttagttttgtttattgcaacacaggtgcaaagggtcaacctcacctcatttatctttcagggcatgttattattattggtctgtgaaagaatccttttttgttcactcattatgttgaactatgtaaaattaccacttttgtaagataaaaaagcaatcaaatattaatgatttcaagtggctt

SEQ ID NO: 246179 - DNA, 783 bp, Homo sapiens
ttaataaatcttgccgcagcacactctctaatcgagctgtaacactcgccactgcggtccacagcttcattccttgaagcccgtgagaccacgaacccttcgattgagaagaaccttcggtgggaagaagacttctcgtctcagtaacaataacaagaaaaacagcctagactagacgcacatcaggaagacagttaatcccgtcatgtattgacccggaaacatcatctcatttgcctataagacagagagagagaatgatagaaatgctggaagaacgagccttggggcggtatcgcccagatctgaatccacacagcagctgcttcggtccctgtaactcaaggcttcctcttaatcctctgtcctccatcaacacctggctgagcaggaacaactatgacctaggaccagggccttcaggaatcttcacccctaactggaaacctctccaccaggatgtgtgcagagatgtcagcccctggtcaggcatcctcagccatctggcaccccctcaaagaggccctctgtcatctgccaatctacagtcgataccaccatgactttcccatagagggaattcccagaaaacagttcttgttctcgcttctagtccaattttccccagaaaaagtcacatttctgacaagacttgtttctgaaaagccactacgctgtcaactgccggtttgtcctgggcccccagacaccttcctctgttgtgtatgcctccgaaatacatttcccaggctctctcccaccggctttcagcaggttcagcca

SEQ ID NO: 246180 - DNA, 501 bp, Homo sapiens
gaagtaattctactttttagtagatttgcatctaatgtgactaacatgagatcttaaatgctgttagaattgagtcgttggtttaattagatcccaggcaggactgtaaactagttcaaccattgtggaagtcagtttggtgattcctcagggatctagaactagaaataccatttgacccagtaatcacattactgagtacatacccaaaggattatgaattatgctgctataaagacacatgcacacatatgtttattgtggcactattcacaatagcaaagacttggaaccaagccaaatgtccaacaacgatagattggattaagaaaatgtggcacatatacaccatggaatactatgcagccataaaaaatgattagttcatgtcctttgtagggacatggatggagctagaaaccattattctcagcaaactattgcaaggacaaaaaaccgaacaccgcatgttctcactcataggtgggaactgaacaatga

SEQ ID NO: 246181 - DNA, 362 bp, Homo sapiens
tgagacagggtctcaatctgtcacccaagcttgagtgcatggcacaattatggctcactgcagcctcacagtcccaggctcaagcaaccctgcccctcattctctcaagtagctgagaccacaggtacacacaaccctgcctggctatttcttagaaaaaaaatgtttgtagagagggtgtctccacattttgcccaggctggtctcaatcttttgggctcaagcaatccttctgtcctggcctctcaaaatcctggttttacagatgtgagccaccactatgcctggctgtgacatgtatatttaaatagatttaagaaactaaattacatgttacatgtttttacagttactttttaaaa

SEQ ID NO: 246182 - DNA, 413 bp, Homo sapiens
aagggataccactgtgaattgcagcctttgctgatgtagtcgcatgtcctcctccagtctgtggacattctatatctcttgctgctctcctcctcctggcatgataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacatcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgta

SEQ ID NO: 246183 - DNA, 513 bp, Homo sapiens
tttggatacggcagtgatctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatgggtctcccctggtacgtggctgccacggtcatctccatcgcccacatcgacagatcccacattgaccaccatatgccaagcactctaaatgtgtcacagttcacttacacctttgagggagatactaccatcatctccattttacagagaaggaaattgagtcttggagagatgacacgcttccccaagctcacacagttagcaaggagcagagcctggatttgagcctagttctgctgccttcagagcccagactgtaatagttcacctctttgctgccggaggactggggctgcctggagctgggtgggtgctttactcacttcttttacttgctcatctcctgtctgc

SEQ ID NO: 246184 - DNA, 370 bp, Homo sapiens
ttttattttgagtgttaaaacagctttggatttctggtataatcccactaggtcatgatgtattcgcctttttatgtattcctggatttgggctgatcatattttcttgaggacttctgtatctgtgttattgaaaggtattaatctgtacctttctttttttgtaatgtatgtgaatggcttggtatcaagttaacactggcctcataaaatgaattgggaagtgttcctttcttttatatttttgaaagagtttaaatgcaatttgtattatttctttcttaattgataggctttaccagtgaagccatctaagtttggagttttcttgtggaaaggttttaaaattatgaataaatttgttaataga

SEQ ID NO: 246185 - DNA, 274 bp, Homo sapiens
tccccccacacacacctccaccccgcaggccctcatttcctcttctctttccccttgacaaaagatgtttattaaacaacaacagcagcagcaatccacaggagatgaagtaaaatgatgaggggaaaagttggggattttaggacgttgtccgctttggagggggctctccttgcactctttgtagagatttacatgactgcgagcttccctgggcccctcagtagctgagggaggaggagagaggtgaataaaacgactgagtgtccaataa

SEQ ID NO: 246186 - DNA, 476 bp, Homo sapiens
cagttggtaattggtaaacattgtttatatgaccaaatgtagatctaatattgtacattattgcatcagggtatgtcttgtgacttccagatttttctcaggtataaacacagttttctaaaggcattttatacatttgttacctaaaatgaacaactgtgtaactgtcagctatacctagaattttttatcagaagtattttagattttggattttggagtatttgtattatacttactgtttgagtgccactaatccaaaaatccaaaatgtttcagatttttggattaaggatgtttaacctgtatatagaaagagacttatttagacaaacttgaaagactcatgtactacttacacatagggttttgttttgtttagttcaaagtttaagtgaatctcgctctgtcccagccaagatcgcaccactgcactccaccctgggcaacagagcgagactctgcctccagaaaaa

SEQ ID NO: 246187 - DNA, 440 bp, Homo sapiens
ggtctgttcatacaatggaatatcattcagccctaaaaaggaaggaaattcggacacagaccacaagatggataaatcttgaggacattgtgctcagtgaaataagagtcgcagtcacaaaaggacgaatactgtatgattccactcagatgaggaatctagaggagtcaaattcgtagagacaggaagcattcatagaatggtgggtgccagggcctggggcgagggggacagagagctggtatttaatggggacttagggaaaatgagaaaagttatggaggtgaatggtggtgaaggctgtaccacgatatgaatgaacttagtgctgctgaaaattatacgctcaaagatgattaaaatggtcaattttatcttatgtatattttaccactttgaaaaatgtttaataaataaaaataaatttttaaaaaaggctg

SEQ ID NO: 246188 - DNA, 493 bp, Homo sapiens
agagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccc

SEQ ID NO: 246189 - DNA, 356 bp, Homo sapiens
caccacacgggaccattatggggctcacaaaggatagtgcatgtacaaaggtcttgtaaattgtaaagggctgtaagtaaaagtaaaggtgtattgttattaattcctggctcacctcccaaggagactctgggtaaataagataaggttgaagtaatattccaagtgattaaggccaaggtgagggctttggactgaaggccaagttcaagcctgactctctctcacggggccaggccattgtttagttcctgattggagagaagcctgagtatctcttcagtgcctcagtggggagagtgtaaatgagggaaaagttcaaaataagacatggcttgtttgcttgccctactgct

SEQ ID NO: 246190 - DNA, 238 bp, Homo sapiens
atctgcctttttctgtacttgcttgtctttagttttttgtttttgtttgagacaaggtcttgctgttttgcccaggctggcctccaactcctgggcacaagcaatcttcctgtatcagctcccagctactctggaggctgaggcaggagaatcacttgaacctgggaggcagaggttgcaatgaactgagatcgtgccactgcactctaacctgggtggcagaacaagactttgtggc

SEQ ID NO: 246191 - DNA, 289 bp, Homo sapiens
gaacccaaactctgcctctattctggaacccaaactgtgtctccatcccagaacatctcgaaagaagcagaggctgttctgaagggtggggtgatagtccccagactgcggggagataccacacctccaggaccagttagaaaacattaataaaacctcagaattagacagctttacaatcagaggattctcgagaaacagtctctcttctagtgtcctcattttccaaatgagagcaatgaagaagccaagaggaggcaaatatatgttcaataaaaataggcaatat

SEQ ID NO: 246192 - DNA, 399 bp, Homo sapiens
gctgaagtgcagtgttgccatcatggctcactgcagcctcaacctcccaggctcaagagatcctcccacctcagcctcctcagcagctgaaaatggccttggtggctcctctctccttaagatcttaggatttgtaccaactcatcagtagttttacaatctgcacagtacttgtacatctcatttcatccccacaccaaccctaccaggcaaggatcactggcctcatttaacaagataaagatgaggatactcctagttttgctgagtcctttaagacggctcagttgaaaaagtaatagtgccagggcttaaaccctcatctctaacaccaaagcctaagctcttcctgttaacagtacataaaagtcaaacccaaaccacaaaattgctggggaa

SEQ ID NO: 246193 - DNA, 470 bp, Homo sapiens
aaattctctaaggctagtacattttctgcagcttctcagtaccagatttgacctcagattctgtccctagacatagaacattccatggtttcgaccaccaaccaaacacccagctttctatataatgccgtagtttcctttccctgtgatttttgctgatatacatgtgtctttgtttatttaaatgttttgtaccacctcagtggtttatatatggtgctgcaattttccaagtattttttttttgcctcagtgaagttattttagagaatatcttagattaataaatctttggattagagtagacatacgtaaatgggatttggaatgcaattatttaactggaaatcttcatgggtttatcataaaaggagaaagaaccctctaggtgttgatagggcattggaaaagtggccagtaaattcatttcaaaatgttaggataaactcctcagatagatccaaacatta

SEQ ID NO: 246194 - DNA, 492 bp, Homo sapiens
tattttgtcctgttatatagttgtcacatgtatggtgttatggatttattaagtgttcttcataaatattaggattttataatttctcaatgattgtacatgattaaggtactgttctttttattgtcttaagtttacctgaaaatcggcctaattttattaaatacatattctacccagggggagtggtttaaagaattatctgctttgtctgggcgcagtggctcacgcctgtaatcctagcactttgggaggccaaggtgggtggatcacctgaggttgggagttcaagaccagcctgatcaacatagaaaaaccctatctctactaaaaatacaaagattagccaggcgtggtggcacatgcctgtaatcccagctacttgggaggctgaggcaggagaattgcttgaacctaggaggcggaggttgcagtaagccgaggtcttgccactgtactccagcctgggcaacaagagtaaaattccttctc

SEQ ID NO: 246195 - DNA, 258 bp, Homo sapiens
ttgatgtgaaaacgtttcccaggttttttatcttaagcacattctaaggtacagaacaaaaccccttcaaggtttagtcccacactgccaaatccatggacctagcttccttcgtcttttctttctcctaatcctacccctaaggatcacaccaaaccactctctctctaggaactcctctcaatatatactcaataaaaccccagagtcagtttctttccacctcagtagggctcaatggtgtattagactaatctc

SEQ ID NO: 246196 - DNA, 514 bp, Homo sapiens
ctggaaggccaacgctgttcttatcactgctacacagagctgaaagcaatgttagaactgtgggttaaaaagaaactagtcaagttcttcaacggatgaatggcgttatctttgccatgcaatcctactcagcaatgaaaataaactgactattggcacatccaacaccttggctgaatggcaaggtaattgtggtgacagaggaatgccagtccaaaaaagttacatagtgtgtaattccacttatactgaatttgtaaaataacaaaattataggaatgaagaacatactagttgccaggggttaaggaggcagcagaggcagaagacagctgaatgcaattagaaaatggtgacagggagggccctcatggtgacggaaatgttttgtaccttgactgtggagatggaaacgtgaatgtgtgaaaaattgtacaacagtgaacacacacacagacaccaaggaatgcaaccaaaactggagaagtctaagacaatatcaatatcagtatct

SEQ ID NO: 246197 - DNA, 416 bp, Homo sapiens
cattattagtcattagagaaacacaaatcaaaactacaatgagataccaattcttacacattaagttggccattatcaacaaaatggaaaatagcaagtgtttgcaaggatatatggaaaaattggaaccctcatacattgttgataaagttgtaaatggtgaagctgctgtggaaaatagttgggcaggtaaacataaataaaagttagcctattatctagcagttccattcttaggtatacgtcctaaagaatttatgtccaagagaattgaaagcatttgtcacacaaaaaccttgtacacacatattcatagcaatattattcatgatagtcaaaatatgaaatccatgcaaatgtccatcagctgataaatgcacaaacaaaatgtggtatacccatacaatggaatatca

SEQ ID NO: 246198 - DNA, 469 bp, Homo sapiens
tctttgaaaagataaataagattcataaaactccgtcatgactggcaaaagaaaaaaaagaaagaagatacaaattacgaataccaggagtgaagaagtggctctcgtacaggcattaaaacgacaataaggcaatgctacaaacaactctacacgcgtaaatgccaccacttaggtgaaatgaacaaaacacaaaccacagaaatgcacccaagataaaatagatgatctcaacaattctacaactattaaagaaactgaatttgtgataaaaaccctctggagtgactattttaacaactgaatttgtagttaaaaatcttcctgaaaaagaactctttaggcccatatggtctcactggcaaacttcgccaaatatttaaagaaggaataacaccaactttatacaatttctttaaggaaatagaaaagcaggcaacactttccaactcattgaatgaggccagca

SEQ ID NO: 246199 - DNA, 391 bp, Homo sapiens
aaacaaacaatcactatataccccataaatatgtataatgattatgtatcaattaaaatacataaaagatagagcttatgaaaggaaattgaattgagaactagggatttgagattaaggaaaaagctaataattacattaaaaaatttaaaaagtggggtttaacatggataaatgatgatagcttgctaagaaattaatattatcaactcaattctgtacatctgaggtaaaaaaagcctctgctagtaattcactgaactataccacttttggaaagaattccacttttattttatagtttgattaagttgtctataccaacataaaataaatttaacatttttgcttcaatcttgaataaaatttgttttcaatgtattttattaat

SEQ ID NO: 246200 - DNA, 595 bp, Homo sapiens
tcacgatcgagctcggtacccaggtcttttcccctcaaacaaataacgttgtatacagaaaatcatgaagaatctagaaaaaattactagaactagtaagtgaatttaacagcgtaacagaatataaagtcaatgtacaaaatcagttgtatttctacactgatatacattgaatttttaagagggagataatgcagtggtattaagtccaaggctagctgagaaaccccatggtgtcatagtgatctaaaattcttctgtcttttctaccatcctagagtatggtctcattcttcaaagtgacctcatggtctgtgacagctgctgaaacttaagctatcagggtcacactccaggctggaatttggaggaagggcaaattataaacacacacacacacacacacacacacactcacacactttttagctattttagctgtcttttagaaaatccttcctttttttttttagacggagtctagctttgtcacccttgctggagtgcagtggtgcaatctcagctcactgcagccttgacctctgaggttcaagtgattctcctgcctcagcctcccaagtagatgggattagag

SEQ ID NO: 246201 - DNA, 491 bp, Homo sapiens
gtcctgggcgtttcttaaactgatggcaactgcgtgtgccctggtggtgaaatggtgttgcagtatgcctgggcactgccctgtgaaaaaggacacacagaggggagactcacagttttgttttcattgctgacatggtttaaaaatgtacgttgctagctgtgaaaactcagtcattataacaccgtacacctttcttctttcagcaagtattccttgtgaacattagcaagtattctattctctgttagaattaaacaggtaatcgtaatagcatgaaagggtgaaagtatgtcttatgcaaaatagcctcttttatatagggcatctaccaattttcttgtgatttttgttttttcctcttttgaaaaatgattttagtctgctcgtgtttaggtaggtaacttctcttgatcccaattttatactttaaatgatcccagatattgcattttaaatgagatgagtatataaaaaataggaagcagaaa

SEQ ID NO: 246202 - DNA, 1835 bp, Homo sapiens
  misc_feature (9)..(9): n is a, c, g, or t
  misc_feature (497)..(497): n is a, c, g, or t
  misc_feature (692)..(693): n is a, c, g, or t
  misc_feature (1787)..(1787): n is a, c, g, or t
  misc_feature (1833)..(1833): n is a, c, g, or t
ctaggtacncagctgacactaaatttttagaagtaaaacaagctgtgttataacaccagaacctggaaggataactgctgggtctcagtcctctcctttctggaaacagacacctgggacaagagagaagcagctagggactcctatgctggctgaaccaaggtagtggtgcaggctgtggaggtgggtgcagaaccatagatcttcagaagtgtcgatttcctcctcccttgtgtgccaggtgggcagtatgcatcgtctccatttttctgatagaggggataatagggtaacggggtttgaggtcacaccaggagaaagaggccagaaagtggaccaggagaaccattcatgccttggactccagtcccaggggcctatactggatctggtaaagagtaacagctaggatagccgggcacggcaaatcacacctgtaatcccagcactctgggaggctgaggcgggtggatcacgaggtcaggagatagagaccntcctgaccaacatggtgaaacgccgtctctactaaaagtacaaaaatgagccaggcgtggtggcgtgcacctgtagtcccagctactcaggaggctgaggcaggagaatcgcttgagcccgggaggcagaggttgcagtgatctccgagttgagatcgcgccactgcgctccagccttccagcctgggcaacagnncgagactccgtctcaaaaaaaaaaaaaaaaaaaagagtaacagcgatcttgtttgccaatgtatccagacacataatagtaaacatctggctgggcacagtggctcatgcctgtaatcccagcactttgggaggccgacgcaggcggatcacaaggtcaggagatcgagatctggctaatatggtgaaaccctgtctctattaaaaatacaaaaaattagccgggcatggtggcaggctcctgtaatcccagctactcaggaggctgaggcaggggaatcacttgaacccgggaggcagaggttgcagtgagccgagatcgcaccactgcaccactgtactccagcctgggcaacagagcgagactctgtctcaaaaaataaattaattaattaattaaaaaataaacatcccatcttcagtgaaggatggactaagaggaggagggttctgtgacagagcctgagttctcatttgcctatttctgttctttcattgctggcagctctgctctcctgccaggatgagggacctctgcccacttgctcttggtggtccagagatggctttggttagaaaaaggacagaagattagccactccttgtgtaggaagtcaggaacagctccattcccccagctctcccgggcagtatcagaagccccaggttgcctgctgggagatgcataataaagctcagtcctgaactaaaccaacacatcacctggccctgggtatagaagtagtattgtgagggggatcttgggtcttccaggccaggtgtaagcaaatgtagggagttcagccccaggagagataaaagaatcatgccatggccaggtgcagtgacttatgcctataatcccagcactttgggaggccgagatgggtggatcgcttgagcttaggagttcgagaccagcctgggaaacatagtgaaacctcatctctacacacacacacacacacacacacacacacacacacacacacacaaagccaggtgtgatggcatacatctctagtcccagctacttgggaggctgaggtgggaggattgcttgagcctgggaggtggaggttgcagtaagccaanattgtgccaccatactccagcctgggtaacagagtgagaccctgtntc

SEQ ID NO: 246203 - DNA, 401 bp, Homo sapiens
gattgtttcagcctgggagtttgaagctgcactgacctgtgattgcaccgccatactccagcgtgggccacagagtggagcctcccatctcagttaaaaagaaaagaaaagaaaagaaatctggtaggccaggagtggtggcaggtttggctcatgcttgtaatcccagcactctgggagtctaaggtgacaggattgcttgaagccaggagttccagaacagcctggtcgatctaggcagaccccatatctacaaaaaactaaaaacaaaattagccaggcatggtggcagtacctgtagtcccagccactcagaaggctggaggatcacttgagcccaggaggatgaggctgcagtgagctatgatcatgccactgacagagtgagaccttgtctctta

SEQ ID NO: 246204 - DNA, 727 bp, Homo sapiens
agcgggctttgctccacttggagtcagctgattggcaggagggcatctgaaattgagaggagatttcaggacgtttacccagccctttagtggggatctgtccgggactgtgcagtctgaacctgcaactgtaaaagtgctgtttggactgtggacaagttaggttataaattttgacctctgaatggacgcaaccaatattagcctttaatgcagttagactcatttgtcagagttctggaaaattaggaaaaactaccatatgtccaagccttcatgcttttcgaaaatcaggattcataccatgagggaagatgccagctgctagctgtaccaaaggacagaatggacaaaaaggctcttcacaagccagagagccaaactcaggcagaaagcaatgaagaagaattaggacttttaaatgtcctacacccaagctgttttagcagctccaaccagcacagccagaacgcacctggcctctgctccacctcaacagctcccactgcagtaccaccatacggggcccttagcactggcctctgcgttggaccggattgccttgatgctaccaagtgaggcatcagaccaataagagggagctactctgccgcctcagtataatgagagaacagagacggcctctccctccagtgcttgacagggaacatgatttagcaaggaattgccatggccggagcaaaggaattaccgtttacagggatgg

SEQ ID NO: 246205 - DNA, 409 bp, Homo sapiens
atacacatttatctaactgtatgctggcgaaactcacacaatgcataattatctaactatatgcctgtcaaaaaataccagaggctaatttaaaatgaatcaaacatacaggcccagctgtggtattgtctctctcttaaagattgcctctggatggatacctatggtctggcactatcaagatggtatcagtctgtggctccaggtggaccataactcaagatacacatgggagtaagacacagactccctgaatctgcacacctcctgcatgcctcccatgttatgcattatgcttccctttctttaaaaacctgccctcagtccaaccttgtgaactggtttatacaggtgtcatccagccatttccctactgctggatttgaaaaataaagtcactttcctttca

SEQ ID NO: 246206 - DNA, 404 bp, Homo sapiens
agcgggctttgctccacttggagtcagctgattggcaggagggcatctgaaattgagaggagatttcaggacgtttacccagccctttagtggggatctgtccgggactgtgcagtctgaacctgcaactgtaaaagattgcctctggatggatacctatggtctggcactatcaagatggtatcagtctgtggctccaggtggaccataactcaagatacacatgggagtaagacacagactccctgaatctgcacacctcctgcatgcctcccatgttatgcattatgcttccctttctttaaaaacctgccctcagtccaaccttgtgaactggtttatacaggtgtcatccagccatttccctactgctggatttgaaaaataaagtcactttcctttca

SEQ ID NO: 246207 - DNA, 299 bp, Homo sapiens
aaaagaagcccttggagttatgtgattcctggtaaaatctaccacactttacttccagctccacagcctctcctccagtccacaagtgtgttagttcgtgttcttttggaagcagatgccaagacagagttagaagtgtaagatgtttattatggaaagtgcctatggaaagtaatagggaaagggggcagctgtagataagaaaaacctctgacccagaaatacttttgacatctgtgaaaagagggggagatggaaagaggatttggtaggaagagcctcagatcatagggcagccc

SEQ ID NO: 246208 - DNA, 463 bp, Homo sapiens
ggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggtgagagcaattccaggggccggaggtctcacgctgggaaggagccccacctggcctctctcccgggggtcctagtgagtggtctagaggctgctggcccaagagccaggctcaggaacaggaagccatgcagatacccagcatggagaacccggcaatacccatcccagcttttgattaaacaaaattaccaacaaatattaaaattttgattttcctgttcg

SEQ ID NO: 246209 - DNA, 2002 bp, Homo sapiens
  misc_feature (1263)..(1263): n is a, c, g, or t
ggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggangccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggcaaag

SEQ ID NO: 246210 - DNA, 1985 bp, Homo sapiens
  misc_feature (1246)..(1246): n is a, c, g, or t
ggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacgggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggangccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggcaaag

SEQ ID NO: 246211 - DNA, 1017 bp, Homo sapiens
actctcttattttccttcttctgtcctctcctgttgtttgtttcgctcctccgcgtcgcggtccacatctcttgttgtggtcccgtcgtggttctgttcctgtcgtcgcctcccgccgtttgcgcctttcttgtgtctctctcgtcgttctgttttcgtcgttgcgcttttcttgtctcgcgacggtcttggttgtcttgtcgtgggttagttttctttcgctgttgttctctcctgctgttctgtggtagtatcttgtgtctgtggttgtgcgccgctggtgtggtgtgtttcgtctgcgttgttgtggtgtgtttttgtgtgttgttttttgtttgtgttttgttgttctttctttttttttttgtgttttgttttttttttttttttttttttttttttttttttttttttttttttttgtttttgttgttcataaaatgattttaatagaaaagtacaagatatgaacaaaaataaataatctttatctcatttctagcccagcaaattgtacactgcatataaaaatggtctaagatgcaattttcctttcaatcttaatattcacaaatcaaaatctattaagtaaatttaagtaaatctcttctcctatccttgaaagctttaactgctttctctatgctatctcaagcttcattgtatcttggacaatgtttcagacaacagaacttgtattatacaacatttaactcaatatttgaataatcatagaatattgtattctatcttgattctacaatccttcttaatgatggccaatatttcactagctgaatggcagcagacattaccacttaaccaattaaactattcctttctagaaccacctaaataagcacattaaagaaaatcattatgagtaaaaggagggtgcacatgaactggtaaatttcatttcttagttaaaagtagccataagagatatttctaatttcaagtttcattgttgttgctataccaacttttcatggtgcaaaaaccaaaaaaagtttt

SEQ ID NO: 246212 - DNA, 556 bp, Homo sapiens
ggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtac

SEQ ID NO: 246213 - DNA, 742 bp, Homo sapiens
gtaattgggcttctctcatctttaacaattttatggattcaaggatcttgaggggtaggtactacctctgctgtacccaaaattaactgagtttttagtacatgtcaagggtttagatcagggaagaagagccctagagagttattcaggtgatattcttctcagagagttttaatcattggtataactgtttctccaaagaatagggaatgaatctctttgaaagattatacctgaggtttacaagctttcacttagctccttctaggcagcttctctcatcatagtgcacttaatcaattagaatacaaaatgaccttgttacagtgtgaggacatcttgtggtcagaatgctatataggaaattaattgcaaatataagaccatcactcactttacccccagttcagcctggtagttcttaattttaggtatctctagccttccttgatatcaatctaggttcctcttctaatactagagctaaatctttcagttctcttatttattaaagaaggaatagagctctttacttgcgaggaaataggctcttttcacaatcatctgacacctaactttgtagtctcagcattctaagtaacagcgatctttctgcacttgtctttctttcctggcatacatccccagacaaatgttcaagggatgcttttccctcctttcttactcagtgtcttcttttcttcagatgcctttctgaagttgcttagtttctctaaaatat

SEQ ID NO: 246214 - DNA, 275 bp, Homo sapiens
aagacaatcagtttttgccattcccaagtcactcacgtgttggaaatatcaaagactttaaagcagttatcatcaccattatccatgaagcaaaggtgaacccttttttttttttatttttgagacagagttttgattttgttgcccaggctggagtacaatggcgtgatctcagctcactgtaacttctgcctcccaggctcaagtgattctcctgcctcagcctcccgagtagctgggattacaggtgcctgccaccatgcctggctaatttt

SEQ ID NO: 246215 - DNA, 972 bp, Homo sapiens
tattctaacaccaaatatatggagtttgctgaacatcaaccattctccaacacaaactgggtgtccaacaactcaattctgaaaacacccaggtcagcatagaccccactgactcaaggctgagtcccacaacactgcttccattccacatgccagtcacaagccccagggacccatctatacttctgaggaactgtctataaattataggcttccataactccctccctcaagttaaaggatttgataaaactactcacagaacttggcaaaaacactttacctatgtttactagattattatattggatacaactcagtaaatgctaagaggaaaaaacacataggacaaagaaaagcagggaaaacatgatgtgggcagtgaatcatggtagttacgactaacatctctcaaatcctttgtgttctgcaagaaaagcttactgcaaagaaatacccttttcattatgacttttatgatactccctctttaggtatcacaaattcacagattctacattctcatttttccctcataaataattaataattttgtcttcagtgttcagaatacttgttaaccaaactgctcaagtttctctccttctcccaggcccctggactatgctccaccttcagtctaagccagcatacaaccctcttgatgcccctcccaagaacaggctgacttcagggtgaaacattctctaatcttgaatctgattttgccattctcattctccattctgccttctccctcccatcttccttctaatcgtttgatcctccatatgaaaaatcacccttatctgtctcattttggaggtgcttgcagatcttgtgcttagtgctttttccattgcaatactccttaaaataaagtcacttcttacctacatcagaatttattttatttgatgatatctagaaacagcccgatgacaataacaattacaccctctcagaggacat

SEQ ID NO: 246216 - DNA, 340 bp, Homo sapiens
ttttacatctgttactataatcagttttaaggtattattttttgagacaggatctcactctgtccatgctggcgcgcaatggcgcgatttctgctcactgcaaaccgtctctggggccgaagtgatcctcccacctcagccccccaagtagctgagactacaggtgcgagccaccaaacccagctaattttgtatttttttgtagagatggggattcatcatgttgcttaggctcctgagctcaagcgatccacctgcctcggcctcccaaagtgttcggattacgggcatgagccactgcgcccagcctgggcatttttataattccctaagtaacccc

SEQ ID NO: 246217 - DNA, 181 bp, Homo sapiens
tattgtatgagtggctgtacaagggatctctgtggtgatagaaatgctctctatcaccattctatcaatgtgaattatctggctgtgatattatacaaatgttcaagatgttaccatggcggaggacactgtctaaagactgtacaagagctacttgtattatctctcacttaatgtggat

SEQ ID NO: 246218 - DNA, 1444 bp, Homo sapiens
ggcatcatgaaacggggtcctgagattttattttctttcacggtggttaaataaatggcctttagagtttgatagagttgggtctgattatcaactttagcactgtgtgctgtatgacattgtctcttcacatcactaagtctattttcttgtaggtgaaatatgaatattgacaaagttggtatgaggattaagtgagataatgcatttaaagcacatagtctcaacaaacaatagttatgactgttattatgatcattgttactattcttgaacgggcagtgaatacattgtgctaaccctggacctgccagataggtgtcttctgccctttcagattcaggatgttctcccgtaaagcaaaacaaaaacctatcctgaccttcttggatgattcataaacacttggtgaacagtttttactacacatttgttccctgatagccccttagaagtctgtggaactggctgggcgtggtggctcatgcatgtaatctcagcactttgagaggcagaggtgggcggataacttgaggtcaggagtttgagaccagcctgaccaacatggtgaaaccccgtctcaactaaaaatacaaaaattagccaggcattgtggtgggggtctgtaatctcagctacttgggaggctgagacaggagaattgcttgaacccatgaggcggaggttgcagtgagtcgagatcgcgccactgcactccagcctgggtgacagagtgagactctgtctcaaaaaaacaaaaaacaaaaaacaaaaagaaaactgtggaatagttgcctgagtctttgggtgtgagatacttatgcagcacagcagcttcaatactgtgctctgaaatctcgggtctagttactatggaatggaaagctgaggacagggagtagaaggagattcttcagtagttttttgaactcaacttgtccattccagctaaactttatttcttatgcaacataagtctatgaaggcaagatttttcttggcagcataattactgctacctaataagggaagagaatttccttctaaagattcctgctgttttctcagcaggtgggaacttttgcactctgcagctgctgggtgccattactgtccgtcctgggcttgctctttccattctgagatgggaatggaaaaatccacagggaacaattggtaattccatcctgatttgtatgcattttggggtgttggttttgttttgttttgttttgcttgctttttttttgtttttctttggtacttctattctgtaaccttgtcacttatattttttgaaaagtcaagatgcatcgtttgatacataattaaatatttgaaaacagggactgtcccggaactcttggactttgggctactgtgtgcataacctcgtggagggttctgagcagctctgtccatctacatgtgaaggatcaaaggg

SEQ ID NO: 246219 - DNA, 387 bp, Homo sapiens
acagatatgtgatattccctaatagggctgaacccttcttattcagttacctttggttggggaagaggtggtggattaggtcaatttgaggcagcaaagagcattcttgtcataccttgttgtgcatacaggttgagtatcccttagctgaaatgcttgggactagaagtgttttagatttcggattttttgtcagttttttggaatatttgcattattaccagttcagcatccctaacctggaatctgaaacgctcaattagcatttcctttgagcaccacgttggcactcaaaaagtttctgattgtggagcattttgatttcaaatttttggactagggatgctcaacttgtattttcaaacatttccctaggctatatatgta

SEQ ID NO: 246220 - DNA, 455 bp, Homo sapiens
gagatattgatagcacctacctcactgggttgctgtgaagattaaatgagataattcatgtgaaatgcttaggacagtgtctggtaggcactaagggcccaataaatgttggctgctaatattattaaaacaatttggtatgctgggggatgtcttagaagtatgtagagtagaccaggtacagtggctcacgcctataatcccagcactttgggatgccaaggtgggcagatcacttgaggtcaggagttcaagaccagcctggccaacatggtgaaacccggctctactaaaaatacaaaaattagctgggtgtgctggcacatgcctgtaatcccagctactcaggaggctgaggcagaagaatcgcttgaacctgggaggcagaggttgcagtgagccgagatcgcaccactacactccagcctgggcaacagagtgagactctgtctcaa

SEQ ID NO: 246221 - DNA, 208 bp, Homo sapiens
gtctggggcagtcttttgggactgagccattagcttgtgggatctgattgtaactccaggtagatagtgtcagaatgaaattgaattgtaggacacccagtcggtgtccagagaattggtgtgaggaaaagacccacacatttgatgtcatcagtgttgagaatgaaaaaaagctcggaatggcacatagtagatgcttggtttcaat

SEQ ID NO: 246222 - DNA, 259 bp, Homo sapiens
acagggttttgccatgttacccggctggtcttgaaatcctgggctcaagcgatgtacctgcctcagtctcccaaagtgctgggattacagcaatgaaccaccacacccggctctaaacatcatttcaaattgtcttaacaaaatttgcaggacctcataattggcctaatctgacccaaagcttggagctagtgggctacctgaaaagtatatagatctatcagagaagaataattgttttagcaccgtgaacttaagt

SEQ ID NO: 246223 - DNA, 401 bp, Homo sapiens
ctcccacaaggtctctgagttcagagatgttaacagtttattgccacatccatttaatattttcggaccacagatgaccacaggtgactgaaactgtggataaggaggggctgttgtaattatttgggatatactgctagaacattcatagtttacaaataacaagaatttccgcttgctagaccaagtatttcctatgaaaggataaaatccacatgctatagcttcagtgactcaccctgaacacttgccatgtctcagggacaaagtcaggtatctgtgctaacatgtgactagcaacctcaacccttcatcattttcttactgccttagtatgtgatttaccttacctggcaagggccaaagctatggagagtgagctagctgacactcaaccgtgc

SEQ ID NO: 246224 - DNA, 775 bp, Homo sapiens
aggaaggttctcagaatgggctttcctaatactcttggttcagtagtgagagtttcttaggaggttgttgtcacttctactactggcttttgccatctcctcacagacaaggattaaaatcactactgttgatttgccttttggcttatattacccacatgcagggtaacagagcttttactctaaaattaattcgttgaatgtttaaaacacttcttttgaggagtagagtcttaatgttaatgatggtaatgcatcctttcagaccggccaagcacagagcttcctcagtttggaagtgatgacagtactagtgccttctcacaagtaatatttggcagatattttaagttaggtgttcacatttttggagagatggatttttagtccaagctttacagctgtgtgtaagatctttctcttttgacccactattgataagtccatatatgctattagtatatttactaatttatcaaatactatgctaatattagttagacaatagtcaaaatagatacggtccctgtcctcatggccctcttttaatcttacagataaggatattttttgacatgtcgtcttgagtttaaggtgataggttttctctagcctgtagtagagaacatcagaaatttacctatacagactttcttttgcctgacttatacacaaaagataatttttcaccgaagttgatctaatttacaaattgccgtatgtttcaaagaaaacttttgggcatctaaaagaattcataatacaaaaaaaaaaa

SEQ ID NO: 246225 - DNA, 215 bp, Homo sapiens
caaaggctggggctctggctccaacctgggagttgccccaggggcttctggaaagggagaggcatccctgggaccacacagcacctgctcaggcctcaccacttctcccctctgcctgcctcaatgtccccctgagtttctgcccacctgcagatgtctacctgtggccccactgctgtgagtggggtcccacctgtgtctctacacaggcaccc

SEQ ID NO: 246226 - DNA, 141 bp, Homo sapiens
tggagctctgcagacactgggaccagaggtgaccttgaggatggaagccatgtgttgggaaaatggaacagaaagatgagtggaacttggactatgaatgtctcttgccatacttggactgtctgcctccagacatcctct

SEQ ID NO: 246227 - DNA, 555 bp, Homo sapiens
tcttatttaatgtgagagaaaaataaatttcttatttaagctactcttccttctgttactagcaactgaatatagtcactagagggaacagctcagcatggcaattaagaggatggactctggagccagagtgctcaactctgaatcccgctttgctgcttactggctttgcaaccttaaacaagctacttaacctcttcatgtcatagtttcttcatctgtgatgtgtgggtgataagagcctacctcataaattaatgtaaagattaaattagttgaaacatatcaaatgttcagaagagtccctgcacacagctgaagccagagcacatggtagcgttattatgcctgacagacccaggctaagtaaatgaactatttgtacaatatgagaatgataaactattagagatgctgtattctagtctctttatttcatagttgatgaaactaacatgcaaagaggtgaagtgccctgtccagtcacatacctgtgggacagcacagctggatataaacccagaatcctgctgctcccaggccaatgtctcatca

SEQ ID NO: 246228 - DNA, 534 bp, Homo sapiens
gagaccaattcagatcatctatttaacaaccctgtattagaattcaggggcttctgggtttctagacttccagatctttctgattccagccattttcttgcattatatttatgatttggttgcttggctagaaaaccagttctttccatagtgtcctgaatttatgaataatatcatcatttgattccctgtaatcatgttgtatcttgaagggttatctttagatcagaccttttttgaacctccagatttgaatgtccatctgcctgtttaacatcatcacttagaagtaccacagaatctcacatattaacatgtcaaaatacagcttcagattttcttcctcaaacctttcccccagtttttcctcatcttaatcaatagaaaccttattgtctcagttgtttaaattagaaataattaggttattttttatttctctctctctctttgtgaacttggaatttattagtaagttctgtaaattctaccttcagaatatgttcggaatctgaacttctaactcaaccaaaa

SEQ ID NO: 246229 - DNA, 533 bp, Homo sapiens
tgggtgggaggaactgcagttaaggaaagcagcacaaacacggctgctctgcctactgctattactgtgtgtagaaactgtcttttgtctctgacccagaggatttgtgtcttctgccaacattaatgaagctctagcaggctaacttgttagcctgaaactaggatgaaatttcagatccttcacagtactttacaaaggatcccaactaaagagcaaaatgaaatacaattacagtcatgagccacgtcacgacattctgtcagtgacagaccacatatacgatgcagatcccctaagattataatagagccgaaaaattcctgtcgcctagtgacaatcccaaccctttgtaggcctagacaaagttatgtgtttgtgttttagggttttttttttaaagtttaaaaagtaaaaaaaaattaaagatggaaaaagcttatagaataaagatataaaaaagattttcacacatgtgaatgatgtgattgtgtttcaagctatgtttttataaaacagtcaaaacctaaaaa

SEQ ID NO: 246230 - DNA, 280 bp, Homo sapiens
atttttgaaattccattccatagtaaacactcttaaccacatccaaattgtttaacttcctcctaaactaacagctgagtgtctcacaagaaaaactgcttgtcctgttgcacttatagtcattcactgatatactgatattcctcatactggtaactacagtttagacattatccttatataacttccaaacaacatttttaaaataaacgcttcattaaatcacacacacacacacacacatacacacacaatcataaaaccaaataataacagtgac

SEQ ID NO: 246231 - DNA, 445 bp, Homo sapiens
aggtctagaggcaaggcctggtagtccgtattttaataaaagctcccagtaggattcagatagccagccgggcttggaaactattcactgatttgtgtcccctcacagtaaaaatgctctttccccaggtacaggatatatggccatctggcctggatatcagtggtttgcagacctggctgcaaattagaatcacttggggagcttggagaataaatactgatgtttgaccccacccccaattaaattgttggtggggggagtagttaaaacctccccagttgattctaatgtacagtcaagttagagtacttctgtcctacataaacagatggagctaggtttagctgaaaaagtctagttttcttttagaatatgctttaccctgtgctaaaactcctctgttactgtgcctccctagccacacacacagagcttaaacgta

SEQ ID NO: 246232 - DNA, 485 bp, Homo sapiens
gtcgaccttgcccatgatgacgcactctgaaacatgccggcttctctctgcacaggaggaatttgtgaaatggaagggctccctgttcttccgatttgtcagcactctgatcgattcacacccagacattgccaggtaaatcttttcctcacgtcagacgactcaacagtttacctcatttctgatgtatgctggatttctttttttttcagattggtttagagttaagtaggatttagtgagctttcggtaggtgccaggaaaattagcagatttttaagatgctaagcaatataacaaacctttgttttgcacacaagtttaaaagaaaatggttagattcatcattgaataatctcagcattgactgcacttgctgacagtgtttgctgttcctgaaggagcttgaagaatattatatgcttgctgtattacactgtatagagtagcagccactagaaactcactgttaatttctaggcaaa

SEQ ID NO: 246233 - DNA, 5274 bp, Homo sapiens
ccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatac

SEQ ID NO: 246234 - DNA, 4072 bp, Homo sapiens
agtcgacggagactctcctttaattgatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatac

SEQ ID NO: 246235 - DNA, 2783 bp, Homo sapiens
gctacacagagagctgtgatcatactactgtgatccagcctgggtgacagagtgagaccctgtctcaaaaactagtaatataacacaaacactttagtacatcagaagcattgttttttattttgaaaaggtttgaaatatctatttctgagtggtattaagttattgcatattttagctcatttaatatcatcatatttaattgttaggttgtcatttacaatcctgccatgtagtcccagctactcgggaggctgaggcaggagaatggtgtgaacccgggaggtggagcttgcagtgagccgagatcgcgccattgcactccagcctgggcgacagagcgagactccatgtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatac

SEQ ID NO: 246236 - DNA, 3730 bp, Homo sapiens
ccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccaggtaaatcttttcctcacgtcagacgactcaacagtttacctcatttctgatgtatgctggatttctttttttttcagattggtttagagttaagtaggatttagtgagctttcggtaggtgccaggaaaattagcagatttttaagatgctaagcaatataacaaacctttgttttgcacacaagtttaaaagaaaatggttagattcatcattgaataatctcagcattgactgcacttgctgacagtgtttgctgttcctgaaggagcttgaagaatattatatgcttgctgtattacactgtatagagtagcagccactagaaactcactgttaatttctaggcaaa

SEQ ID NO: 246237 - DNA, 3212 bp, Homo sapiens
ccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagaaaaacatgggagaatggggcttgacatcgttctgtgtgtagctgttgtcttaagtaagcccagccatgggactgtgtcaggggctgcggagcctgtctgtgtctgctctcagccatgtggttcctagaggtggctctgatctgag

SEQ ID NO: 246238 - DNA, 738 bp, Homo sapiens
ccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcggttccactggatgtctcacatgcagacatcatcaaacgtcacatgagtgaaaatgggattcccaaagcctgctaatggcaccatccaagccaccaacccaggagtcatggcatttctgcttcccctttcatgcccactaccactgtcctgcctctgaggtgtctcagggcagccccgctccattcctgatgctgctgccttcatcatagcctcgagcaattgcaggagtattttagctgctttctgatgttaactgtgccagcccatcccccacacttttgcagaacgacttttgaaaacacagctttgaatgtgtcaagcctgtacacctttaatgtttcccctttgtttcctaaataaatgaccacatccttggcatgctttataaga

SEQ ID NO: 246239 - DNA, 446 bp, Homo sapiens
aaaaaaaaaaaaggacaatgttactaatttttgtcactataactgtgtaagctctggatgtatctgtaactgaccccatgcagttatgtagaaattttggaggggaggaggataagaagagtctgaaatgaattgtgaaattttattctttactttaaggaatattttatgaggggaaaaatgaatataactgatagtagaataataaaaatttaaaagatacctagtttggtatcagacacgccactaattaggaacgtctacatataagtttcatgtgccacttgagtcctggagcagcagaagttgataccctttcagtgaggctcccatctgaatcattttgtatatttacagttgcaattctgcttttctatcttttttttttccagccgatatttaaataaggcttttcatatctggtccaagaaagaaaaattctcacc

SEQ ID NO: 246240 - DNA, 576 bp, Homo sapiens
tgggcgccatctaccctccagtgtttcctaacaatcccccatccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttcccagagct

SEQ ID NO: 246241 - DNA, 961 bp, Homo sapiens
acggttccaatccgcagccgggggaagtcgcaacaaccaatgcaccgaggtccggccatctttagcggcaccatatcgtcagatgctccataccggcacggatgtcggcccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccaggtgcagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttcccagagct

SEQ ID NO: 246242 - DNA, 447 bp, Homo sapiens
caaagaagtgagctaaatgacatggtgtgtcacattgcagttactctgattgggatgatcatgagagtatagatagaggcatttagtatgagtgacaaaagtattcttttccttaactttgagaacatagccaaagagaacaagaaggtaggaagctagcagctgtgttactttggacagcttatttaagcttttgagacagtttcaaaaacagttttcttagctttaacatagtttttgtaatacaaggttttgcaggctaaaggagataaaataggcaaaatacttagcatataagcacttaacaaatattcttggctgggtgccgtggctcatgcctataatcacagcactttgggaggccaaggtgggcagatcacttgagcttaggagtttgagactagcctgggcaatatggcgaaaccctgtatctacaaaaacaacaac

SEQ ID NO: 246243 - DNA, 291 bp, Homo sapiens
gaaaccatccaatttattagtgtttcccttgctgcctcagcatttctggttaatgcactacagcaaatcatttggagggacaacctgaatgaagctctgccctgtgtactctgcaaaaatgttcaaaccattatcaagagtgttggaaatgaaagacaacagcatgaaattgagaagataaaattttatcagagattgtctttttaaaacaatgacttcaaagtaagaatatacattgactaatatgtacagaattattattaaaacaaatatttatttcacaccaactac

SEQ ID NO: 246244 - DNA, 431 bp, Homo sapiens
  misc_feature (416)..(417): n is a, c, g, or t
caagggggcccacagacagaaggcctgctgggccaatgacacacacttgctatgtcagagagatgcagggatgctatggtttgaatgtgctccccaaaaagcatgtgctggaaatgcaatccctgatgccacagtgttaggaggtggggcctcatgggaggtgtttagatcacgagggttccatcctcatgaatggattaatgtggattataaaagggctgggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgannactcgtagctactt

SEQ ID NO: 246245 - DNA, 427 bp, Homo sapiens
gctgctgagacagagatgagcaacacagacacgatccctgcccccgagggtttccagtctaatggggcattgaacccttaccaaatgatcacacccgtcatcacagacggaatggggtgtcggagaggtcagcgagtagtagccagagaaggtttccccaaggaagtgacctatgagttgaaatctgaaaggttatagcagcctaactaggtgagggggaagcattccaggtaagagaagcacaggtgtgaagagacgctttgatatgggaaggagcaacggagaacctgggtgaaggcggcagacaggagccaggtttggtgaggcttttgtttaatgaagttgacggtctttagctgcaaggttgcccctttagactttgcttccttagaggatttaacctcattgtttcttcaaggccggccaa

SEQ ID NO: 246246 - DNA, 272 bp, Homo sapiens
ataaaccccaccactgagaattatttggttaaccacagtttaggctactgatggattttactcagaattaaagtggaaatatattaaagcaatagttttgagaacaaagtaggtcacaaagctccatttaaaatagaataggccgggcatggtggctcatgcctgtaatcccagcagggcaaggcaggaggattgcttgagcccaggagttcaacaccagcctgggcaacaacgaaaccctgtctctacaaaaaatgcaaaaattagctggg

SEQ ID NO: 246247 - DNA, 146 bp, Homo sapiens
tttttttgaagctattgtaaaaggggttgagttcttgatttgatcctcaacttggtcactgtaggtgtatagaagagcactgatttgtgtacattaattttgtacactgaaactttgctgcattaatttatcagttctaggaactt

SEQ ID NO: 246248 - DNA, 5408 bp, Homo sapiens
  misc_feature (1246)..(1246): n is a, c, g, or t
  misc_feature (1493)..(1493): n is a, c, g, or t
  misc_feature (1573)..(1573): n is a, c, g, or t
  misc_feature (4119)..(4119): n is a, c, g, or t
  misc_feature (4882)..(4882): n is a, c, g, or t
tactcagggcctcgtctgtcaggccgggagacccggactcttacctgtggagatgtggagctgggaatgacgctgtcccgaaaaacaggaggtagccaggggacgagagggaagtagggatgctccaggcagaggacacagcttgcgcaaaggcctggagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgantgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctccncctcctcagagtccagcaccaacaagtgctctgccaacttctggtttaacccattgtccccgcctgacgactgtgccctnggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaagttcaaaaggaaacggccaggcaggaccgtgtacgcccaaatgcacaacgagaaggagcaggagatgaccagccctgtgagtcacagtgaggacgtccagggcgctgtccagggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccctctgtgggagcccgggtgccaggccctcccaacaccacaccaccctccaggcccccctgccctccggctggaaactgcagctctgtaaatgcctctctaggtagctgctggcggtggtgggggtgtctcactctctgtctttatagccggcggtagccaccggggtggctctgtcagagttccgtactcgggagcccctttccctgagtgcccagggtgtctcctctgcccagaggggcagcagctctccctggttctccccagggcagacggggtagggcgggctcaggacccagtgcccatggttcctcactcctaccagcaagcagcaccatcccgcaggcttctcccacctgatggctgttctcccaccgggtctgggctctggaaggagccagatgcccccagaaaggtgggtggtggagacggcaccagatgtaccagttttctgcagttccttataggcgaagggaaccgggtggaaaccaagctgggagaggctgaggatggcagggctggaagggccatcagcgtgaccctcattttcaagaaggggaaactgaggcccagggaggagagtaactgaaggtcacagcacggtcacagcagaggtggccgaacccagccctctgcgcgccagtgctgtgcggtctccacacccttacggtttcctagaatcagggatgttagtgtaagtctataggaatataggggggtgggggggtcaccttttgccttgaaatgggaagtcagtagccccttcctcctcctccctcctccccctcctctctggcagggatctcagatgaccgtggcctcccnctcagagggggagaacgccagagccctggctggtgatgtgctggctgggggtgaatcccaatgagggtccctctcagagcgggagaacgccagagccctggatggtgatgcgctggctgggggtgaatcccaatgagggtccctctcagaaagggagaacgccagagccctggctggtgacatgctggctgggggtgaatccgaatgacagtgcagacgttctcccatccaccatgtctgagcttgggggaattgcctcatttcccctggaaaagaaacatggtccattagaggggaaagcccaggggtgaatcttcacgccccaaacagtgcccggtggggaggaggcacccgctccttgttgagtaaaaccacccatggagactggaacctcatctccctgggtcggggggtgttcaaggccacaggacaaggggagcaccctgggccacacaggcgtggaggtgtccccaccccttccacctgtcccccagacccaaagctctctccccaccctacctgcccacctggggctcctgtgccccctccccactccagaggccaccctacaagttgtcctcaaggtcatcctggagatgggatccaggacgtggggccatgactctctgggaccttgccacagcccccattcccctgcttgcagtctgcaaggacacctttgcagggattcttgtcctgctggccaccccacccacacctgtccctggccagcaggccgcctgcaagcgtcaggcacacaggnacagacatggcgagcacagtgcaggcccggggcccacgggcaacatggaaccctgggaactgccctcccccttagctcacagtgcctgcggtagccactctaggtcgttggccttccttgaccactccatttaattctctctgctgtttgggttgggtttttccccttagttatctgtgggtttcctgtattttatgttaatatttctattaagaacatgttgggcatgtggacccaagcacctgggaaggaggtggcatctgagacagcctgatacgttcccgtctgtgcacccatggagatccaggcgtgggcccgtggctgtccctggttgtaaattcgagggtctgcatatctgatgttcaggtagacctgggcgcctgggaacgaggccatcagctgccatgcacataacaaagagacaatgcattccttcttatttttcctttttaaaaatcgatgaatcatttgtgatgcttttaacaaagattaaatgaatttgatcagcttttgccttaaaaaaaaa

SEQ ID NO: 246249 - DNA, 5963 bp, Homo sapiens
  misc_feature (1801)..(1801): n is a, c, g, or t
  misc_feature (2048)..(2048): n is a, c, g, or t
  misc_feature (2128)..(2128): n is a, c, g, or t
  misc_feature (4674)..(4674): n is a, c, g, or t
  misc_feature (5437)..(5437): n is a, c, g, or t
gcggccgctcctgctgctgctgctgctgctgggcgcctgcggggcggcggggcgctcccctgagcccgggcgcctgggtcctcacgcccaactgacccgggtgccgcggagccctcccgcggggcgcgcggagcccggtggcggcgaggaccggcaggcgcgcggcacggagccaggcgccccgggtccgagtcccggtcccgctcctggtcccggcgaggacggcgcccccgccgcgggctaccggcgctgggagcgggcggcgccgctggccggagtggcttcgcgggcgcaggtctcgctcatcagcacgtcgttcgtgctcaagggggacgcgacgcacaaccaggcgatggtgcactggacgggcgagaacagcagcgtgatcttgatcctgacgaagtactaccacgcagacatggggaaggttctggaaagttctctgtggcggtcatcagatttcgggacgtcctacaccaagctcaccctccagcctggtgtcaccaccgtcatcgacaatttctacatctgcccgaccaacaagaggaaggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgantgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctccncctcctcagagtccagcaccaacaagtgctctgccaacttctggtttaacccattgtccccgcctgacgactgtgccctnggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaagttcaaaaggaaacggccaggcaggaccgtgtacgcccaaatgcacaacgagaaggagcaggagatgaccagccctgtgagtcacagtgaggacgtccagggcgctgtccagggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccctctgtgggagcccgggtgccaggccctcccaacaccacaccaccctccaggcccccctgccctccggctggaaactgcagctctgtaaatgcctctctaggtagctgctggcggtggtgggggtgtctcactctctgtctttatagccggcggtagccaccggggtggctctgtcagagttccgtactcgggagcccctttccctgagtgcccagggtgtctcctctgcccagaggggcagcagctctccctggttctccccagggcagacggggtagggcgggctcaggacccagtgcccatggttcctcactcctaccagcaagcagcaccatcccgcaggcttctcccacctgatggctgttctcccaccgggtctgggctctggaaggagccagatgcccccagaaaggtgggtggtggagacggcaccagatgtaccagttttctgcagttccttataggcgaagggaaccgggtggaaaccaagctgggagaggctgaggatggcagggctggaagggccatcagcgtgaccctcattttcaagaaggggaaactgaggcccagggaggagagtaactgaaggtcacagcacggtcacagcagaggtggccgaacccagccctctgcgcgccagtgctgtgcggtctccacacccttacggtttcctagaatcagggatgttagtgtaagtctataggaatataggggggtgggggggtcaccttttgccttgaaatgggaagtcagtagccccttcctcctcctccctcctccccctcctctctggcagggatctcagatgaccgtggcctcccnctcagagggggagaacgccagagccctggctggtgatgtgctggctgggggtgaatcccaatgagggtccctctcagagcgggagaacgccagagccctggatggtgatgcgctggctgggggtgaatcccaatgagggtccctctcagaaagggagaacgccagagccctggctggtgacatgctggctgggggtgaatccgaatgacagtgcagacgttctcccatccaccatgtctgagcttgggggaattgcctcatttcccctggaaaagaaacatggtccattagaggggaaagcccaggggtgaatcttcacgccccaaacagtgcccggtggggaggaggcacccgctccttgttgagtaaaaccacccatggagactggaacctcatctccctgggtcggggggtgttcaaggccacaggacaaggggagcaccctgggccacacaggcgtggaggtgtccccaccccttccacctgtcccccagacccaaagctctctccccaccctacctgcccacctggggctcctgtgccccctccccactccagaggccaccctacaagttgtcctcaaggtcatcctggagatgggatccaggacgtggggccatgactctctgggaccttgccacagcccccattcccctgcttgcagtctgcaaggacacctttgcagggattcttgtcctgctggccaccccacccacacctgtccctggccagcaggccgcctgcaagcgtcaggcacacaggnacagacatggcgagcacagtgcaggcccggggcccacgggcaacatggaaccctgggaactgccctcccccttagctcacagtgcctgcggtagccactctaggtcgttggccttccttgaccactccatttaattctctctgctgtttgggttgggtttttccccttagttatctgtgggtttcctgtattttatgttaatatttctattaagaacatgttgggcatgtggacccaagcacctgggaaggaggtggcatctgagacagcctgatacgttcccgtctgtgcacccatggagatccaggcgtgggcccgtggctgtccctggttgtaaattcgagggtctgcatatctgatgttcaggtagacctgggcgcctgggaacgaggccatcagctgccatgcacataacaaagagacaatgcattccttcttatttttcctttttaaaaatcgatgaatcatttgtgatgcttttaacaaagattaaatgaatttgatcagcttttgccttaaaaaaaaa

SEQ ID NO: 246250 - DNA, 404 bp, Homo sapiens
atcctgtactgagttaaaaaccacaaaggtcaccagaagagagattcctgagatggatttgaattctggcaaaaccaacgttaggccagccaaggagcatattggagaaagagattggtatttaataagcatcgcggggacagttggctaacaggccaggggagagttaatttaaattcatacagcatacctgtcaagttcagctatatcgtactgctaatctgtgacaaacctggagacaaggaactggcattgttacccctgctgctgataaggagataaattcctggctattgaagaaaaagataccatcagggctctgatagatgggttcaaatatgtgagaataaaaatgtttgcattgcaatgtaataaaaataaataccaaaaggaaagccacggca

SEQ ID NO: 246251 - DNA, 501 bp, Homo sapiens
cactgattttgtatcctgaaactctactgaattcatttatcagatctaggatctttttggatgaatcttgagggttttctgggtatatgatcatatcatcgatgaaaagtgacagtttgcctttctctttactgatttggataccctttatttttttctcttgtctgattgctctggatcacaacagacagcaacttttaaactgtggtatttgacaaagttttgacatttgtaaacacaaataaacaataatcacaataaaataatgaacatacttatcacaccaaaaggattttatatcattttgtcatatttgttttgctattgtctaagaaattgagtaatttttaaagtaaaaaatccaagagaaaaggaaatatggaacaggtggctgaaatagaaagtactagtaaaatggtagatttaaagccaaatactttagtaatctcataagtgtaagttaaccacatggtttaattaaaagacatattactaattaat

SEQ ID NO: 246252 - DNA, 477 bp, Homo sapiens
tgcattttaaaatattttagctgatttgttagtgccttttctgcttaggcagatataagtatcaggtgaattgattgtggaacataagtagagacactgcattggaatgaaaatcagttttataaagttgaacacagattttaaaaatgctgtacatagatttgtttttatatttttcagtaaaattttaggccaggtgtggtggctcatacctgtaatccccgcactttaggaggctgaggtgggagaattgcttgagcccaggagtttgtgaccagcttggacaacacagggagacctcatctctaaaaaaagtgtaaaaataaaaaattaactgggcatggtggcacatgcctgtggtgactgagatgggaggatctcttgagcctgggaggttgaggttgccatgtgaccaatgattgcaccactgcactccagccttggtgacagagcgagaccctgtgtcagaaaaaaata

SEQ ID NO: 246253 - DNA, 416 bp, Homo sapiens
atcatagactgtaagctgagtaaggagagaatatacgtatataagagcagtgatggctggtgaaaagttttgtgggcaagaaatagaagtctccgtgaagtcaaagaatagttggattggggtgaaactggaaagataagggttggtggtcagaaagtggaataggctgggcgcggtggctcaggcctgtaattccagcactttcggaggctgaggcgggcggatcacgaggtcaggagatcgagaccatcctggccaacatggtgaaacccatctctactaaaaatacaaaaattagctgggtgtggtggctcgtgcctgtaatcctagctactcaggaggctgaggcaggagaatggcttgaaccagggagtcaaaggttgcagtgagccaagatcgtgccactgcactccagc

SEQ ID NO: 246254 - DNA, 330 bp, Homo sapiens
tacacacacttgaacccgtcttccatgttcacacccacacccagacatgcacaacttaacacacacacattcacagacatacagtcacccatacacattcacacagacatccatggacagccccccaacacggacatatcacacacattcacacacacacagtctcacatgtacacacatactcttgcacccaccccacacacgttcacactcacactcagacacacacagctcacatacacacacacacacagacatacagtctcacacacacacattgacacagacatccatggacacaccacacacaaacacacatacacacgagga

SEQ ID NO: 246255 - DNA, 250 bp, Homo sapiens
tcaagaggccagcagtctgcatatttggaattcatctgtaacgaagtgaattccaggtccctctcaatttctgcggcccaggcatagctaggagctgagtcctgggtggggcatgttacaacttgctggctgatgaagtcaaagcacttggatttctaaagaccaacggtttaaaggcttggtttgtgagctgacaaaaacaaagttttcactgttgatggggtgaaggtttttttttttttttttttct

SEQ ID NO: 246256 - DNA, 2278 bp, Homo sapiens
tttacatttgatctgcagtgaggggacatttctaattttagtttgacccacatggaaaggtggatagctttttttttttgttttggtatagagagcacgtagaattggacaattaggtaaatccttggaatcccccaaacagccatttgctttataaatccagtatttcttacctctgaacgtcttaaagagctgcctcacaaattaatctaaccattgcttgcactaagaagtttgccaagagcctcttccagccttactggggggaaggaagagattactgaaaaccaacttgtaggaatgaaatgaggctgtcagttgtctaacctaacaaactgccaaattaggtttacattttttgttattagacttttgaatggccgaggcagagttaaatttaaaattttggattgtagccactttccactcgcctaaacactcaataccggtttgtttatttttccagcatcaagaaagaaaaccaaggcactagaaagcaagcacacttaagtattgaagataattacatcttaaattttgcctgaactgtatattgtagcatacttaaacccattcaaggaaaaaattggcaaattgaaaattctcccattaaagattgatatttttgcaaactgacaaatttaacgatttcggtacccctccccaaaaatgcagtcacataaaatatatcaatactattttgaattagctctagaaatcacactgaaactatgttacatttacaaatattaaatttattataactaaaatgaatttaattgttctcagatttggccaccttatagctccgtttaaggaggggatttgttaaaaacaaaaatgcattataacttggtcaaattactttcacattaaggaaaaaaacttctaaaaaggaaaacaagaaaagcaactcttcagtttcacataattaaaagaacaggagaaagcacgcaagctacatatagctaaatttacgaaaccaaccaaagccagggggatttctcttctgattatgtgtcataaaaaggtccactgtcttatatacacatgtatataatgttacattccatcactgtaaaaagtcccctttgccccctcccccaaaaaagtttcagtctagtctccaaacttggaaagcggcgctcgctcctgctgccggtgcagttcgttctcggtcagcagctggaggttctcggcgcgcacgggtccagctccagctccagctcccgcacacgcgcgtcgtcgccacccagccgcttgctctccagccgcagccggttgttctcgtcctccatgcgcgagaggcacttctccagttccaggtactccttgatgagctcctgcttgctcatgttctgcaggctctccgtgtggtaccgctcgtacgtctccgagaagtcccgctgcagaaactcgctgccgtcccctcccatcccatcgctgcccccatcctcctcacccccttcttccatgaagtcgtcatcgctggtgtcgtcggatttggcggcggcccgcttggagtacaggccggttttgagatccggctcctcctggtcgtgatcatccatgaggaactgcgtggtgttatagggcgcgaccggctggcccttggcgaacatctcggctcggatccttgaagctcgaaggctctgtttctcgtcgaactttttcttctcttcccaggtcagcttgtagtacggtttccaatgccgcttcttcttggacgggcgtctcctatgttttttcttccccagctgtctctgctgctgtccccactcctcttcgccccctgcggcaggagcccccaacttactggcctcggagtcatgacaaggctgggcgagcagctcggcctcgggcgtcggttccacttctgccggcggcgggaagtcgccgccagcggacgagtcgtccccattctggcccttctcgccctctctcaggcagctagattctggacaggcctgggtctgcaagggaggtggttgggattccaggctcccttccccctccggccccggacggccacccaactgggggaacgctctcgattgccacctactgtcctcctcgggcacccgctcctccgcgcctggggggcgctcagggttcagctcttcctggacagcagcagcacctgtacagttgctagtttgaggctggtgttgatattctgacaagaatggctcggccatggctagtagagtcctcgaagtttaagaaattttggctagtaagtccttaaggaaaaaaatgggtttttcttaaaaaaaaa

SEQ ID NO: 246257 - DNA, 2095 bp, Homo sapiens
ctctgtctcaaaaaaaaaaaaaagttttccagaactgaagttctgctcctcctattaataatttttcttcagttggagtgacaactccatagcattaacttttttccctctgctccccagatgttttacaactggattacaaaataggatcatcattgactagggtcctcaatccaaaactggaaccacttactcctaactgaagcttcagtacacttgatgcctactgtggtttgattttttacctacatatgacatgttcgctctacactgatcaagagatcatcaagaaagaaaaccaaggcactagaaagcaagcacacttaagtattgaagataattacatcttaaattttgcctgaactgtatattgtagcatacttaaacccattcaaggaaaaaattggcaaattgaaaattctcccattaaagattgatatttttgcaaactgacaaatttaacgatttcggtacccctccccaaaaatgcagtcacataaaatatatcaatactattttgaattagctctagaaatcacactgaaactatgttacatttacaaatattaaatttattataactaaaatgaatttaattgttctcagatttggccaccttatagctccgtttaaggaggggatttgttaaaaacaaaaatgcattataacttggtcaaattactttcacattaaggaaaaaaacttctaaaaaggaaaacaagaaaagcaactcttcagtttcacataattaaaagaacaggagaaagcacgcaagctacatatagctaaatttacgaaaccaaccaaagccagggggatttctcttctgattatgtgtcataaaaaggtccactgtcttatatacacatgtatataatgttacattccatcactgtaaaaagtcccctttgccccctcccccaaaaaagtttcagtctagtctccaaacttggaaagcggcgctcgctcctgctgccggtgcagttcgttctcggtcagcagctggaggttctcggcgcgcacgggtccagctccagctccagctcccgcacacgcgcgtcgtcgccacccagccgcttgctctccagccgcagccggttgttctcgtcctccatgcgcgagaggcacttctccagttccaggtactccttgatgagctcctgcttgctcatgttctgcaggctctccgtgtggtaccgctcgtacgtctccgagaagtcccgctgcagaaactcgctgccgtcccctcccatcccatcgctgcccccatcctcctcacccccttcttccatgaagtcgtcatcgctggtgtcgtcggatttggcggcggcccgcttggagtacaggccggttttgagatccggctcctcctggtcgtgatcatccatgaggaactgcgtggtgttatagggcgcgaccggctggcccttggcgaacatctcggctcggatccttgaagctcgaaggctctgtttctcgtcgaactttttcttctcttcccaggtcagcttgtagtacggtttccaatgccgcttcttcttggacgggcgtctcctatgttttttcttccccagctgtctctgctgctgtccccactcctcttcgccccctgcggcaggagcccccaacttactggcctcggagtcatgacaaggctgggcgagcagctcggcctcgggcgtcggttccacttctgccggcggcgggaagtcgccgccagcggacgagtcgtccccattctggcccttctcgccctctctcaggcagctagattctggacaggcctgggtctgcaagggaggtggttgggattccaggctcccttccccctccggccccggacggccacccaactgggggaacgctctcgattgccacctactgtcctcctcgggcacccgctcctccgcgcctggggggcgctcagggttcagctcttcctggacagcagcagcacctgtacagttgctagtttgaggctggtgttgatattctgacaagaatggctcggccatggctagtagagtcctcgaagtttaagaaattttggctagtaagtccttaaggaaaaaaatgggtttttcttaaaaaaaaa

SEQ ID NO: 246258 - DNA, 439 bp, Homo sapiens
agcaccaaagggggccattactagctgtaagaccttgcaccttctaattgcctttctaagcctcagttttctcaccatgaagtcagggaacataacagtgcctgcctcacaggagaattatgaagaggagaaagaggtgatgagaaaagtaagggtaggccgggtgtgggggctcacgcctgcaatcccagcactttgggaggccgaggcaggcagatcatctgaggtcaggagttcaagaccagcctggccaacatggtgaaacccagtctttactaaaaacacaaaaattagctgggtgtggttgtgagtgcctgtaatccaaactactcgggaggctgaggcaggagaatcgcttgaaccagggaggcagatgttgcagtgagccaagaccacgccactgcactctagcctgggtgacagagtaagactctatctc

SEQ ID NO: 246259 - DNA, 211 bp, Homo sapiens
gcatgcctgtaataccaactactcaggaggctgaggcaggagaattacttgaacccaggaggtggaggttgcagtgagtcgagatcgtgctactgcactccagcctgggcaacaagagcgaaactctgtctgagaaaaaaaaaaagagagagagagatttaaggggtggaattaacagcgcttagtggtggagtagaggtggaggggagca

SEQ ID NO: 246260 - DNA, 111 bp, Homo sapiens
aaatgaagtatccatctataagtgcatttctagaaagctgtcaaattagaatgcaaagctctggataatttgcaaaaacaaacaaaccaaaaaaatccctcattttattta

SEQ ID NO: 246261 - DNA, 729 bp, Homo sapiens
gaaattccggacacatccgaacatcagaaggaacaaactccagacgtgctaccttaagagctgtaacactcaccgcgagggtccgcggcttcattcttgaagtcagtgagaccaagaacccaccaattccggacacagtagaagcccattgggcttttcaattttatttactctaatttcattctaaagaattctgttttgtagttctccttttattttattattattttttgagacagggtgtcactctgttgctcaggccagagtgtagtggtgccatctcagctcactgcagccttgacctctctgggctcaagcgaccctcccacctcactactttgggggatgaggtgggaggatctcttaggcctgggaggtggagattgcagtgagccgagatcacgccatggcactccagtctaggtgaaagattgagaccccatctcaaaaaaaaacaaaaaagaaaaaagtagaatttaggtattcctacttttacagtcaaaagtccactggtgtttgcataacaatgatgttttgactagttattggactaaaagtaggacacatgaagcaggtgactaggaatttggaaatattattgcttaggtcattactggaccttacgaagagattgttgcactggtgacttggactttgctggtccctccccgactcttcacagctggcttgacgactcttgtgacattctgaggttttatgctaaaccac

SEQ ID NO: 246262 - DNA, 545 bp, Homo sapiens
tattctaggtgactggtgccctgggaacatgcatctcagtggccctgtgacagttaacctaatcacagtccacgcttgcccttctgaatacaaagcacacttgactgaggaatctcactcaatatgtgtatgggacacacatttttatgtgtcttctaaagaagacaaatattcttttgaaacagaatatcctgtgagaaaacaagtaatgactggctataaatatggtatggtcaagtaaaaatctttaaactgtgacccaggatttcaggagttggtctggtccctgggtggtttaagaagcaaagccacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccag

SEQ ID NO: 246263 - DNA, 409 bp, Homo sapiens
gtacataatgctatatattcataacagtattctaaagcatatcaccagtgcatgggaaaatgttgaaagtaatttcgccagtaagttatttcaaattttctttacctataaacaattataaacttgagatttcgttactattattataatgtgaagaaaatggtatattattgccttttaaaattgtatatggcctacatcttttttttgttttgagacaggttctcactctgtcaccctggctggagtgcagtggcacaatcatagctcactataatcttgaactcctgagcccaagtgcttctcctacctcagcctcccaactagctggcactacaggtgcaagccaccatgcccagctaattttttaattttttgtagagacagaatctcactgtgttgtccaggc

SEQ ID NO: 246264 - DNA, 425 bp, Homo sapiens
cccgcaccagcccctccgccccttctcatcagtcaggtggcagctgcacactcctccctccgcacagcctagttccccagggacctcgctgagccaaaaatgcctgtggcctctgaggaagctgggaggaaaggcacgctgtctaaatgaagggccgtttcttccttccagaatagctgcggccacagcgcgtccaacgtgcctgagccgttggagccaatcgcagcacggggagcagtaattaataaaaatgggtaatgatagaccatctgtcccagcctgcgctccgtggcggggccacgccgggccctcattaggcattcctctgtcattgtccccgcagatgttggcggtggccgtgtcggtctcatgggaagacgaggttgaacacatttaggcaaacgacaccagcaggctgggcccga

SEQ ID NO: 246265 - DNA, 484 bp, Homo sapiens
taatttacaaagaaaagaggtttatttggctcacagttctgcaggatgtacaggaagcatagtgccagcatctgcttctggtgaggcctcaggaagcttccactcacggtggcaggggaaggggagcaggtgtgtcacacagtgagggagcaagggagagcaggggaggtgtcaggctctttaacgatcagctctccgtgaacgcaccagcgttactgcaccatgccatgcctgagggatccgcccccatgatctaaacgcctcccaccaggcccaactccaacaccagcgatcagactcaacagactcaacatgagattcggaggggacagatctccaagctatgtcatggtctatactgactatggaaaactgtcaggtgaccagtccatttaattacagtcacatgagggtgtcaatggcctgatcccagcaaccactgtccctgcctgaatagagaagatgccagataataaaaggggcc

SEQ ID NO: 246266 - DNA, 355 bp, Homo sapiens
ccatccatacacatgctttcagctggatcaactgatggcccaaccaactggagtagtggcctctctccgtgaacgcaccagcgttactgcaccatgccatgcctgagggatccgcccccatgatctaaacgcctcccaccaggcccaactccaacaccagcgatcagactcaacagactcaacatgagattcggaggggacagatctccaagctatgtcatggtctatactgactatggaaaactgtcaggtgaccagtccatttaattacagtcacatgagggtgtcaatggcctgatcccagcaaccactgtccctgcctgaatagagaagatgccagataataaaaggggcc

SEQ ID NO: 246267 - DNA, 590 bp, Homo sapiens
aatcagttatactttatttactaggtatcttttataagagtttttctgtgtctgattattttgctaaacaaacctcctatttaaattgtttcttcttttaaagcatgctattaaccccagattttgtcctttcatttctctatacatctagattatttagctacatttgcataaaatgatacatatcagtgctataaatataaaaattctagtattacaactttataagtaataatttacagagctggttttgtgcctaagaacttaggcatgagtaaatctggttcacacatttgaattgtatatttctagtttctgacagcatctagcatttgtttattgcattacattttttcaagaagttccatgcaaattaattcagtatctggaacatatctgttttactaaatgtttttcatgaaataattaaattttcaatatatgaggtgttgataatattccaagtcttaaagaagaggatgtatctatctcagtgattcagagagatacatttgtccagaattactacagctagtaccatggcaaatcatggactccaacctgagtcttcactccatattcattacatt

SEQ ID NO: 246268 - DNA, 283 bp, Homo sapiens
ctcctctccctcctcccatcctccaccctcaggtagtccccaatttctgttgtttccttgtgttcataagttcttatcatttagctcccgttaatttttagttttttggtctaggctggtctggaactcctggcttcaagtgatcctcctcagcctcccaaagatctgggattacaggtgtgaaccactgcacctggcctagttttatttgctaatgacaagtcaacagtcagtttagttgtaatttcgttgtaggtaagtaattctctctcctcttgagcta

SEQ ID NO: 246269 - DNA, 3050 bp, Homo sapiens
  misc_feature (2150)..(2150): n is a, c, g, or t
  misc_feature (2896)..(2896): n is a, c, g, or t
  misc_feature (3044)..(3044): n is a, c, g, or t
taccaaagcaagttaagtatagttcctcaaatacctatgacacagcccttcctctaagcctccttccacggaggggccctctctcttccacctgtagaagcccaccccagataccaccaccttcttgaaacctttttgcctctccagcccttggtgcaggctgtcctctcttaggctgtgtgagggctgttttgtgtccatctcctctctcctgctggtttgctctcagcatctgagtcatctttgaatctctggcccttgatggtagcctggcccgagccaatgttctgtgagtgtctgtggaaaggataggtctttcagccccagtgatagaagcccacctctaacgtgcttaagtaagaagggcaagtacctaatcatgtaactgggaatgatgggatgtggggcttcacacagcactgagggagagctgcaggaaccaggccccaggacagaactgtggctgtcctgcccctgttttttctctctctctggttttttttttttttttttttttgggacagagtcttgctctctcacccgggctggagtgcagtggtgcgatttcagttcactgcaacctccgccccgtcccgagctcaggcgctcaagcgatcctcatacctcagcctcccaaataattgggaccacaggcatgtacaacaaagcccagctattttatttgtattttttagtagagatggggtctcatcatgttgcccaggctggtctcaaactcctgagctgaagtggtccgcccacctcggcctcttgaagttctaggattacaggcatgagccaccgtgcccagcttggccttgttttcatacccagatggggagctgctgtcaccagattcacttcctgccagctgagaactcaccccaccaacaaaagtcttccaggttagctcatgtagaaaggcagggaagagcctgaggggctggtttggattacatgtccactcccagaccagtaatgtggtcaggaggctgggatgctcagattggccagatctgggccaggtgatcacctttatggggaaccaagggctgtagttgaccatcgagagaacttcctccaaagtaatatttgctagcagaagatagaggtggggatagaaagaatgatagcagcccagcctcttaaagaaaggatgagagtttagaaagggagatctgagctggctgcgttggtttattttttatttatttattttctgagacagagttttgctcttgttgcccaagctggagtgcgatggcgtgatcttggctcactgcaacctccacctcctgggttcaagcgattctgcctcagcctcccgagtagctgggattacaggcgcccaccaccacgcctggctaattttttgtatttgtagtagaaatggggtttcaccatgttagccaggctggtctcaaactcctgacctcaggcgatccgcctgccttggactcccaaagtgctgggattacaggggtgatgcattggtttatttattcattaattcatcaagcatttgagcacccacttcagtgcacactcagactagagaggggtccatcccaggccgggcagggcactctcagaccttacctcccacagccatcaccagcccctacgaaggagactttcctaggctcagaggcttcccctaccctgctgaatggtgttaagttctaattgttaaagaaaaagttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaccagaaaacaaaactgggcgcagtggctcacgcctgtaatcccagcactttgggagtctgaggcaggtggatcccctgaggtcgggagttcaagaccagcgtgaccaacatggagaaaccccgtctctactaaaaatacaaaattanccaagcatggtggcgcatgcctataatcgcagctacttgggaggctgaggcaggagaattgcttgaacctgggaagcagaggttgcagtgagccaagattgcatcattgcactccagcctgggcaacaagagcaaaactccatctcaaaaacaaaaacaaaaaactattcaatgacacttgtcaaagcacagtaatgaagactttattcaagaggtggcaagcactagttgtagggaccgtggcaatggggtcctgccctgaggcagaaaggttggactcaacttcaaatacagcaatgggcaagtgagaactgatagccaaggagcagagtggggtcagcgggtgcacaatgactaagaggatcatcaggcatttgtgggggattctggttaaatagtcctaacaggattcttgttgagggcaggccagggtaactagacatcatggaggatggcagaggataaggaggccgattagattttgagagtgatcagatgtggaggatgaggattctagctaaaccaacttagcacgatacttgctaaaattgaacaaggcagagatgaacacagaagtccaaaagttgagacctagttgaaaaagagctcagaaggccgggtgcagtggtccatgcttctaatccgaacactttgagaggccgaggtgggaggattgcttgagccccggagtttgagaccagcctaagcaacacagtgagacccagtatctacaaaaaagtaaaaanaatgcaacagggcacaatggcatgggcctgtagttgtagggatctgtgaggctgaggttggaggatggctcgagcccaggagttcgaggctacagtgagctatgatcatgccactgcactctagcctggacaacagagggagacactntcttta

SEQ ID NO: 246270 - DNA, 483 bp, Homo sapiens
agtacctcctagaatactgcagttggatattgaagaagtgagcaactttttactctttgaagttactggagagggaagaaatggcagtgtaggtctgacaagaattcttcagagcaggtagtactgttgtccgtgaagtactagcaaaacacttttggtgtttgctaattaaaacattaaaaatatgtaattgagccagacacggtggctcatgcctataattctagcactttgggaggccgaggtgggcggatcacttgaggtcaggagttcgagaccagccaggccaacatggtgaaaccctgtctttactaaaaataccaaaaattagctgggtgtggtggtgcacacctgtaatcccagctacttgaaggctgaggcaggggaatcgcttgaacctgggaggtagaagttgcagtgagccaagattgcgccactgcactccagcctgggtgacgagcaaaactccgtctcaaaagaaaa

SEQ ID NO: 246271 - DNA, 307 bp, Homo sapiens
aatatcctataaccatggatttgaaagaatcaatgtcattaaaacgaccatactgtccaaggcaatatacaaattcaatgcattctggtcaaactattaccatcatttttcaaagaattagtaaaataatttaagattcacatggaatgaaaaaaaaagcctaagcaaaaataacatagatgaaggcaccctattacctgatttcaaattacactacaagactgtagtaaccaaaacagcatgatgatggtacagaattatacccataggataatggaacagaccagggccctcatatgtacatatg

SEQ ID NO: 246272 - DNA, 445 bp, Homo sapiens
ctgtattagtgttatggtttatgctaagcatgtataatttaaaaaaaatgagagtaactttaaaatgatttggaagaaaaatatgtacatatgtgaacagtacttaattccaggtggtgggaatatggatgactggttatcttcttctttctgtatctttcatatttttaaatggaaaaactcaatgacctggaagtgaaagaacagatttggaaggggtgtggggcaagtgagaggaaaatgcaagagaaggacaaacctagttctggcaggattgtgtttaagttggaggtttctagggagcagttgttgggataagaaggatatggggaggcaggagaatcatgaaaatatttaggacagtgtgttgcctgtcatattattcctcctcctttcctgtttcttcaaaagaaatatacagacttacacttcttttcaagcatat

SEQ ID NO: 246273 - DNA, 488 bp, Homo sapiens
cagaattgatagacttcatgataggttatgtgaagaaggatcaaaaaggaaccaaggacagctatacagtggttggtttgaacaattgatggttcatgatgccattgctgagataaggatatttaaggaggaagatgacgagaattaattaagatcaagaaaacactaacaccaaaactcaaaggatgttggaagcttgaaagaagacctcaaagacaatatttgggcatattttaagagcatcatcaatactctgtatggcaccgaggatgacttatggaaaaacagagttatcaatgactttttgttggaaattatccaaaagagtaagattctgcaaagaagtttgtgaatttatttaccagtttatttttatttctattttcattttacgattgcctgagagtgatatttgaaaagtgttatattcatatatgtctaaatttttcaacaagtatcaaataaagattctaagttataagaaaaaa

SEQ ID NO: 246274 - DNA, 405 bp, Homo sapiens
agaaggagcttacttatttgccaaacagaaagaaagttgatgagagcaatgaaaccgcaaattaattaagatcaagaaaacactaacaccaaaactcaaaggatgttggaagcttgaaagaagacctcaaagacaatatttgggcatattttaagagcatcatcaatactctgtatggcaccgaggatgacttatggaaaaacagagttatcaatgactttttgttggaaattatccaaaagagtaagattctgcaaagaagtttgtgaatttatttaccagtttatttttatttctattttcattttacgattgcctgagagtgatatttgaaaagtgttatattcatatatgtctaaatttttcaacaagtatcaaataaagattctaagttataagaaaaaa

SEQ ID NO: 246275 - DNA, 480 bp, Homo sapiens
tgcattctggcttgggctgtcccaccttttccaaggtaatcaaatacactttactgcagcagtttccggggacggatgcaatagactagtgaaggctcaggagttgggtggggaaagggagagctcaaccctatcacactggatcactggatatggaagagacctcttggctgtagtgcttgaccttttctgcaccatggaccctttccaaaagctcatgagagctaactctcttcctcaaagagctgtatgtatacctacagttttgcagatggaggaggggatggactgcaggttcagtccatgtcaactccagtcccatcttacaaaatgaggaaactgggcctggtgcggtggctcacacctgtaactccagcactttgggaggccgagggcggtgggggggaatcacctgaggtcaggagtttgagaccagccagaccaaacatggtgaaaccccatctctactaaaagtacaaa

SEQ ID NO: 246276 - DNA, 272 bp, Homo sapiens
cttggaaagtgaaaatagctaacagtgaagtagccggttcatcttttacttacatatcttttctgttcagtgtactttgggcagccatgctgacggcctcagtggcaaaggctccatgggtagagatggtgatgcggagatcaacagcgagttcttggatgaccggatcagggtatgtgttggataccttctccaacagaggcaacaactgcttcagaacagcaaaatcacttgacttcaactacaaaatgaaataaaaaatgtcaaaccca

SEQ ID NO: 246277 - DNA, 943 bp, Homo sapiens
agccctgtcttctccacctagggagagagaccccatgagctcgtcaagctccttctgtgactgatcagagatcccaccgtgagtccagctcctggtcccatgctctggatatatcggtccctggcagcgtggtatctcacagaatctctgaccaatggagagctaatcaaagacaagtttaataggtgaagaaaatacttggattgggaggatggctgaaaagtcccattgaacaaggccctcaaatggagttcctgtggagtggtcacctttttgatgacttcaactgggaacatcagtacggaaccatcgctgggtgttcattccatcaccccttcctatgtccctgctcaggacaccctgcgtctgtctatatgcattgctaccagtttagacagtgagttacatttagtccatttgtgcattgttctttattgtatccatggtatctagcacaattcttgttcttattagagcttggtaaatgtcattgattaatccagggcagattatctctctcattttcgtgaatcctctgcataaacaatttgattaaaaatttatgacaaaattcatgaggcatggtgatgtatacactgatcaattgatttagagtgataggtagacaagatgcatttacatatttatctattgtcctttcagtgtgaagtttcttcttagtggcaaaagttctggctacttgtatatctctcatggaacgtcattattactggcagtgccgtggctcttcttcacttttttgtattgaagcaacacagatcatacctctgtagttccctgataccatgtgtttaatggtagttacatcatcactcaagaggctgccttgtccagcgtatatcttccatactggcttccactgaccctctgaaagctgttactgtgcttccattggcaatgatcacaattgcaaatcttatcc

SEQ ID NO: 246278 - DNA, 531 bp, Homo sapiens
tatttttgtttctcagagattaccttggggagtgtgggagtagggggcttcactgatacttaagttgattctcactttgaaattgtacctcccactgtaatattttaattttgtagttgttttagatgcttgtagttgttcatacagttttcattagtatcctcaactagactcaatttgaaaatattcttcttatttatttattctttataaattttgtctacagttagtagacattacaattgttttggtggctgtatgtagttattttaaaaaacaaagtcttttataattccatctcccagaggcaaatactgtgaacattttgaatatttcacttttaaaaatgcatcttaacatatttgttagcacactagtatttttcactttaacattatattttaaaaaatcataacatataactattttagatggtcatataatttatttttctactgttggttatatatgttatttgttttactattgtaaataaagctgcaataaacatttctttgtcagttcagacta

SEQ ID NO: 246279 - DNA, 903 bp, Homo sapiens
ggagccagtctagctgctgcacaggctggctggctggctggctgctaagggctgctccacgcttttgccggagacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctg

SEQ ID NO: 246280 - DNA, 730 bp, Homo sapiens
ggagccagtctagctgctgcacaggctggctggctggctggctgctaagggctgctccacgcttttgccggagacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagaggtaaaagaatgctcttagatgagagatgggaccacctgagaccctcagctttcctcctaccattatgtacccaatggaagagactgagttggtgcttcttgctagtgtgcatagttgggtgaggctgtatttctctgagacaggagaaaggatacttggtgttatcacagcatgttcacctgtctcaagatacagctccctctgtg

SEQ ID NO: 246281 - DNA, 597 bp, Homo sapiens
agagtatctagtcttccttctgttccagatacttcctggtagttagactacatgggcttccccaggaatcctgggggacttaagagcatcaagatgcattgagttttggcgcaaggatcttcccttgccctgccacccacagaggaaaagcctgctgccctccacagcggcattattgcagacaggcaggagaaaacgaaccaggaaaaacaactttcgcaacctgaaggtttgtctctccttttccctacagtgtgtcagaactgcattgaactaaatgcagccaccatatctggctttctctttgctgaaatcgtcagcattttcgtccttgctgttggggtctacttcattgctggacaggatggagttcgccagtcgagaggtaaaagaatgctcttagatgagagatgggaccacctgagaccctcagctttcctcctaccattatgtacccaatggaagagactgagttggtgcttcttgctagtgtgcatagttgggtgaggctgtatttctctgagacaggagaaaggatacttggtgttatcacagcatgttcacctgtctcaagatacagctccctctgtgaaaaaa

SEQ ID NO: 246282 - DNA, 1176 bp, Homo sapiens
tcggaggatctcttgaacgcaggaggtcaaggctacagtgagctgtgattgcgccactgcactccagcctgggcaacagagtgagaccctgtgtcaaaataatattaaataataaccagcaatttgcagggaagcttaaatttcgcttctgaaggtttgataactgagttggctgaactaaactaacagtaggttaacaagagaaaacccatacaaatttattgatatgtaagcatacattaatagctagcaaaatgtctatgggcatgcagggaaatcaacactgcagtctagcagaatccatggagaagtggcaagcaaggtggagactgtaaaaaaagaggagaggttgcaggacctaggggtagcagaatacagataattcccagaaagagaaagccccaccctggatagagaagtgagaagaggtgtaagatccattagacaaaataagagacttgaaagaaaatgagaccaaagacgcagtctcatgaaagtactgcttctggggaaaggaaagagggtgccttggaagggtcaccatctacctggaggcttggtgatagagagaaggggtagtagaaattaaggatcttggtgaaccagaatagaaaatagatactcatttctcccacccaaaaaggagtcattaattaaaaacagaacagaacagaaaaacactttattaggtactatttactaagaaatccagttaagtcatctaaattccttgcttctgcctatacacaactatatctggtttaggaaaaataaaatatttcaagatgaacagaagatggcaggcaacatccatataaagttactttagctggaaaacaaaatgatagtcaaaacatttcaactgggctgggcacagtggctcacagctgtaatcccagccctttgagaggccaaggtgggcggatcacttgagcccaggagttcgagcccagcctgggcactatagtgagacctagtctctacaaaaaataaggaaaaaagtttttaaaaaattttagctgatgaaaagtcttcccgaaacatccaactatagcactaaagaaaactacagcacagtactcctaccagaatttaaaatatccttaaactaacatttgtagagataaaaagtctcaaatccaaattcaaaactgcaaaacaaatggacaaaaagag

SEQ ID NO: 246283 - DNA, 228 bp, Homo sapiens
gatattttgggtttggcaatcacaaagtccttggtggcatgattaggtggcggaagccagaactctgtgggtagaagagttaacaagtaagggaagggaaaaaaagattacctttttctctaaatgtggctgaggcaggagaatcgcctgaacccgggaggcagaggttgcagtaagttgagatcacaccactgcactccaaactgggctgacagagactccgtctca

SEQ ID NO: 246284 - DNA, 704 bp, Homo sapiens
tgggtaacaggagggtggagggggcacattctgagaatacacactgtctttcactactctggggatgggagatgcctctgttattttccccaaaggcattaccagtgttttctgcaggttaaaggtgggctttctttagatggaaaaaacatgatgagtaatgagctggtaaggaaaagctgagactaaaaaacaaaaggtaaaacacaccaggtccaggagcttaactatcttcctaacttggaccacgttttagtatatagctgtaagaggcttttattaatcataactcttagaaatcaatttaagaaaatatagtacttatctgcatgtataaagccctgtacagataagcctaatatctaggaggcctgtgcttggtaggcttatcttggtaagtttatcacatttattcatcctattatggaaaaaataccttgtccattcctgaattcttcctttggtggacctcagttttgggtagatcttagccttcaaggaatctttacagttgttcttcatctttcatcttgaatgtagttattattcctaactccttctttacagctctactttgccattgagatttttttttaattgacaagaattctgccctaattacttaaataaggattttcacactatgtccaaaaaatttttactgttgattcaaataataaataccaactcgtcacttcaagtca

SEQ ID NO: 246285 - DNA, 532 bp, Homo sapiens
  misc_feature (422)..(423): n is a, c, g, or t
  misc_feature (441)..(442): n is a, c, g, or t
  misc_feature (480)..(480): n is a, c, g, or t
  misc_feature (519)..(519): n is a, c, g, or t
atgatggagctacatataaagaatttgagagctgaagtagagtcagtggaaaactaatatggatccgccactgattggctgaaaaggggaaggatgttatctaaatctgaattatgttgaacagaagaaaagagaagacagggttaagaactactctaccggatgattagtggtaactgttaaataatataagaaaatgagaagagtatactcaaggggatagaagagtttatgtacgtaagggagatgtccttaaagactgacaggaaagaaatcacccaggaagagggccaggcatggtggctcacacctgtaatcccagcactttgggaggtgcttttacttttatcaaaagtaaaaaaaaagtagctaatttaatgaataattgatcttttcccaactaaaacgaaatattatccatnncaatttactgatgttttnntatgttttggggaatatctctggactctcttctgtccnacttttgtcccatgtaaccatttggaaaccactcttaancttcgaaccttgt

SEQ ID NO: 246286 - DNA, 346 bp, Homo sapiens
atgatggagctacatataaagaatttgagagctgaagtagagtcagtggaaaactaatatggatccgccactgattggctgaaaaggggaaggatgttatctaaatctgaattatgttgaacagaagaaaagagaagacagggttaagaactactctaccggatgattagtggtaactgttaaataatataagaaaatgagaagagtatactcaaggggatagaagagtttatgtacgtaagggagatgtccttaaagactgacaggaaagaaatcacccaggaagaggcacgctcttgctgtctttccgctgtcgtgctccggtctttcgtagcgccagtatcgg

SEQ ID NO: 246287 - DNA, 330 bp, Homo sapiens
aaacgcagctgtgtttatttcaatgcgattacattcaaataaacacacatgggatcccttatgagcgtgaacccataaaacacttgttgatttggttctgaaattgtgtgttcaaataaacacacttgttttaagggaagtttcgctttactcaaatgttcatgccttgaacatgtgttttatagagggcagatgtagagtgtcttaaaagaataatagttctttagaggctgagtcattgctttagacaaatgcagaatttatttaatgtgcttttttttaatatattggtaattgtctatataagtaataaaaatcttggaatatctc

SEQ ID NO: 246288 - DNA, 408 bp, Homo sapiens
agatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcatacca

SEQ ID NO: 246289 - DNA, 743 bp, Homo sapiens
gggcacagtggctcatgcctataatcccagcacttggggaggccaaggcgggcagatcacgaggtcaggagttcaagactagtctggccaatatggtgaaaccccatctctactaaaaatacaaaaattagccaggcgtgatgccgggcgcctgtaatcccacctactcaggaggctgaggcagaagaatcacttgaacctgggaggtggaggtttcagtgagccgagatcgcaccactgcactccagcctgggcaacagagtgagactccatctaaaaaaaaattccatagtcttgctgtaacagaggtatgtacacatggctgttgaaacggaaaagagacctaggtaggtggctcacacctataatcccagtgagtcatgatgctgaggtgggaggattgcttaaggccaggagtttgagatcagcctgggcaacatagtgagatcctatctgtacataaaaaaggagaaaacaagaaaagaaaaggatgtgacttaactgcagggtccctgaggaaggtttcacagagcagtctcatgctagcaccagagggtcactttccctcactatcttcttcaaatacagaaaactttgagaaatcttacaagttgggagaacagcaattgcaactctggagtctaggaggactaatgccagtcagtcatgttctcggctagccaacctaagatacccatcaggagtgggagagtggttagtatccttggagtaggctccagatc

SEQ ID NO: 246290 - DNA, 991 bp, Homo sapiens
aaaggacagtacacttgtatccccactagctaagatcatgttgctctcatgaatataattcactaccaaaaacttgagcatgcatctcttaaaaataatattcttttggttgggcatggtggctcactctggtaatccttgcactttaggaggctgaggcaggaggataagttgagcccaggagtttgagaccagtctggacaacatgacaaaagcccgtctcgacaaaaatagaaaaaaatagttgggtgtggtggcatgtggctgtggtcccagctgcttgggcagccgaggtcggaggattgcttgagcccagtaggtacagtgccatgatcatggctcactgcagcctctgcagtccggcctaggtgacagagtaagaccctgtctccaaaaaaaaccccaaacttctatttttcagttgacttaaaaaaaagtcttatctacgtaacgttcacagattgtatataattgtattcttgggtcttttacaatttatgattgttaaccccttcacatacctttctttttttctcatctcattaatactgaaaatcctgatgtctgtgattcctagtttaggtgtaaaggtttgattagcttcaggttaaacattttggtaagaagatcccaagtgatgttgtatacttcatattgaatcatattagtacatgtgtaatatcagattttcttactgttattgatgcttggtcacttgtttaatcatttgattaaggtgggaactacaagatttctttgtaaaggtacattttatgctctttgcaattagcaagtaaaggatggattacttctttggcatcctggaaataatcttattcccaaaatccttttaccaggtgcactcacacacacccccactctcactcatgctggtacagtttaaccatgccagttaatctagcatgtttatctttggaatttgggaagaaacctgagtacccggagaaaacccacaaagacgtggggagaa

SEQ ID NO: 246291 - DNA, 468 bp, Homo sapiens
cgggggcccaagggcagaaagggctgcagggatagcctcatcagagggcactcaggcaatggaagagatgtggctgtgtttctgctctctgcagaagagagtcctggaggagggccagcagctgccccgggtgctggggagacagcagaagagggtggacatcagcagggccagggcgatgatgaagggacatgagataagacactttggtgactgattcggccaatgcttcttgaagaggagtgaatatgggcagagtctgaggtggagcctgaagcagatctaccccaggggaattcaaaagtgtctccggagacttaaaatgttaaattcatctaggtttcacattcttctccatgttctatttgtgcttactgcaacattagaatcccgaagcatgcacgaatccttccaaatctccaaataaaacatatttgtttgttttaattgctgtacaaatatgaactc

SEQ ID NO: 246292 - DNA, 416 bp, Homo sapiens
ctgtgctaaaattctgtggccttagttagcctgaagggcccttcagtccctggtgctgctgtttctgtgacataggaaccctggcggtaggaccctgtattagtctttttaaattgctatgaagaaatacctgggcagggcacagtggctcatgcctgtaatcgcagcactttgggaggctgaggtgggaggaccccttgagcctaggagtttgagaccgacctgggcaacatagggagaccccatctctacaaaaaaatttaaaaattagctgggcatgatggcacatgcctgtagtcccagctacttgggaggttgaggcaggaggatattttgagaccaagaggttgaggctgctgtgagctatgatgattccactgcactccagcctgggcaacagagagagaccctgtctc

SEQ ID NO: 246293 - DNA, 653 bp, Homo sapiens
gaggtggcggaggccccgagggctttgcgtcatcacttctgcggcctgcgggcgagaaggtgcgcttcgggagtagcgcgggaggacaggaggcgcaggttgtgagggacgcaggccctggggcttcggtctctgtcctccgagctcagagcctccaggcttcttcccggccgcgcgctcagcactcactgtcttacggtcccgaagcgctttaaggtgcgcagtccgcaggccttgcctactgatcttccagccaccccttgaaggaagcagttgcagacgctgagcacagtgccaaacctatatagaaactcatttgggatatggaggagaatatgccaccagttctccaaagtggaggggaaacctctcaactctggctggctgacctgctgccctagcctcccccctcctctcgcagctgttgggccaaaagacacaaagaacgagcccagtcctcctcgtccccactccttgtgaccaggggatatggacctaatgaatcatcattttcagtatggctacccttcctttttcctccaccctttccccccattctccctcagacctggctaattaaaaggaagggaaacagaatgcataatgtgggtaactatactgtaataacagttaacacaaagtgtttccatttg

SEQ ID NO: 246294 - DNA, 714 bp, Homo sapiens
aaaatatgaactttagttaacaataatgtatcaatatcagtttactaatgttaaaaatatactatactaatatattaataatagaggaaactgcagtgtggggtatatagggactctgtactatcttcacaataaatctgtaaatctaaaaccgtgtgtgtggtttttttagactaggtcttgctttgcccaacatgacatactgaggacacatcacctctgtattcttcccaaaaatctactatctaatcgtggaaaaaaatcagacaaaccccgactggcattttgtaaaacacctggccgatactctatgaacgcatcaatgctatgaaatgcaaggagatactatcacagattggaggagactaaggaagacataaccactaaatgcaatgtgatagcctagattgaatcctggtcatcctaggtgacaataaattatgacttgtgaaaatctgaataggatgaaagtttaccactaccctaaccacaatagaagagagttccaaatccaatcacagtgctgcacatcagttttgaagtcagctaaacattgagtcttagcaccctcagttactagcttcatgaccttagataagttacctctcccagtctgactttatgattcataaaaggaaaataccaccagctaaggtgtgttattgctgtaagaatattaagcaaagtgcagtaaatcttacttatttctctctt

SEQ ID NO: 246295 - DNA, 710 bp, Homo sapiens
cagagctacgtttatctgtttccaaagagtacactctcccctcaattcccagtagtacttctccagtaaatcttaagtattgtattgcttttttcccttctatttctcttagcagtctatagaaaagagcgtttatttaaagattttagtgctcatctgggcatagtgactcatgcctgtaatctccacaccttgggaggccgaggcaggaggatcgcttgagcccaggagttccagaccagcctgggcaacatgacggaaccctttctctaccaaaaatacaaaagttagctgggcatggtggtgcacacctgtagtcccagctactcaggaggctgaggcagcgggattgcttgagcccgagaggtggaggttgcagtgagccgagatcacgccactgcactctagcctgggcgacagagccagatcctgtcttttaaaaataaaaataaaaataaaaaaagattttagtgccccctataacttgaggcttggattctgaagtgaaagttgttgttctgagaggtgttgattgagcagtagtaataccaactacatcagtgggacttggtggcccagtcacacggatgcagtcagaaagggagtgttacctcataaagcagtgattcaagcctgggcttggattttaaaatgttggaaagttgtgaagaaatgggattttttttttcttccaaagattgtaataactt

SEQ ID NO: 246296 - DNA, 564 bp, Homo sapiens
taaacaacagtgtctgcccaagataaatgcacgtgtgagatagatttcacccctgagagcagttcatctttccttctgcatgccattttccctgtactgcccctcaaatggattctgaacatatagattacattatcacattaaatgaggatgagtaaacttcaaaggttcagagttaagatgcacctggacttttagattctgacttgaaagcgagctcacattaactgttccataaagctgtgatggagacacctaatgtcgttgtcaaattcctctgagtagtttttcaatgagccaaaccaaatgcaggacttcagggcttgtgagttattctctctaaagtgatgctgcaaagaaacataacataacgattgacaattttactaaaatcatgtattataaaagtgtatttgtatcagtactcacagccaattgtatacctacctagttgtaaccatttagttattacacaagaaaaaatgtgtgtaaatcgcagtttgggggcacatagaaacaacactatatacaaattataatttgtattcattgtttattccttta

SEQ ID NO: 246297 - DNA, 203 bp, Homo sapiens
cagcctgggcaacaagatcaaaactctgtctcaaaaaaaaaaaaaaaagtcacattatttatacaagtattttattttctacagaaagataatttgcttttacaaactaccaggaagttttacttgttcattcactcgcttaaatgacattttagagcacctactctgtgccagacacaatagtgtaggctgtactctcatta

SEQ ID NO: 246298 - DNA, 268 bp, Homo sapiens
aagctgtggctctgcaggacacgtgcggggtagacctctaaggccttgtcccagtggaaatgccctcccacttggcctgggtagctgctcacgcttctgaaacgggaaaaatcaactgcattcctgaatgggagcctcagagcattagaaaagataatgttctgattttttaaagctaaacgtatatggaaggaagctgaaagaggacttttgatgagtcacctaatgttgatgttgaaataaacctaatgaccctctggctaaaatc

SEQ ID NO: 246299 - DNA, 197 bp, Homo sapiens
actgtagtagagaaagtttaatagatacaagactagtcatgccacatgggaaatggagtttgtactcaaatgatctcctccaaaggtcttaggtcaggggtttttcaaaggcagtttgggggaagggagggggtggccaggtaataggtgcttgctgttgattgactggggtggagatgaaataggcgtcaaagctg

SEQ ID NO: 246300 - DNA, 370 bp, Homo sapiens
gagtttcctttaagctgtgtgtagaccaaaaaaaaaaaaaaaaaaaaaaaaaaaaaggcaagtgttttcctttgtaaagcttttcctttccttgtatttgcacattttttttttttttttttgctagtgaacttcagtcaactttcctcttaaagtttaaacatacatttcagagacagatttcagaaaccatggcccctgggcagtaatattgccacaatgaccaaggtgatctggtaaagctttctaggatctttcctcagattttaccagggaggaaataactcagttttacataaaaaataatttggcttcaccaggactctcctgattataatggtgactagtgctggttggtgtactgctaaaa

SEQ ID NO: 246301 - DNA, 540 bp, Homo sapiens
atgaattcacagatggctgtctcactgatctcttctttgtttgccaatattgtggctgccaaatttactgtgatgcagaggtatcttgagtaactttacaagaggctcttaaaccaaaaaagtgtccatggatcagagaaatggcttttatctataagccttgtcatctcctctcgcaataatcttcatataagtaatcatctcatcatatatagatcaatcagccttgttaatgctctgatctcagctctcacttttcaatgcagccctcgtgactaggaactattttctttgtaatttgaggttttgatttagtggtcacattagtcttgtcagtttgtagcagcataccatgatgttattcataaccagtgatagtattatctgctataaagttgcactgtaaatcaggaatagttgtcaacttaaatatttatgcatgtctagggaaagtaattgttaggcagacaccctttgctgtaaaacaccaacaccccagttctgatgtgttcggaaaaagaaagaaataaaaattaaaaa

SEQ ID NO: 246302 - DNA, 510 bp, Homo sapiens
agaataagctgtagtctagttggtcagagctagttgtttatgaacagattgtaaggctggataatttgacttcaagtctgtactcagcaagtctttatgtttcataaccattaaagtccatgctttgagcatttttgataaaaaatgtgattttaaaccaggactagttttcacaagttaaaggagttttaaaagaaaccaaaatattggtacaaattaattacaggtttatgcatttcgaaggcagataccctgattaacattgagggtatcaattgtttaagataaaatatttgagaattatatttaacatatgcaataaatgtttttattcttaaaattgtcgaaaagaatagaagaagttggtggtggtgatgaaatagtactaaagactttctgctttcaaacagaacagacaactggagagctaatgcacatccttgctagttaggcgaaaatttcacaggaatgaaaaagtaaagcagactttgcaggatctatttctttaaa

SEQ ID NO: 246303 - DNA, 395 bp, Homo sapiens
gtagctgtgaagtctgtgtgtacatgttaccaagaaggttataatgcttcccatcagaggagagctagaaagataataggtgcagccttgccagaggagagttgggaaggtataggtgcaggctcacccagagacggaggcccttttagtgttctgttctgtaaaacttcttgtacggtagatggcacatagtgaacgctccataaataacacgattcttattgttactcatcttcaaattctgttatcccaggctgttgaattgtcttggtttcctttgcaagagtcagtgctgactttgtcctgttctgattgctcatgtaattcatggtatcttagtctgtttgggctgctataacaaaataccataaactgaatggcttataaacaacaga

SEQ ID NO: 246304 - DNA, 462 bp, Homo sapiens
tctgggatgacaggagtgaggcactgcgctgggctcatgcatttttgaggaaatacctatgcagcacacggccggcagcaccacagtgtctcagctgtctttccaggaaagtcctgctccccactatactgtgggtcccccggctaattcagctggagtccccgtcgctcgagagcctcctcccaggaaaacgccctttgctgcggcagctttctgttctccctggctccctgcacggaactgagcttcggtacagttcatcatttgtgctgtttcaacaaagaccttcttagggaaatggcctcttctctgctttaattctgagcacgcactggtgaaggacactgtatctgagccgaggcccagggtgtcacccatcagagcctttcaccatctgtgcagatgtcagcgcggggaagggacacctcctttacataaaaacagcttagaccttgcaggctc

SEQ ID NO: 246305 - DNA, 480 bp, Homo sapiens
caaacatcatatgttctcataagtgggagctaagccatgagaatgcagaggcataagaatgacacaatggaccttgggtactcagggggaaagggtgggaagaggtggagggataaaagactataaatagcgttcagtgtatactgcttgggtgatgggtgcaccaaaatctcacaaatcaccacgaaagaacttactcatataaccaaacaccacctgttccccaataacctatgaaaataaaataataataaaaagaagaagaaagcatactaaaataaagatatgaacctgaaacttgtcatccacccaacctggatatgcttgccagtatgtgacatcaataataacatcatgactgtaagaccaggcacagtggctcacacctgtaatcccagcactttgggaggccaaggtgggccgatttgagatcagaagttgaagaccagcctgggcagcatgatgaaaccccgcctctac

SEQ ID NO: 246306 - DNA, 582 bp, Homo sapiens
ctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttct

SEQ ID NO: 246307 - DNA, 345 bp, Homo sapiens
actaaagttcctcatccacctgcctcatgggattgctcagaggatagtgtgagacaatctaccacaaagtacaactgtgagccacttcctaactcctgctttcccatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaacaaggcacatgagagagatagtactcaccggggtcctctagatcgtcgacgt

SEQ ID NO: 246308 - DNA, 592 bp, Homo sapiens
ctcaaccagatggctccaaccagagaatcatttatctgacccacagaacagtataaaagaatacattgttgctgttctaagccaccaagttcccagatgatcagttttgcaacaagagcaattgatgcacatctagaggcttgattaaatgtttcagcaggaatacttcatagatgatctgtgtgcttctagcacatcagaaggctcataatgttaaaaggaggtttacttttgaacctgggtaaatgtggattaagggaaacaaacatcaacatagtcattcctcaagttagcatctctcctgggttttagtactatctggtcatcttttagccatcagggcttgtagggcactaatagggacaagtagcgatgttcctccctgatgttcagaatgacctatgcccaaagatagccgcagcatttgtcaagaggaggacattatttcaccaggttatagccacatataatattattccaaagtcatgctgattaatatatttctaaggactttgttcaacccagttttgggggtgtgcctattccttttttatttgacacaatcaagctgataccttaagatgaccaaatc

SEQ ID NO: 246309 - DNA, 963 bp, Homo sapiens
tctggtgcaaattttggtgactgatgagaaattggtacataatttaaccaaaaataggctgtatatcatggcttgcaacctggagacctctggtagatttctttagtgcatcccagccaagtgtccttcagaaattctgttgttgccaggctctcttcattgccctcaaagagctctacataagcagtggttataaagagctttgcatgatatctggagtttctctagtaatggtctcatgtgcctttacctgtgatcccaaagttaaccttggctatctataatttgtgatggcagctattctttgggtaaacaaattagctatctcagggtccataatttgtgtagaaatcctgtgcattacatgaactttgaaatagcctaggaatagagaaattcagtttctggttttagctaatgtcttgagagcttctttgctgcttctgtaacctagatagactttgctgtcacatcatgttccaagcatttgttgccattcagatgcagaatgctttgaagtcatcatttgtcattcattcttccaggaacacctagaattcttaaatagttttttggttctttactttccactttatccaggtaatggttgagataaggcactttatcccagagtgtttctggtaaaatgtttccatgtcagtttctctgagtagtctttcatccatcctgctgttgttactgcctttttccattaaggagcctgtgaatcctcaaacagcctgagagaatgggccctggattttaggaactaggccatgcctggttgatacctttctactaggaagtccagagtgttctttatttaaatgtttgttatttcagtcaaactggattgaaggataaagtgaaactaagaatgaaggaggtactcattgatttatccagttacaagtcagtctaggagcaaagttataacagtatctctcatcattcactattcgt

SEQ ID NO: 246310 - DNA, 538 bp, Homo sapiens
tccagggcaggttgctgataggtcccggtgcctcctcccacccagacttggctggtgtccacaacgcagcctccgctcacctggctcccttataatctcagtgtcgccggagcttctggtcaagtgcactcatcctggagccgactgaaccaagggagccaacggagtcacgctgggtgattcgagactatcccaagcaacacggacctcatgcggcaggtcctgtccccaccacgctgacacttgaaaggcaactgtttgaaactggttcaaatggctgtgtttgacttgaaacacatccgcgtttggtggggctggtgaaaatgaccttcggcagttcagaaacagcggaagatggacagtctcacgctgaggtttcaaggactgtgctaaaaataagattaactaagaggcagagaaggaggctcgtggataatcaaatgtgtaagattggaaagagccgctgtaatcaatttacatatcaggaaagggtaattaccataaccaaagggaaaatttctccaagccaaatggttaa

SEQ ID NO: 246311 - DNA, 524 bp, Homo sapiens
ggaaaagcaagatttgagaatattcctctttactgcattgtcattgcactctagtccttctgatttcccttgtttctcagatgatccctacgcccaattatacagaacagtcttcctctagttacttatatcaaacacttgcctgctagctgtgtttggcaggccagcaggatgaggtaataatcagaagaaaatgttctggtttattggcctcatccacgtacaacattattcaaaatagttctctgtgggtgagaacagagttgctttgagatcccctggtctaatgttctgtagtagtgaggaggaacaaaactgtaaacttttttgatctcttctagaataatggtaaggtaaatgatatctgcttggcccatcctttcagtaatgtttacaggcagttagatgtatgtgaaaatgagagcctttcatttataaacattttggctttactctttccaagtccagccatcttcttacgtacagcctccatggtcagtacagcagtgttttcctaaaagcat

SEQ ID NO: 246312 - DNA, 400 bp, Homo sapiens
ttcagtttgataatgaaggagaataagtcattgtgattgcattcccatgtgaaagctatgagatgccccattttagttttctcaacaacctaaacattatataaagatagattgcttactgttttgtttccattaagttaaaaagcatatcatttttttaagctgatgaaattttaaaaaccattcagaaatctataattctaccattattatttttgttttattttattccagcctttttatttggacgcttttacattgctataagcataatgtacatattcctttatagtctactttttaaaatttgcattatatatcaaattttttttcatttgttatgtagccttctaagaaagcaaaagctatatatataatccttatggaattgaaaattcag

SEQ ID NO: 246313 - DNA, 597 bp, Homo sapiens
agataaacaagatgttctgatagagaataacctggagatctacttagggtgatttcaaggaaaattctttttctgaggcgataacatttcagttgagccctgaagcatgagaagtgaggattaagagcctcgggaagatttttccttacagagggatatagagatgcagtggccttgagtaagggaagagcttgatttgttttaggacctgaaggaaggctggcaaggatagagagggaagggaggagccagatcttagggatcttctcagctttggtacagattttggaattttaagtatcactggaggccctcaaatagtgccttgacgtgatccgataaattgggctggtgtgtgaaaagatttgaagggggtccaggaataccagttggcagagacctggggactggggatgaggccagtattttgtgtgccccatttcccagggaacaccgcaatttatattgttggttggccatcctcctccttcgaacaacagttgacacccgtccacccccccccgtgcgcaccctccccctgcactccgccctgtcctaaacagggggaacgccataagccgggcgaacattcttccg

SEQ ID NO: 246314 - DNA, 460 bp, Homo sapiens
ttctccagtctggtaactaccccggcatattcaaagcttttagccttgaaggagttaataatataccacctcaaaatatgctgctgtggcatattgactattttaaattaaaggcacttaaaaacagcaggtgcaagatcactgtcatggatattatgtgtcttaaaaggaggagatgaaattcccatgtgaaagatgtcttccctataaaataacattgttatcttcaaggacagaaagttgaagtcgagggaaatctgtccaaacaaaatttgttaatccctatctttctagtcgcttctttaccccaagccccttcgccttatcatgtttcacaactactattttttgtccatttcactctataagcaattggctcttaactgctgctttaggtcttttttttttttaatgagggcccccgtgctatgtaaaataaacatttgtgtggttgtctcct

SEQ ID NO: 246315 - DNA, 382 bp, Homo sapiens
gtatttgaagggggtcatggaaccaatcattggtactgcaggaagactgctctatattctcattgtgcatcaatctccagaacttcatcttgcagatgtgctgcccctccctcacctttttgaaagagcctttgatgattatatggattcctgtcttttttattttttgaggtggagttttgctcttgtgtgccaggctggaatgcagtggtgctatatcggcttactgcaacctccgcctcctgggttcaagccattctccagcctcagcctcccgctagctgggattacaggcacccgccaccatgcccagctaatttttgtatttttagtagagaccgggtttccccatgttggccaggctggtctcaaactcttgact

SEQ ID NO: 246316 - DNA, 344 bp, Homo sapiens
tgctctctccaggctgcgctgacacacagttcccccggggagtgctttgctgttcagccctccggctgcgcgggaaaaagcgtgtatcctcagctgagttgtgccagggcgcttccgagcaggcctgggcactgcaggaactagccgtcctcgcccgctccggagtgcaaccaccagtggttactttgctctttacacggcattctcaaaactaatgataatagaatgatcggttctgagacaaagctatggggcaagttgaaaagctctaagtgcttcatttaaaacccagtggtttaacccacccctatgtttaataaaacattaaacagaattgggctgag

SEQ ID NO: 246317 - DNA, 340 bp, Homo sapiens
ggggctctatatgggggctgttgacaatttctatgctttcagccacggtgcagcactcagccttttgtccccaacccgcttgcaagttcatgaggctagacccataacttctgttttgcaacactcttacctctaacacagcacagatattaaaacatcttacgtgagctacatgatctgggagtaaatgcctcagaagtttctcattctgattctgttacgtagaaataaaacaaacacacgagtttcaatagcgtcagatgaaaacagttcctgtcttgctacccataatctgtatgttccatcagtgattaagggacagcagtagagaaaccacaga

SEQ ID NO: 246318 - DNA, 715 bp, Homo sapiens
aagagccgtcctctggcagatatgtgaaagaactgcctatgaggagcgagaggctacttcgcacacctcgcagctcaggtccccggagacggctttacaggcacacaagcccctctcccaagccatctgccaggagccccatgaggaacacagcacagcgcctgcatcagaagcccatgggtttgcctatcacatgtcttgttttctcctgatccgtggctcacaggctcagtgtgacccaacctcctagatttccccatcagtgctatttgcagtgcccccaagcactttcctccactccagtccctgagcgcatgccaacggccctattttcagccacccctctccatgcctcttgtctgtctctagctgacaagcagattatctcttctgtccactttgtttgccaatgtactttggcaccattgaattccaacacatgaagtaaactgaactgtgtacaacgctgagcacacacgtggtttggagagcagccccttgtcaggatccaaaatgttcccaagccttgttgatatttgggtcactgcagatctctgagtcccccttcctttttaatcttcttcccctcaactcattctcaatttctctctctgaaaccacctgtgaacacacttatgcattcaaatagatgcatactgttcatgcttatatttttctgtaaccgtcatatctaataaatacttatcatccagga

SEQ ID NO: 246319 - DNA, 375 bp, Homo sapiens
tgtagtcctgtaatcccagctactcaggaggctgaggtgggaggactgcacgtgcccaggaattcgaggctgcagtgagctatgatcatgccactgtattccagcctgggcgacagaacaagtctctgtctcttaaaaaaaaaaaagaccaccaccaacaaaaccccataccatctcttatcagctgcattgggagccctgggcctttgaaaataaggagacaaaaactagagcctttggggcccagctgcctcttctggcatactccaggatgtgtgcaaagcttccccagtgcctagggcctttgtattctccaccttgaagcatctccccgaacttgtaaaccaatcatcttccaaagtttttgaggtctgc

SEQ ID NO: 246320 - DNA, 457 bp, Homo sapiens
agaaaaagcttttttattgagtgtcaggccctgaggacacaacaggggtcaaaagccacactaccttggccaggcaaggtggctcacgcctgtaatcccagcacgtgtgtggggcccatgctagacctgtgggggagagacagctgacagctaagttgctctttcccaagggctgaacagtctagtgaagagatggcccctatgtattcagcatccagtgctgggaagacacaggaagaggaggctctttgggctggggccggggtttggggacagcctcctagagaaggtcgttgagctggtcttcatggatagaggagtggcatctagaaaggaaggagaattgcttgaacccaggaggcgaagactgcagtgagtggagattgcaccattgcactccagcctaggcaacagagcaagactctgtctcaaagccaaaaaaccaaaaaaccaaaaa

SEQ ID NO: 246321 - DNA, 326 bp, Homo sapiens
tcctgtttccatcccagaaatgctgatgtgtagccaataagcctgttcttatgatatgcacgctctcaatttggctgatctgaggggtttagctaagccttgggctttgattttcccatctgcattttcagatcctcccccatctgtcactggggcagtagtagccttctcccccaaccagctcagcaggattaggccctgtggtgcccatgcttgggcccaggatgcacaagtcagcagaactccagctgggattcctgcaggcttgggcatgggaaactgagtcctcactggttcttcccagagattccttgacacatcctttc

SEQ ID NO: 246322 - DNA, 589 bp, Homo sapiens
gtaacagttatcttaggaatcagagcaggaattctggtctctttctcagagctcatgcccagaagaactcagggagtaggggaaaatgggaagaaagggcatgagagtgaagggtaagaggaaaagggaagagaaagagaggactaagaaaggtagatgtgcatggtacctcctgatatgtatcaaaataatgtaaggtgtagcacattaaagctttagagttatgaccttccagttgaaccctcttgtttaatatatgaaaaccagaaaacttgcctaaagctctataattacaggcagaactgaaaagacagtttacctatgattactcaatgtctaaaaaggggagttaactaggaaaaaattaggtaatctgttggtacttgaagagttagtttcagctccagaaagagaagatacgtgatgtgagggatctgtagagggaaatgagaggaataggtggcattacagagagaaaatacaagaatcatgcaaatttggaaagttctatgttgtaaacgaaatgcgtgaaggagaggcagagaggaccactacctcagggagtgagataatataacctgcctttttc

SEQ ID NO: 246323 - DNA, 240 bp, Homo sapiens
cttcacaaaatgccctttgtcagagaataaaaagagttcaacaagcttggcggccttctgaaccaggtacttgctggcacagaggttccttcagggctacaagacacattaagtcatgaactattcttgattaaagatttgactgtgaaagaagatagacatatttatttaccactaaatctaacattaaaaaaaatgcatgttttactttggctaatgaatgtcactttcaaaaccatc

SEQ ID NO: 246324 - DNA, 1756 bp, Homo sapiens
ctgttcaccggaataacacaagagcaacaataataatgtactcatttactaaaccaagttgaataaatacatttttccaggttgtgagtgaaaatagcttaaggtctgccaggtttttagagattttgtcatttaacttaaacgctaaaacattcgtcccttgaagcggataccattatagaaaagtgttaattgcttggaagtttcatttattgaagttcaagtgtttttctcttaaattcagtatgttggcctgtgagttacggtcataaaagtattgcaggaattatttacctctgaatgagaaagctcaagatagttatatctccaggaactttcttcgtcttctgaacttcccccaaccccagcagacacacacactgttctggttactttcctgatcaaattcgagtctttcaaaatagcttttgatatgtcccaggagttaaacacggtatgtaaatatgaactcaccaatgtggaacaaatggagtgatctgttatcccctgggtttagacgctgcctttctattaatactgctcacaggagacagagtagggactcgtgtgcactggccacgtctcaacagcagtgtgaccttgggcaaggccttcctaagtcccgactccctgtcctctaacatggtgttcatatcagcctcattttcttactgggaaggttacgttatgtaatatatgccagccatttttgcaaagtgctgtatacaggagatcttgagtgagtgtgtttccctcctcctctttttgggtagctatgttaggctgttcactttgggcatttgccctgaactaaaatccctaagtccctttccccaaggtgaaactaagatagagttttcatatttatcctgtcttattcttttcagggaaaagattttacatctgttgaatttcatccttggtttaaagttgttcttttaactactgagatcttttgaaaatcttgatggctatttatctgattaatggtatttcctaattgattgtcatccacagaattgatggtgtatgtattccatgccttcatttcgtcaatgacaaaacattttaagcaggttaatactgatgacagatttctgaggttgcctgtagagaccattctcttcctcgatattgctcagaagttgaatttggtgtctcagcccactaggaattcgtctaacagtgttattacgataaaatgttactacaaacttgattaaacttctggtggaaattccatcacattttatgcaattttcaatttatttctccaatttatttttaatgccacatggacattatattccttaaccattcttttgcatgtgattaacatttgtgaaattaaccacttaagcaagtgtttttgctttgatgaaagaaaaatgtttaaaatcctactggatatgaaactgaaagtaatgttttgtgttttttgtttcaaatgaaagtgtaaattaagaatttgttggcagggcgtggtggctcatgcctgtaatcccagcactttgggaggccgaggtgggcagatcacctgaggtcagcagtccaagaccaccctggccaacatggtgaagtcccgtctctactaaaaatacaaaaatcagctgggcatggtggcgggcacttgtagtcccagctactcaggaggctgaagcaggagaatcacttgaactcaggaggcagaagttgcggttagccgagatcacgccactgccctccagcctggggagacagagcgagattctgtgtc

SEQ ID NO: 246325 - DNA, 1320 bp, Homo sapiens
ccaggtagacctaactattgttaaacacggtatgtcaccaatgtggaacaaatggagtgatctgttatcccctgggtttagacgctgcctttctattaatactgctcacaggagacagagtagggactcgtgtgcactggccacgtctcaacagcagtgtgaccttgggcaaggccttcctaagtcccgactccctgtcctctaacatggtgttcatatcagcctcattttcttactgggaaggttacgttatgtaatatatgccagccatttttgcaaagtgctgtatacaggagatcttgagtgagtgtgtttccctcctcctctttttgggtagctatgttaggctgttcactttgggcatttgccctgaactaaaatccctaagtccctttccccaaggtgaaactaagatagagttttcatatttatcctgtcttattcttttcagggaaaagattttacatctgttgaatttcatccttggtttaaagttgttcttttaactactgagatcttttgaaaatcttgatggctatttatctgattaatggtatttcctaattgattgtcatccacagaattgatggtgtatgtattccatgccttcatttcgtcaatgacaaaacattttaagcaggttaatactgatgacagatttctgaggttgcctgtagagaccattctcttcctcgatattgctcagaagttgaatttggtgtctcagcccactaggaattcgtctaacagtgttattacgataaaatgttactacaaacttgattaaacttctggtggaaattccatcacattttatgcaattttcaatttatttctccaatttatttttaatgccacatggacattatattccttaaccattcttttgcatgtgattaacatttgtgaaattaaccacttaagcaagtgtttttgctttgatgaaagaaaaatgtttaaaatcctactggatatgaaactgaaagtaatgttttgtgttttttgtttcaaatgaaagtgtaaattaagaatttgttggcagggcgtggtggctcatgcctgtaatcccagcactttgggaggccgaggtgggcagatcacctgaggtcagcagtccaagaccaccctggccaacatggtgaagtcccgtctctactaaaaatacaaaaatcagctgggcatggtggcgggcacttgtagtcccagctactcaggaggctgaagcaggagaatcacttgaactcaggaggcagaagttgcggttagccgagatcacgccactgccctccagcctggggagacagagcgagattctgtgtc

SEQ ID NO: 246326 - DNA, 505 bp, Homo sapiens
acttaaaagaactgagctgggcgcagtggctcacgtctgtaatcctcacacttctggaggccgagacaggcagatcacctgaatttgagatgagcctggccaacatgggaaactccctctccactaaaaatataaagactaaaaaacaagaaagaaaagaattgtagccacacaaaatatattctcagaattaaattacaatagaagtaagtaatggaaagatatcactaattagaaaaattctcagttgaaaattagataatgaattctaaggaactcaactttcaaaggaataatcaaaagggaaattagaaagtgttttaacctgaatgaaaattaaataccacgtgccaaaacatgcaggtgtagtaaaatcagtagaggaaaatgtatagcgcttatctgcttctgtttgaaaagaagaaaaataaaagatcaatgacctcagcttttactttaagaaactagagaaaataaagaaaatgaagcccaatatatgcagaaa

SEQ ID NO: 246327 - DNA, 523 bp, Homo sapiens
gatatcttatttttaattttgggaactctttctccctctatttttatagcaactttttcttcatgggtacagtagcttgttgtaattctctttgagtgttaattgcagttttttattctgtttagttttcttctttcttacatagttgcttttatccaaattcatttttgtttcttttagttcctttctttcctatggaagctttcctcaaatggctaatgatcctcattgttggtccatatttaagagtaatgtagccgggcaaaatggctcatgcatgtaatcctggcactttgggaggccgaggcgggcggattgcctgagctcaggagttcaagaccagcctgggcaacatggcgaaaccccgtctctactaaaatacaaaatattggctgggcatggtggtgtgtgcctgtagtcccggctgctcagaaggctgaggcacgagaattgcttgaacccgggaggctgagattgtaccactgcactccagcctgagtgacagagtgagactctgcctcaa

SEQ ID NO: 246328 - DNA, 510 bp, Homo sapiens
aattaagaccctctgttttaggtaactttgggaacctggtggagcatcctgacattacatcctgaaccagagtatgtctcaagatatttttggatcctgcttttgtggagacagaatccacaacacagcagagagttcctcactccaagaggtacattcttcttactgtctggttcactccctagacacatgccagcttgaccatcatacagagcagcccccaggatgaaggcaaacttctatctggagtctgatctttccaagatagggctgaatcaacttagctcttttttcttgtggctcattgctgctttccagattgagaatagcctcagatttctttctggcttccatataccatgcatcctattgctttgcttatactcttaccccccaatgtcaaaatagtcctgaagtgtataccagatcatgtcacacatatgcagaactgatcatgtcagttcaaccttggctccaagaataaagctgtaagtcctataaccaaaaaaa

SEQ ID NO: 246329 - DNA, 489 bp, Homo sapiens
tagaaagaaaagaagaacaggatgagggggaccaggaatgttggggatggatgtggtggaaggctgtgctattaaataggctggtcagtttaagcctcattgagattcatgaggacaataccacctttctcataatcaaaagtcttaactataataggccaatttcagaatttattttacattgctttcatctgtctattcacactctggtactacactgttttaaatattgaggatttatagtatttccaaactttaccaggttagtttgaaggaaataatgttttcttttttttttctttccacaggtgttatctcataaaggagataatttttaaggtatgaaatttgaaatttttttttcttttggggcacagtggctcactactataatcccagcacttggggaggccaaggtgggtggatcacctgaggtcaggagttcaaaaccagcctggccaacatggtgaaaccctgtctctactaaaa

SEQ ID NO: 246330 - DNA, 683 bp, Homo sapiens
cctttcttttctatgctttattttttacttttcatgtcaacaattgtattcatctacagaagttctgtgtatgcatatttatattctctatcttcatcatgctcatgcttttctctgctttctggaacatattgagaagatttatgatagctgtcttactgtctctgcctgctgcttctattctctctttcacttctcaatctgttgagttttttcttggttatgagtcatctctttctgcttcttctaatgcttgtttatttttattaacattgtgaatttacattgttgtttgttgcattcttgttaactagtattgagttttattcacagttaagatacttgaaatcaaatcttgttttttattctgttgcctcctcagcagcctgtagtctaattttatccacccactgtttctaaatccttctgacaattctatccagtgctcatttattaggaggtctttctatgtttgatggtaggaacataaacgattaccggccctgagtaaggtccagggactgttccacctgttcctttcaagtgacatttttcttaccctcagtactttcctcacatgtatgtgcagatcagtattcaacttgacaaaacctctctgtagattctctagagctctttctctgtgattatactgtcctctgcaggactctgccctaaaatca

SEQ ID NO: 246331 - DNA, 323 bp, Homo sapiens
ctagactgtaattctacctaagcaattggtctcctccgtaacaaatcaccgtgtgaaggcagactatttctatgtcatgagaatgcttaaacaaaaagagcacacaggagaagtgaacatactgtcaaggtgttatatgaaaattaactctaggaagggcatctgatgaggtactggaaagaaggagatctgtcttcataatgtcatcagtaactgggaagagaaggactagagaccaggtaaatagataagtcactatttggtgagcatttcaaatgaagttattccacatcctgaaaaacaaaaatgcatttcataaaaca

SEQ ID NO: 246332 - DNA, 639 bp, Homo sapiens
ccctagtctgacctctttcaccacagatttgtgtttctggttcttgaacttaatggaattatacagtaggtacttttggtgtctagcttcttttactcaatgttatgtctatccatattgttgaatataaaaggggtttattctttttgttgttatgtaataaaatatgaacctgccacagtttgtttgcccattgtactgtggatgtacatttggatagtgtctagtttttgtctatgatgagcacatgtcttctgaaagagacatacactcagtttcttgggcatatgctctgcagtagaattgctgggtcatagggtaggcacatatttagttttagtagatttgatcagatagtttccctgagtctcatttgaaccttgaacttgaagcctttgccttggtgagcttcaggttccccagcttactcataatgcagtacttctgagcccagagactggggagaggatatgtgggaaataactgggagctaagtggcagcttagctggaaggtctctagtaccttgcaggaatttcaggagcaaccccagccaccactatcagacatcaaagatcagacaggataaggcaggtggccccttcactttgtgagaaagccagagcccagagaagccaca

SEQ ID NO: 246333 - DNA, 701 bp, Homo sapiens
aataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgag

SEQ ID NO: 246334 - DNA, 209 bp, Homo sapiens
atgaagtaatttatatggtttagatactgtaataactactgctaacattgtgatgaacacttgccaggcttattattattatatgacatatatcatcatatatctacataaatatgatgaaagatctccctacaaagccattgttatcacctttataatttagtaatataacatatttgttagtaaacataggtataaagtattgtttt

SEQ ID NO: 246335 - DNA, 843 bp, Homo sapiens
tgggacagagtctcactctgtctccaggctggagtgcagtggctcaatctcggctcactacaaactctgcctcctggattcaagcgattctcctgcctcggcctcacgagtagctgggattataggcgcatgccaccacgcccaactaatttgtatatttttagtagaggtggggtttcaccatgttggccaggatggtctcaatctcttgaccttgtgatctgcctgcctcagcctccccaaagtgctgggattacaggcataagccaccatgcccgatggccaagaattttctagaattggtaaacatttgagaagctatgattcctgatcgggatatacaagaaaagaatctttacctagaataagagtgaaaaaaactcaacaattgaaagtcaaaaagaaaatattgaaacagtcatacagaaaaaatggaggagacctgagactgctccaagccactcactttactgatgttgaactgatactcatcactctaagatttatagacaaaactatttatagctatttatttgtagctatttatagacaaagccacaatgggaacccgtatcccttatgtccagtgcaccagttatatgtgatattctgagacaataggcaaatgaatttttatataaagaaagtagttcacttttcaaacttaaaagggaaatatataagaatgcagtcatcttttacatgttcaaaataatgagaacaatatttagcaaatacttagaacctgtcccaccagctaaacgtgttaggcaacaaaaagtagtagaaataagaaaaatgtaatctcttgcctcttgcagtactccatgatggaggtttgtt

SEQ ID NO: 246336 - DNA, 338 bp, Homo sapiens
agagttttagtattttaatattggaattctgtgtaagattgtatttgaaccaggtaccgtggctcatgcctgtaattccaacactttgggaggccaaggtgggcagattacttgaagcccaggagttcaagaccagcctgggcaatatgacaaaacctcatctctactcaaagtatacatactaaaattagccaggtgtggtggtgcttgcctgtagtcccagcttctcaggaggctgaggtgggaggatcacttgagcctgggaggtggaggttgtactagagctaagatggcaccactgcactccagcctgggtgacagagtgagatcttgtctca

SEQ ID NO: 246337 - DNA, 545 bp, Homo sapiens
tctccttttattttgagacagactctcactctgtcgcccaggctgtagtgcagtggtgcgatctcggctcactgcaacctccacctcctgggttcaagtgattctcctgcctcagcctcctgagtagctggggctacaggcgtgtgccaccatgcccggtttatttttgtatttttagtagagaggggggtttcaccatattggccaggctagtcttgaactcctgacctcaagtgatctgcccaccttggcctcccaaagtgctgggattacagtctagcactgagttatttctttaaaattaatccgaatccctaaactatcctgttggatatctttacattgaataagggaccatttctaacccttggttagctttactatcttgcaggataaaacttaaaccgtgttaaatcttgtatcattatcctagttcctaggtgttttccgcaattcaccaaaaaaaagatgctattcttaaatagcttgcaacatatgtgttttctctatgtgattcaactacggaatttccagcatatcaaatg

SEQ ID NO: 246338 - DNA, 86 bp, Homo sapiens
aagcttcagcataaatgtcacttctatttggagtcttgcttaaattttcaaattcagttaggtccccatattacaaaaaaaaaaga

SEQ ID NO: 246339 - DNA, 474 bp, Homo sapiens
cccactagtcacggttggctagaagctcctgcgtttcccctctagccagcaaagcttctagccaccgctattccagaggaccacggcccctgtttttatgtctgagcttcagagaaaccccaccttcccagagaatcagttctgtggcagcatctactcccaaggcactaagcctcagcagagtcatatgatatacaatgacctacttggttctctgcccaggcagccatccgcccaccacctccagccccagctgcacccaggctgagattagtcttttaaagtgagggttgaaggagccttccttggccactcgaggacttaagcttttacatcgttggtgggaatgtaaattagtacaacttctacagaaaacaatataaagatttctcaaagaactaaaagtagaactaccatatgacccagcaataccattactgagtatctactcaaaggaaaataaatcatcatatt

SEQ ID NO: 246340 - DNA, 764 bp, Homo sapiens
agttgagaccgggtaacttatagccagggataatgttcaaagtctttaacaagtggtatggcttgctgaatcagagtagctggaggtaagaatgacatcctggaatcccttcttgtgctaaatgttacccatttagttggtgggtctgggtctaggatagccagggagggggaaacttcaaggggtggggtgcctcagggcagtggctgctgacccacagacctggaagtatttgactatttgaataactggtacaggtttactggtgtctacactggcagagaatctgctgtgcttcctccccttcccttcgtggcaatctagcaggttgctccaggcagcttccccagctcttattccaagaaaacctgcccctggggtggctgcaggtcacagctttgttgtcctgggacaaaggagtgtctggtgattaggcagccccaggggtcctagccaactggaagaagggcttcctgaggaaacacagtcctgggctattttatatgtgtcaggaggatgtagacagttcaacagctctagcaaatgccttaactaatagtggcttaatcaagataggtgattttcttttgtaaaaaattttactggggtaaaataacagaatgtaaaatttaccatcttaacctttttaaggtgtaccattcattaaatacattcacaacgtgtgccaccatccagctctgtaattttgctcattttgtaaaactgaaactctgtacccattaaacaaaaactccccacctacc

SEQ ID NO: 246341 - DNA, 683 bp, Homo sapiens
agttgagaccgggtaacttatagccagggataatgttcaaagtctttaacaagtggtatggcttgctgaatcagagtagctggaggtaagaatgacatcctggaatcccttcttgtgctaaatgttacccatttagttggtgggtctgggtctaggatagccagggagggggaaacttcaaggggtggggtgcctcagggcagtggctgctgacccacagacctggaagtatttgactatttgaataactggtacaggtttactggtgtctacactggcagagaatctgctgtgcttcctccccttcccttcgtggcaatctagcaggttgctccaggcagcttccccagctcttattccaagaaaacctgcccctggggtggctgcaggtcacagctttgttgtcctgggacaaaggagtgtctggtgattaggcagccccaggggtcctagccaactggaagaagggcttcctgaggaaacacagtcctgggctattttatatgtgtcaggaggatgtagacagttcaacagctctagcaaatgccttaactaatagtggcttaatcaagataggtgattttcttttgtaaaaaattttactggggtaaaataacagaatgtaaaatttaccatcttaacctttttaaggtgtaccattcattaaatacattcacaacgtg

SEQ ID NO: 246342 - DNA, 589 bp, Homo sapiens
tcacaggtgcaaaggcccaggttctcccactggctccagtccagggctagggacacctgtaagaccatgatatcatctgatacataacctttacatcataagctttacataacttttacatacataacatcacacatagcattcaggatacacacatcagatcacctttacatgctctaacatgtaaagattaggaaagtcatcaagctcattcttatgtcaaaaaacatctgcacaatttgaacatcaacaatttttgaaatctatcaaggaattgaaattgcaagggaaattacccattccaaatactgaagatacagacatgtccaggatcagaggtgacactggctgaactggaaaagaacttgaagaaagcacgagttggtgagagcacacacatggtaaatgctatgaaagcctaaacggcagatgtggactagggtgagattcctggggacctacactccgtagtcttctgaactttccttcaaaatcttccagattctcaggtatacaatccaaataatttttttatgggtctgaattggggaggattaattaccgagaaatgtaccaagagccttctaaa

SEQ ID NO: 246343 - DNA, 483 bp, Homo sapiens
catttatttggaatttataatcatggaattttcgtactacattaagaatctccatgggtgataatagagcactaaaatagctagcattgcactgatgtttctcactctctacatttgtttaattcctctgccagagacacttacttaacttgtcttggtggatttttgtaatgtgtctttcaaatggaaaaaccgtattcaagcattccagttttatcaagtagcaaaaacacccaggctgttggccagaatttgcatgtttgttactgcagtacatacccagatatctcaggcagaggaataataacaattttccacaatgtcattggatccataattctggcagtaggttaattcacttagccacttccattaaagcaataattattggcatataatcttagaaatcaccatgcattgcggtgttcaattccagttgaaatagaatttttagttcaataaatgtttgctaagtacctacta

SEQ ID NO: 246344 - DNA, 291 bp, Homo sapiens
gtgccactttgggttgtgtctaccacatgttgacattaaaaaattagagggaggccgagtcaggtggatcatgaggtcaggagattgagagcatcctggctaacatggtgaaaccccgtctctactaaaaaatacagaaaattagccaggcgcagtggcaggtacctgtagtcccagctacttgggaggctgaggcaggagaatggtgtgaacccaggaggcggagcttgaagtgaaccgagatcgtgccactgcactccagcctgggcgacagagtgagactccatctca

SEQ ID NO: 246345 - DNA, 183 bp, Homo sapiens
gcccggctaacttgtaagtttctcttagcttcctgtacagaaggcttcaggtgccgatattactgcattactcatacagtaatatagtcttaccccttgctgttgtggcagttggtcattccaacttcatggctctgcttctaatataacatccctgtctaaaatgcagacatacatgtgtac

SEQ ID NO: 246346 - DNA, 377 bp, Homo sapiens
tactaaaaatacaaaattagctgggtatggtggcacatgcccataatcccagctactcgagaggctgaggcaggggaatcgcttgaatccaggaggcggaggttgcagtgagccaagattgcaccattgcactccagcctgggcaacaagagcgaaactctgtctcaaaaaaaaaaaaaaaaaaaagaaaaaagaaaaacaacaaaaagagaaagtaaatgtggcaaatttgataactgttgcatctggtcatggagattctttgtatagttctacttttacgctgcttaaaaatgtttgataaaaccaacatggcatatgtatacctatgtaacaaacctgcacattgcgcacatgtactgtagaacttaaagtat

SEQ ID NO: 246347 - DNA, 413 bp, Homo sapiens
ctgttctctgggactgaatgcggctgcatccttcccttcctctgcttcctgtcccgatctggtttctgagtccctgggctgcagctgttgaatttccagacacaaacaagtatgcgttctgagagcctcgccgagcccacacaaccgggagagccaagctggattccattctgctttgcacatcagcagctctgctgccagctgaactccagggcaaaagctgtgcctggtaatgatgcaggcagcagggatggcacagctggcctggcttaggccgttaagggggacacgcttggccttatttgggggagagcgagaaatggaaggcgatgaagagttgcggaagcatacatcagcctccacaaaactggtgcacagcagggaaacaatctggttttgctagtcatcaacaa

SEQ ID NO: 246348 - DNA, 508 bp, Homo sapiens
tcccagctgacttcattattgagataattataaaacaaattatgtaagaatgtgtgccaccacctacattctgagcgctgctgtaaaatatgttccacaattccaaatcttgcttcaccagagaagggcagcaaaaggcttagagtcagacagacatgggtttgaatcccagctttgctttctacttgctttagtctctattctgccctcagtaaaaacaggaagaggtgctaggctctctcatacatatctccttggcagggttgttgggaggagataaagaggtatggatgagagtgcctagcacttaacaggtcttctgaaacttggacttcctttacctacagtagttgggaggaagaggcaactatcatttaaaaatctgaaattaatcagaagttctattacagctgctaggcattccaggagaagctgctgaccagcagggctctcggacatatgaataaggtaaaatcacaataaaaataaagtgaacagaaagaaataa

SEQ ID NO: 246349 - DNA, 408 bp, Homo sapiens
aaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagatgaatcagaagaaagaatttctgaacttgaagacaggtattttgaaataacccag

SEQ ID NO: 246350 - DNA, 479 bp, Homo sapiens
ccagatgaagagtcggggtgtgggaagggaaggtggctggggggtaggagaggacacgtctgcaagcagaagacaacagatgtgaaggcccccagttatacaagtcaaagctgggaatagcggcaacagtcgcaaagggaataacgtgtagagagagacaaaaaggatttctgagcatattggagctttttagccattctgatacattcagcaggtcaccttaagtaaagcaatctggacatgtctcacattctccaggtatggatttttatgaatcttgctcaccagcagactcaggcgtgagtttttaataagaatgtctagtttagaaattacctaggagcattttcacatcaactttaggattccctcctgaaaattttcagtttctaatgggcaggaatatatcccagtatctaaataatgtaaatggaagttcgtttcttttctagaggattttagcgtggaaaaaaaaaaaa

SEQ ID NO: 246351 - DNA, 340 bp, Homo sapiens
actacaagctgtaagctctcacaatgctcaggtctaagtacatgatgtatttatttcctagatacctactgtgaagtgtggaacaaagccaagttctattacatatttgaaaaatccaggtgacaggaagaggatacaaagatggagtaagctccccgtgtcacctcgtgggaggtagaagggatcagggtagggagttaacaagaaaactaagaaagggatgatgagactgaaatggaaaagtagatcagtgattgccacagtagagtgtaataaaagcaatataagatcttctctttctatttatgttcgttaaaaaataaaagacattaggcttgac

SEQ ID NO: 246352 - DNA, 397 bp, Homo sapiens
tgatctcggtctcctgacctcatgatctgccctcctcagcctcccaaaatgctggtatgacaggcatgagccaccgcgcccagcctaattaattttttacattttactttaacttctgagatacatgtgctaattaattaattttttaaattttactttaaaaaagtcatactttacttaagtaaaagtaagtaaatgtgtgttaactaaacacattctggggtacatgtgcacaaagcgcaggttagttacatatgtatacatgtgccatggtggtttgctgctcctatcaacccattatctaagttttaagccccacatgcactaggtatttgtcctaatgctctccatcctcttgccttctatccccccacaggccctggtgtgtgatgttccc

SEQ ID NO: 246353 - DNA, 2053 bp, Homo sapiens
acaactctctcaactcatatctaagggctaagtccactttaaccttccaatatcattacatcatatttaaacattgactctatctggtcaaggacgacaacattttatttctcctgacccttttgctatcagatctggccttgtcagttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctggtcatgtaggcatatgtcccactctgtcggtacagagggtaagcagcctcttcctttttaaaaaatttattatgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagatactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaagaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaaggatgaacataagacacatctgtgggaattatgagggggagattataaagagtcaaaccttgtccccatatttaaattttataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctccttgttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgcc

SEQ ID NO: 246354 - DNA, 592 bp, Homo sapiens
ttggaaaactaatattttaaaaatagtcctcaggggcattaattcttggtaataaagttagtagaggtttattgagtagaagattaggatgtaatctttgacataagtggagtagtaactactcaactattagtgtggagttttcatggatttagtatcaatcaaatgttttaggggtccagaggtagtattgttaaggtctagtgaatgcttagatgttaagatcatctttatgttaagcagtttactggtttgtatttatcaaatcatatttccacatcccaatggaattacaatttttttaaatttataagctctaaatgtataggaaaacttggagaaaaatgaaaattttaattggaaattaaacacataggtcccggcactgctagaatgtgtaatatacagccttgttattctttccttcctagattctcttatgtggttaacgctgaatttctctgaaccatttagtaggttatctatttgttttcccgttgtacttcatttagtctattatacactagagaatttttgctgatccattttctggggctttctattcttggaggtggcattttgcctttgtatg

SEQ ID NO: 246355 - DNA, 465 bp, Homo sapiens
ctaacgtgggaagctggagataaaagtggcatcagcaggtttctctccgccctgctccttgctgtgtgtcccagtccattggacccaaaccagcaggatctgcaccacctggagcttggtaaaaaggcagatttctaccatctgaaactgggggtggggccagcagcctgcctctctgcggtgctgatgcacgcaggggtttggagagcccctgccctctctccaccctgtccgttcacacagccatgtgcattcattcccccacctgttgcactcggatctgggcactgtgccgtcggggtgcaccttgcccattctctcttttttttttgagactgagtcttgctctgtctcccaggctggagtgcaatggcacaatcttggctcactgcaacctctgcctcccgagttcaagtgattctcctgtctcagcctcctgtgtagctgggattacaggcacgtgcc

SEQ ID NO: 246356 - DNA, 360 bp, Homo sapiens
ttgcagtgaaccgaagtggtgccactgcactctggcctgggcgacagagcgagactccatctcaaaaaaaaaaaaaaaaagatatagaatattcccatcaccccagaaggttccctggcgtccctgagcagttgagcagtatccacctccccattggcagccatagatttgctttagctattcttgaacttcgtatcagtggaatcgtatagtataatgtgtacactcaagtctagcttctttcgctcagtattatgtttgtgaggatgggcatggtggctcacgcctgtaatcccagcactttgagaggcccaggtgggtggatcagtatcacctgaggtcaggagttcgagaccagct

SEQ ID NO: 246357 - DNA, 446 bp, Homo sapiens
cccaggaaggcctcaggcagaaggtgaagcaaaacaactgcttccaagagagactgggtgagacttgccaagtgacagcgtgtgaaacagagccagcaaaaggggatggcctcacgagtctatcagtttcccgtggattcctcatgggagggaccaagacttgggttttcttgttaacatgatccctttaggacacacagggcagtagggcctaggaattccacatgggccaacatgcatgtgtgtgcatacacacatgtacacacagccccccaagtgttgaaagactgggtgattagacaccaacataataatggttagttaccaccaagtagtgagatttgagtgatatgggtcttcttcaatataatctcatacttgccaagttttattcataatcaggaattatatgtatcatcagaaaataaatgttattttgtgtgtcc

SEQ ID NO: 246358 - DNA, 593 bp, Homo sapiens
tgttttttgagacagtctcactcacgctcagtcacccaggctggaatacagtggtgtgatctcagcccactgtaacctctgcctcccaggctcaagccattctcctgcctcaacctcccgggtagttgggattataggcacccaccaccacgcccagctaatttctgtatttttagcagagatggggtttcaccatgttggccaggctgatcttgaactctttacctcaggtaatccgcccgccttggcctcccaaagtgctgagattacaggcgtgagccaccgcacccggctcatctcagatttcttacatcacttaaaaaatgaatttatctatgctcctttttgtccctgtgtgccagatgcttaacctacagttaaaggcctactttagtaattctgatcctaatcggtccagtccagttaatcttcctgggcaaaggattcatttaagataagcttcactttacaaaagatagccccaaggctaggaagtccctgtctctagatgtgtaatcttaaaaaacatgctctgatgtcctgaattgacttcccttcctaaggatccttttgccttcatttctcaaatgtcc

SEQ ID NO: 246359 - DNA, 1073 bp, Homo sapiens
gttacttattagtgatccatcagtgggattaaaaaactggcattattatttggtgatattccatgaaatgtttacatgtgtatatatactttcctaatcaaaattcatatttgcctagtcactgaggcaaagaactagcccattatttaaggacataggattggagtcaggtgggcttaggttcaaatctctgctgtctaatattgagcaagtcacttgacctgttgctgtgcctaaatttccttgttacaggatgaagatcatattacctatctattacaggttgcaatgacttttgacactaactacctgcagttattgtcaactaaggaagctcacacaagctttgatgtccagagtgtttattggggcttcattacatagacatgactgattaaattgctggccctgtgattgagttcaatcttcatccctcttcccctccctggaggtcagactgacatcaggagggccaaaggcccaatactttaatcacatggttggtctttctggggtagccagtcccaactctgagtcatcttgttagcacagactatgtaggggttcaccacgagtcacctgagtagcacatactctcagggcacatcataaataacaagacactcctattacttgagaaagtacaagaatttagaagctacctcccaggaatgagggagagaggcccaccaaattctttattctacaacagtgttattacaaggcctatcacagggttacttcaggtggtccatgtggagcacagcataggatggcactcaataaatgttaacagttactacattacagttgcatagcacagagcttaagaaagaaaatattcagtgcagcaaaccaccatggcacatgtatacctatgtaacaaacctgcacgttcagcacatgtatcccagaacttaaagaaaaaaaaaaaacaaatattcaatgtgtttgccattagattctgcacatttttgaaagtgatctatttgttgtcatagcttcattttcattctgttcattttctgcataaataaatgagtaatctctacctcagatttaccagtgactac

SEQ ID NO: 246360 - DNA, 458 bp, Homo sapiens
gggtagaaaacataaatagcactagatgaaacatgcctttccttccagctaacactgatttaaaccatgccctcagtgacttacaaagataccaataatgggtcctgcagtttaggtgggcaccaacaaggccttgtcagaccagaaatggctgggaggtagggaaggaagacaggctagctcactagcagaggagagtagcaaggccctacgtcgaggaggaaatgtccatggaagaaaaccccaccaaacccgcaactggcgaaattccagtcccgtggaggtgcagttacctctgcatagttttttccctctttaaccagtaggagtagatctggatcacactgaggaaagggtttcattctagatctgtctttcaaatagtttcttattcaggataaatattcatgtatgctcagatactaataaaggaatgcttgttatcctggcttctccac

SEQ ID NO: 246361 - DNA, 621 bp, Homo sapiens
aaagcaaacaccccacctctttctcgtaggagcagtctgggcaccatgttttaggaaatgctgacctgtactcatagtggaactatagcagttattaatattatggtcagaatatcagggaatgagaagcctggagagataatgggaatgaatttagcttaatctctttaccatttggatcaggaaactggcccacagaggggcaggaactggcgtgaaatcatctggtgaattggtaacaatttgagagggtcttctgagatgcttcatgaaaccactctttttgcagcttcattctgtttaccttgtagttctaacgtgtcttaagccacattgtttcataggctatcttgtgaacacatttaaatgccatttgctggtgcctggttttatctgagcagcacctctcgtatttgcaagtctgttactccgttaagtggcactgattaccagaaaacatcctagtatgctgaaaaatacttgaaatgatcaactaatgaggacactaagtatgttttctcattagtaattatgcaggctctgaagctaatcccagtatctatacatacttgtattgctaaattaaaagcaactgtggtgcagagaacagaaacattttga

SEQ ID NO: 246362 - DNA, 690 bp, Homo sapiens
aaaactggaagagaagttgtcactagcatacctatcctaaaagaatggctaaagaaagttctctgaacagaaaggaagcaataaaaggaggaatcctgagaccccaggaaggaagaaagaacacagtaagcaaaaaaacctcctaaatctaataagtgagtttagtgaggtcacaggatacaagacaatatagatataagattaatatacaaaagtgagttgcatttctatgtactagcaacacgtggggaccaaaattaaaaacacagtgccattgacattagtattgtaacaatgaaatacttaggtattgtcttagtccgtttgctgctgctgtgacagaatgccacagactgggtaatttataaagtgagcatctggtcagggccttcctgctgcatcatgacatggcaggagacatcacatggcaagatagagcaaacctgctagctcagatccgtcttcctataaagtcaccagtcccatcatggaagccctaccctgatgaccatatctaatcccaattacgttccaaaggccttaccttcaggcaacatgaatctggggattcagtttccaatacatgaaatttaggggacatgttcaaacccctacagtggctgtaccattttacattccctccaacagtacacagaggttctgatttcttgatgttcttgccaacagttg

SEQ ID NO: 246363 - DNA, 532 bp, Homo sapiens
cggaagttgttttctctcaaaataactttaattgtgccaaactagtgaaagttttataaattttccagaacatttgatcatttcacattcaatgacatattcgtggtcattgcacaatgagttgagccctctgtgtactaactagcttggggaattggtaatggctaatgggttttggatcatttgacttttagatcaccggcttgaatttagagtttgctgtagtgatgatatattaccacttgataaaaatcaggtggtttctgtacaattcatatagctacattccatcttaaatttttattcttggaacttatttttcagtaaagtatattgtagcagagagtaagagtagaaatgaactaattcctttttttttttttttttgagctggagtcctgctctgttgcaggactgagggaggctgaggcaggagaatcacttgaacccgggaggcggaggttgcagtgagccaagatggcaccattgtactccagcctgggcgacgagcaaaactccgtctaaaaaaaaa

SEQ ID NO: 246364 - DNA, 770 bp, Homo sapiens
tctctgttggaagtgtaaaaggaagataagaagggctctgatgctggggttggggaggaaagagaggcaggtaagacagagcctagagagacgtttagggatcccagcacgcaaaatgaccatgcaggagggaagaggtagatttgcataaggagcccgtggctttctgggaaagaaggaattaaactcttccaacccaccttcctgttattcacagttaattagtggcagaatagggtttaacagaacttttcatttatttattttgtagagattcagtcttgctctgttgcccagactggagtgcagtagcacaatcatagctcactggagcctcaaactcctgggttcaaacgatcctcctgcctcagctttccaagtagctgtgcctacaggtgtgtaccaccacgcccaacctaacaggacttctgaagcaacagaagggaagccaggttcctgtgaggatcctagctttagcaaggaggggcagtttgtcaacagaggctgtgcaggagcaagttcaacagtgacaccttgtggaggcatgaagcaagagcagtgctagactctgctctgcccctacatctcttgggaactggtgggagcctcagactagccactttaacggctccgtgcctcagtttctcccgttgtaaattcggaatgacacacattcactcgcttcctctgtcatggagttcttctgatgacaacatttgccttaaggaagatgatggttgactcctataataattatttatggaaaggta

SEQ ID NO: 246365 - DNA, 491 bp, Homo sapiens
tggcaggcacctctaatcctagctacttgggaggctgaggcaggagaatcacttgaacctggagcacggaggttgtagtgagctgacattgcgccattgcactccaacctgggcaacaagaatggaactccgtctcaaaaaataaataaataaataaagttaacaggaaaacatttagtaattgtgtattctgtttccccctacaactactgtgagtaatctgcacttttatttctcttttggcccataagttttacattaatcctattttgctatttactgaataaagggaattgagaaaaaggcatttctcattccaagttagccctacaatgccaagtgtaaaaactcaggcctaagtgaagtttgaggtcaggataagccaggctaacagatctttctggattttactttgcatctcattcattcattcatttattcatttaactgatacttattgattactgaggatgtgccaggactgtactggg

SEQ ID NO: 246366 - DNA, 428 bp, Homo sapiens
gtaaaaaatgttattttcccactgccacttcaagtattttgtaccatggtcatctgttgttaagccacagacagcccactgctgtcaagcatttttttactgtttagtatgaatgggttcatgagtccgtgctggtatgtttggtaatatcctcagagttactgctcactcatttacctctccatgtagctgatttccttcagcacaagatgtctacacccatatcataaatgggaaagttgagggtggaggagcaacgtaaatgtccacggtcacactgctagttagaggcacagtgctagttcagtcacctggcaggctttcagatcccttcgccatctagttcaatgaaggtcgaagagggtgagaagagtttcagagttagtgggtactttgcattcttaggatttttaaattatagacctctt

SEQ ID NO: 246367 - DNA, 706 bp, Homo sapiens
attgactctttcaaagtctttcagtaggttaagtttgttttctgcagttttgattacaaatacttcatttttgttacaaagttaagctttagtttaattcttggtcatatcaaacattttaaattcattgagtctaaatcatgagttgattatattagatttgtgtaataaagcattaacaatcatgacagttaagatgattcttttatgtgttagttcattggggcagaagacagcataatacagatgcccagtgtaaagaagttagcagattcaaattatccagtggttcactcaactagaaactctaatttttaaagaatgatgtaaaatttgctgggcacttgtgtgtactcgcgtgcatatgttcttgtgttgttggtgtatattgttctgctttgttttgttgttcttcatatacattcaaataagagcttttctgacttggtagtagtaggtcaggataaagagctggggtgtgctatcccctacttgtgagttgtatataatttgttaggattcttttgtgtccacctttttttaagtttagatggctggctctgactgctataacaaggtatgtatcacagctatgtaatgtaagaatgcaaaatctactatagttgtactataaattcagcacctgttactgtataattaagatactgcatttgaagacaataaaaaagctaattcaaatacgtgt

SEQ ID NO: 246368 - DNA, 364 bp, Homo sapiens
ctacaatcttttatacacagggacaaaaccagaaatcagttggttaatgaaaataagaaataaagtaaatgcatatttaaaaaaaaaatttaaaggcaagcgttgcaggggaaagaaaaatacaagaaatgtatttctcatcagctctcagtgggttggtgtcctgaaaacacagtcacactgtcaaaactaatgcacacttacaaaagtctgctctttaaaactaatatcttaattcaggctgggcatggtggctcatgcctataatcccaacactttgggaggccaaggcaggaggaccagcctgggcaacaaagtgagaccccccatctctacaaaaaatttaaaaaactagccaggcatg

SEQ ID NO: 246369 - DNA, 705 bp, Homo sapiens
gctgcaagctcaagaaagttacagtctaagggatatgaacaaactttcagatcaattaagctttgaagttagctgtcatagctgaaggaaaagctgaagaagaaaattcgcaagttttgatctccaattaaatagacaagatactcaaacatcaacagcagcaaagtcttagcaaagaaggtaaatattttctgttcaagaaaagatttaaccttgaatggagaatgaaggcaggggttttttctttggcttagctgcttcctttccagcagcttgcctggcacatcgtggtcacaccttccctgcctcactcttcatcctttgggtctcagctttggaagattctggaaacctccgatcctcctgaggcaggtgcccctgctggaggatcctattaggagttttggaaacttactgcctggaatagaatcccaactttgcttgttcccagctgagtgaccctggagccagttatttaccctccctgggtctcagtgtcctcactcatgaaatgataataagattgatacgaaacataagtgtagctattatcatggcaccctgagtttaacctagcatcaccacctaccatccaggactgagtggatgaggctccaattaaatgagtaaatgatatgataagatggagctaatccatcaccaaaagggacaagaagcaagttgcttgccctactgaatgaagaa

SEQ ID NO: 246370 - DNA, 759 bp, Homo sapiens
gctgcaagctcaagaaagttacagtctaagggatatgaacaaactttcagatcaattaagctttgaagttagctgtcatagctgaaggaaaagctgaagaagaaaattcgcaagttttgatctccaattaaatagacaagatactcaaacatcaacagcagcaaagtcttagcaaagaaggtaaatattttctgttcaagaaaagatttaaccttgaatggagaatgaaggcaggggttttttctttggcttagctgcttcctttccagcagcttgcctggcacatcgtggtcacaccttccctgcctcactcttcatcctttgggtctcagctttggaagattctggaaacctccgatcctcctgaggcaggtgcccctgctggaggatcctattaggagttttggaaacttactgcctggaatagaatcccaactttgcttgttcccagctgagtgaccctggagccagttatttaccctccctgggtctcagtgtcctcactcatgaaatgataataagattgatacgaaaataaatgagttaatatgggtaaagcacttaacagagggcaagcacatggtaaaccataagtgtagctattatcatggcaccctgagtttaacctagcatcaccacctaccatccaggactgagtggatgaggctccaattaaatgagtaaatgatatgataagatggagctaatccatcaccaaaagggacaagaagcaagttgcttgccctactgaatgaagaa

SEQ ID NO: 246371 - DNA, 424 bp, Homo sapiens
ttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatggggaaagggcctggggtgttacccatgtactgaaaatgaacttttaccaacatggctaaaaaattaaaactgactggcttctgtgt

SEQ ID NO: 246372 - DNA, 355 bp, Homo sapiens
tgattatgttcacctccaaggtcagtccttcgctgagcctccagattctgcccatttcttccccttcatcactgatgttgctgtgcattgaatctctcataatcaggatgatgagacatagcttggcaaactagttcattttcttaaggcagttaaaatttaattatcctgcttgcagagaggccatagatagttgagttgcatttgctgcctatgcctcatataaatttcgttttttcccctaaaatttagttttttttaaaaaagtccattccatgtgtcagggcacatggtctggagttgtcctggcacaagacagccccaggtgtctacctgcagacctgccagctgtccc

SEQ ID NO: 246373 - DNA, 373 bp, Homo sapiens
taaataaacccaaacatctatggtgaactgattattgacaagggggccaagatcattcaataaggaaagaacagtctcttcagtgaatgttcctggagcaactggataaccacatgcaaaagaacaaagttggaaaaaaaaaaaaaaagaacaaagttggaccctgcgatggttaacttcatgtgtcatcttgggtaggccacattacccagatatttggtaaaataccagtctgaatgttgctgtgaaggtatttttttttctttttataatgataaactggcaatttataattgcgcagatttatagcatgcaaagttgtgttataatctatgaatgcagtgtggaataattaaatcaagctggttaacat

SEQ ID NO: 246374 - DNA, 231 bp, Homo sapiens
ataattaagaaactttcattttttaggaaatggactagttttcatataatattgttagttattagcaatgaaatgaccaattttagcaagtagttgggaagaagttaaaatatttaaatctataaactacttccagcttgtagataaatctgttgcgtaatgtcttttatactgcttattaaacagattgtatgtgaaggaatttggattttgataactaggaaaaaaagt

SEQ ID NO: 246375 - DNA, 522 bp, Homo sapiens
agaggttagcttcaatatatctagagaatgtcttttatttactttttgtcttatttccatttgtagtaggctctctgctatgtgaagttttctttgttggtagcttcctagtgtttgttgttaaaacccaacaatgttgactgcacatcatgaatgttctttggttaaaatgtatccgtttttcacttgtacccatttttcattagtagtttactgtttaggaattcaaggcatcacatagttgcacacagaagcttttcttattttattaatagcatgtaactaatgtggatatcccagctctttagttgtatctcagaaccaggacaaaaaaagtcatcttagtttgcaaaaagatgcaccaccccatgcacactggacaacagctctgggtctctcttggagactgttgacatttcctttaggcattaatgtacttggacttgactggcacctttagcatgttagaaacaggttatttggtaaaggaaaaggctctgccagaggcaggtgaattgacgt

SEQ ID NO: 246376 - DNA, 400 bp, Homo sapiens
ccctctttactccataaactaactgtcacagggaaagatgagcctatttaactgcaggaaaatgctgaaatagtttaattgtcttccctcgatggcagacggttgttatcagagtggaggagggaatgcagaacccaatgaaatattaaatgcagacaaaaatgtgtgggtgaatgtgattgtgtagtttaatccatgtgcttttttttcaagtagtttctagtttcattgcaaagtgtggtataaaaatgatgtcagaggaatggtttgctgggttatttaaaagattgcatacaccacttacaaggtatgttgttgatggttaaaaatgacatatttattattcatgtggtccccctgacatagaagaagctgcttgaaaaatgaaatgtagatgaaa

SEQ ID NO: 246377 - DNA, 404 bp, Homo sapiens
aggggaaggtgaccaccagggcagcctgccttgtaaattaccctgaaaacaaaaacatacagcgcctcctcggcttgggacccccaccgataaattatggccaggctgtggagcagagcccaggagagactggttgctggagagttcctcccccaaaccccacgagcgatcaagaggcctctgggtccggaaaagggctgccggggtagctggcatcctgagtagatgggagcctagagcatcccaaagggtttccgctgtgttttcaggcaaagtccagagccagaccctcttgcctcacaaatttgccaggagatttcacccaggtcctctgtggcttcatacccacctcttcctgcacttttctgtttgccagcctccagccttagaccccatcagagaga

SEQ ID NO: 246378 - DNA, 401 bp, Homo sapiens
gcttctgggctgtgttgggagcgggcattgtcccctacccactcctgcacagtttcccaaagtccagccacctccgaccctccttgggggaaaaaataccagtacccagacacctctgcaccctgttatatgactgggcttgcttcaggaatatcttacaaagaagaagaaggaggaggaggaacggcttggagtcatgtttacatctagttctactgatccgttcacatctggagagattatttataactccctctataactctctgtttggaggcactggtggctctaactgacagactgatgtctaggaaatattgctctatgtctaatggtacctaaatgtgctgtggttgtatttacagatttacgtttgagggaaatataattatttccattgta

SEQ ID NO: 246379 - DNA, 440 bp, Homo sapiens
tatttgtttcaaactctacatacagatgacacaaatccttccctttttcccttttatatattaattttcaaagaattttcttctaatcatgcaatttggccaggaaatgtttaactcccatttgaatgtaaaagcatcaaagaatcctttgtagagcatttagtcaacaagttacatttggttgtcatctctgcaacttgaaaaatccaattaatttattcaacaaaatttaagtgagcctcttctagataccaggcatcgctctatgtgcaggagatacagcaggtagcaaaaggtctccatcatcctgagagatgggaaagaaagaatgaacagagaaagagaaatgaacttatactttgtcagctggtgatagctgccaagggcaaacacaatgcagggcaaggggacaggatgtgactgtgcgtgtgtgcgtgtgc

SEQ ID NO: 246380 - DNA, 415 bp, Homo sapiens
cagtttgatagacagtcttaggggtttacgatagcctgggtggtcagagaacatcagagaaggaggtaggatttatactgtttgaattgcaagaaagaaccagagattctcccgcctttcagaggggagaatattctaaggaaagcaaacagctacaacagaaggcctaaagtaggaatgaggttgatgtagacaatgaagtcaaaaaggccagtgtgactcaagaggagtatgggggagggagcattaagagtcaatattgaaaagtgagggacggacagaatatgttgggtgtaataatccaaagtaagaagcttgacttccaagtattaaagggagtcttttcacgattttactcaaaaggagtaacatgatttgatttatgttttgaaaaggtcgttttgtttgctatgta

SEQ ID NO: 246381 - DNA, 543 bp, Homo sapiens
cacatgctttggccccagacctactgcatccaaagtggagccttgggaatccgccttttactgagttttgcgaatagttgatcccccagtacataatgcctggattaaatgaaaacatttaagaaaaatgaggacagggaaaaggcatcatggtattccagacccaaagagaaagggagtttctatacccacagccccaggagctgtttacatttgactcagctcaagctcagaactggccgggaagggccttcagtcagtgggctgtgaacacatcttcccaagacaggaaggacttagcatgacattaaactcggaaatggtaaaggaaaatttctcatagtttcacctacaaaaaagcgaaaacttttgcatagaaaagacaacttggaaaaaaaaactaagtttggcaaatcaatgaaaacttagggaaaaatatttgcaacatgtattaccaatcaaggtttaatgtttataataaataaacaattctcacaaatccaagagagaatactgcaaaagacatgaataaacagtccacag

SEQ ID NO: 246382 - DNA, 479 bp, Homo sapiens
atacccagttcaattgcatctgcagatgaggatttaaaattctgtgcagcagacagtacctccagcaggcgagtaaaaggttactgcattatttttcttgtttgttaccatagcctttatctaccaaaggatttttaaaaaattgaatgtgaagtgcatgcctgtttttagatattctggaaattgatttaagtataacatgaatatcaaaagggcagtgcaaggtgaaggcagaggcagtgctggatctttttagctttaaaccagggaagaaattgagcatgttacatacacaaagaagaaacctttcagtgtcacagacaatgggaagttttaaaatacgtattttaattcaaggtgtttattatttagttttagactatcttccccaaaaagggtgctcttacattagcaatcattggtctatgaatgttcatttaagttacagtaatttgaagtatgattatttgtgaagacta

SEQ ID NO: 246383 - DNA, 228 bp, Homo sapiens
ggagatgcagtgagccaagattgcgccactacactgcactctagcctgggcgacagagtgagactccgtctcaaaagaaaaaaagaatgaacaattaaagttacttaataatatggatgtggaagtcacctgttggccatcatggagttgctggatgaaccatgaactgtgcttctacatggattcatttccactacccccactttttctgttgttgttggcgccagg

SEQ ID NO: 246384 - DNA, 312 bp, Homo sapiens
cagtatagagtgctggttagaagcaggctgtctgggtccaaatcctgcaacttaccagttgtgtgaccctggataacttggataacctcaaacgtcttgcacctcagtgtcctcatctgtaaaaagaagataataacagtatctattccatagagttgtagagattaaatgaactagcatgtgtaaagtacttattatagtgcctggcatggtaaattctatataactatttgctgtcactgtgtgaacatttttcccaaaaagaaattatgttgtgtgttatttttaaaagccttttgagacctaacacat

SEQ ID NO: 246385 - DNA, 260 bp, Homo sapiens
taaggaatacactgacacaattacatcccagcgtaatcaacgccgtggcagaagagagcgaggggctgcaggaacccagaagaaacaccaggccaagcccagtgttaccacctgcacattctcctccagctgctgtaaactccacaatggcagtggctcacacctgtagttccagcactttgcgaggccaaggtgcaaggatcgcttgagtttaggagttggagaccagcctgggcaacgtggcaaaacactgtctctac

SEQ ID NO: 246386 - DNA, 761 bp, Homo sapiens
agactgtgtagtatccctgtgttgggcaccattcttgcacatggtaggtgctttgtgaatatttgtcaggaaaaccaaaaagaatgaaacataagagaacaacaagaaaaagaatctttacctttaccctttctcttggaggaatatttgacttcttattcttgtgaattctgggagattaggaaaaaagcttctgaaatgaaggttatttcagaagtaatttttatgggagagcttccagaattcttagcctcagtaatgataatggctaacattttggagcagctaccatctgccaggcttggcagtgctaagtgcattgtcccttttaatcctcgcatgaactctttggaataggtactataggtgctgagcctggctcttcagaacaataagcatcctgacaaatgactggtcccttgaagacagtaccaggtcttattctttgcacttggccggagactagccagatgctgaggtgtgctcagtaaatggggatcatggctgagaggcccttgcaggaagctagaacctcacacacttcctctggttccagagcaggggtgtgtagaatctgtagggagacactggtgggtgttttcacaggagactgtagtgcccaagcagctttaaaagggctaagggaattttctgggatgctctacgcttatgtgggagctgactttgctttgggccaaaaatctgtgggtggtgttcagatctccttctatgttcttgtaaataaaaaacctttgaaatgc

SEQ ID NO: 246387 - DNA, 401 bp, Homo sapiens
  misc_feature (211)..(211): n is a, c, g, or t
accctcatcagcaacagcacgggcatccaggagctgttcaagcatctcagagcagttcacggacatgttccagcacaaggccttcctacactggtacatgggcaagggcatggacgagatggagttcaccgaggccgagagcaacatgaatgacctggtgtccgagtaccagcagtaccaggatgccacagccgaggaggagggcgagttngaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaa

SEQ ID NO: 246388 - DNA, 840 bp, Homo sapiens
tgaggcctgtggcgcgagcacagcagcatcctgggtcttacgtcggcagaagtagaaagggaagaagcctaaaggaagtgaaagtgttgctggatctcctgctggcattgcctcctccttcacacagcatcccggttctccctgcagccacctgatcttccctttgtccccttcctcaccacagccccaccaccttcaccactccaagttgatgcttctcctacatctggccaagatgctactcagaggtggatgaaagcaaaagtcactgctctaatacaagaaaagtcccggttttaggtttcagaaacagaattttcccgaatgtttaaaatggtgaatggttccataaactgtgttaaccaggcttcttacaggctagtcccagaatctgaccaccatgtgcaatactgtttctaagaaaagtgtgctccaagcaagaaccttcaaacatttaacctgaatgaatgaatataacctcttcacggttcagtgttttcataagcaaaacaagagaatagcagcattgatgtcttttaaaaaaaatttagggctgggcgcggtggctcacgcctgtaatcccagcactttgggaggccaaggcaggcagatcactcctgaggtcaggagtttgagaccagtctggccaacaagatgaaaccctgtctctactaataatacaaaaaaattagctggaatgtggtggcacatgactgtaatcccagctactcaggaggctgaggcaggagaatcacttgaacccaggaagcagaggttgcagtgagccgagatcgagccactgcactccagcctgcgtgacaagagcaaaactccatctca

SEQ ID NO: 246389 - DNA, 349 bp, Homo sapiens
tgtccttagtcagccgctttacacctgcttggattagccactggatatgaagcttccccagaaagtggagagaactcagcaagggtgctctccatagctgaagcaaccctgggagggcctgagagccaagtctatcttccaacagtattcccagcaaatggtgaaacaagtcattcatcaaggagggatctaggtggctgatgcctgcatcaaccacagtctgcctctgttcagcttgaatccatttcttcatttgtagtctgagggtgtaagacaaatgcatgtgtctgtgtgttcaggattgtaggaggtggaggtctgtatgtttagggtagtgtgtctttgtgca

SEQ ID NO: 246390 - DNA, 382 bp, Homo sapiens
tcttttttattgaggagaaatttatataatatacagttaaccattttaaaacatacaattcagggatatttagtgtattcacaatgttgtgagcccaccagctccctctagttggttttgaaaattcatgattaattttttcttttctttctctctcctctttctaagattctgactatgcatatattaaatagtttgttttttgttctacagcttttgtttgttcttttcagtgtgtttcagtttgagtaatttctgtagctctagtaatttctatagatctatcttcaatttcacttattctttccttgactgtgtcagttctactgatgagactgttgtggacattcttcatctctgttactgtttttttttttttttt

SEQ ID NO: 246391 - DNA, 661 bp, Homo sapiens
tgaaaaattttacagttaaaggaacattagtgttgcatttgcaataactaggacaagagccagtcacatgctgatcttttaagtaatgagaatactaagtaaattaacaccataacatagatttaaagaaaaaaagccattagaactaaattaatataataacgtccagttacagcctctggttctgcttaaaatttatcagattctatttacacgtagggaaaaggacataaaatgaatcttagccttgaatatattcatacttaattaacgcatcctaaaaaaccattaacttaaacatcttaaagtgttctataatgttggctttatatgttttaaagtaagaaactttctgccagtggctttctttttttttttttttaaagagaaagcatcttgttctgttgcccaagctggaatgcaagagcagagtaacagctcactgcagccactgcagccttgatcccctcacttcagcctcctgagcagctacaatcacaagcacgggccaccaaggccggctaacttttatttcttgtagacatggggtcttgctatgttgcccaggctggtctcaaactcctgtcctcaagcaatctacctgattacaggcatgagccactgcaactagcccagtggcttaatttctgcttagaaaaat

SEQ ID NO: 246392 - DNA, 603 bp, Homo sapiens
aagtgtctctttggaaaagtatgtgtgggagggaagcatgttataagcaaagcaataaaggaaatgagtagggttttcctgtctttgactggtgtacagacctctaaagtcagagggattggtgttattctaagagtcttcagtcctctctttggcttactgaggtagttgtagcataatcaacagctcaggctttggatttaagcgcacagacctgggttcaaattccagtctttataagtgactgcaacattattcaagttacttaacatattcaagccccagcttcctcatttgtaaatatcataagtgtactacctgatagacttgtgaggattatacaaaatagcattgtaaaagtacctagtgcataacaggcattacctatatgtaagtttatgctaccattattattttgtcagatggaatatgtattatgtttttattgggttgagtgttctatcaatgtcaggtaggtcaagttggttgataacatcattcaagttttctgtctttactgactttttaaaaatcacctctctgtcaattactaagcgaggagtattgaaatctccaaatatcattgtgaatttggtttctcct

SEQ ID NO: 246393 - DNA, 245 bp, Homo sapiens
aatctcagtgctctcaggccttcctgcttctcatttccagggaagccgaaggggagtggtgctgtcagcaggctgccagagccaagggaacccaagctggagaagaatgagtttgaatccaccattcatgtgctatgtgacccaatgcaagttacacacctcctgtggcccatgttagggacataagcccctcatacttgaaggactctgagatgatctgggccgcttagctaaaggtatctgga

SEQ ID NO: 246394 - DNA, 390 bp, Homo sapiens
tcacagtcaggtacagtgcacttaccattcaataaaaagcatctctgaaacggggaagtggttaaggaatggactaaattctgtatggttgaaaatatggacagttactgctgtagtcctctcctcactgttttggggaccccatgggccagcttggggatatgaaaaagtggtggggttctgggagctcaacagacctgggctcaaatcccaggtgctaccttcatatttctaagcttcaaagtttcagtttcaactttataaaaaaggaggtaccatttgtccaatgatgctctttttttttttttgagacagagtcttgctctgtcacccaggctggagtgcagtggcgtgatctcggctcactgcaagctctgcctcccgggttca

SEQ ID NO: 246395 - DNA, 282 bp, Homo sapiens
tattcaaattttttgcccatttttaaattgggttatttgccttttattgttgagttgcaaagagttatttatatattctggatactaccttcattagatatatgattgcacaggttttgtctcattctgtgtgaactgtctttttactttcttgatggtgtcctttaatgcacaaaaatttttaaatctgaagttcaatttatctatgtcttcttttgttgcttgtaattttgtcatcatatttttaaaaccattgcccaatacaaggtcatgaagattcat

SEQ ID NO: 246396 - DNA, 604 bp, Homo sapiens
ttttaaaatgattccctctggcaatattgtttaagttgaagacaagtatgattaaatacagggacagaggttaaaaggctatttcaacagagtaactgcactactgaaaagacaagtggaaatatattaaaattactcaggagacacaatctacagggcttgattgattgtataagaaaaatgtgggaggattaggtgttaaggatatttccaaatctttggcttaaaaaaaaccagctggataatggaaccattcacagagataatgaacacaggaggacgaacaaaacaaattggggtgtgggttggaaggtgcaccaaggtaggggagttgactgagtatagaacactttattttacttatattatttttgagacgaagtcttgctctgtcgcccaggatggagtgcagcgagacaatcttggctcactgcaacctctgcctcctaggttcaagcaattatcctgcctcaacctcccgagtagctgagatcataggcacccaccaccacacctggctaattttttgtatttttagtagaaacaggtttcatcatgttggccaggctggcctagaactcctgacctcaagcaatccacccgc

SEQ ID NO: 246397 - DNA, 349 bp, Homo sapiens
atgtcaatgagaatcagactggtcaatcgcaaaacttacagaaaatagccatgcaaaatcctcattaagaaggaaaaatataacaacccaaaaacttcacactggatccttattactttatctattctcactacagtccagtgtaaaccttctgctcaacctcatattttgacttcgattcttgcttgctttaatatttctattttccccacattcctttgtactcatctatacacattttctgtcatttagtattaatctaaagctactatatttccctgaaggcttccaaaaattacaatctgtattgcactttgtcgattatatattgtgttatttttttcttctg

SEQ ID NO: 246398 - DNA, 4275 bp, Homo sapiens
  misc_feature (964)..(964): n is a, c, g, or t
tttaaatctaagggatattttcccttcctatagaaaaagatgcttttgcttggcctaatgaccatactgggcagagatcagggtgaaatccagagacttcagcccatgttactagtttcagctacaggtgagaagtagcactgcaaagaaaagctaaactggtaaccttgctgtgtagcagagatctttggtcataggagtattcctgcatgggccataaggttgtggtttgaggtggaaactccctgaaacatcagctggaaagtcgcctttagaataaagacaaagaaccttctgcaagccagccaaggcaataccaggacttggaggtggcaagtttgataaactaatctgtaggaaaaagttcctatcttagtgcttacacagttcttttttctttttttggtatagacggggtcttgctacattaattctttgactggggctgggtcttcttttgcacagggcagcttgagactacaatcaccatggcttcctctcaaaaccaagtcagggattaggctgtaagaataacaatacaagtactaaagactgaaattttattaaagccaaagattgagaactggtttccggacagcttctagccatgcattcataggctgtgagcaggagtcctgtagaataacaggagacctctggggtccaagctctgagcttctgggcacattttaaatgggtctcactttattgcccagtctggaatgcagtcacatgatcacagctcactacagcctggaacccttggactcaagcagttccaacctcagcctcctgagtagttgggactacaggcacgtgccacctcagctaattttatttatttatcttttagagacagggtctcgtatgttgaccaggctagactcaaattgctgggctcaagcaatcctcgtgcctcagcctcctgagtagctaggattacaggcatgggccaccactcccngcttaaatagcagttctgttttttgttgaaaaagtagaaaatcatcataaaacataatttggtgaatacaaaaagaaggaatctgagtcacagtcttaccacctgagatgttgaaaacagctggtttaaggggaattgggttctgtagtgagctggggcccaaaattcacagccagagtgataaggaatgtagccactttgtaggacaaaactccaggacagggcgtggtggctcacgcctataatccctgcactttgggaggatgaggctggtggattacctgaggtcaggagtttgagaccagcctggccaacacgatgaaaccccatctctactaaaaaaaacaaaaaattagctgggcgtggtggcacctgcctgtaattccagctactcaggaggctgaggcaggagaatcgcttgaaaccaggaggcagaggttgcagtgagccaagatcgcaccactgaactccagcctgggcaccaagagcaaaactcccatctcaaaaaaacaaaaacaaactccaggataagcctcctgccacatagcaagtgctggagcaaaggccatgcccacaatgaaaggcacatacccacaggctgcacaagctccagacctcctagatccagtgatacaggggtgacaaggcacctagtattgaggtgcggttgcatgggggcagggtgcagtggtgacatgagctctggccaaggtttgccacctggtaaccctttcccctggaggttttgctacttccccctacagaacaacctgacattttggttggtgctgcattgttcagtgcctgccaccactcatcagtcaacgacatttacctagtatctaatgggtgccagattgcatgttgggctgggcaccacaaactgaaaaggtccacttctgcagcacttttgcagggatggagcctggttgcgtggaatgattgtgggcacctgttttgtgtaaatcttagttgaaaagctttcctatcttccgtccttgggcttagagggaaactagggcaggaatgaagcagagagagcctactaagtgccaggtactcatagacattcatttttccactgaatcctccaataaagtttgaagtaagaatcatccccactttgcaaatgcctacactgaggtaaagtaacactcaatttgaaggaatatctaccagctcacacctactagggacaattcaacattcttactatgagagtgtcagagggaatggaaaatgcagccctagaaggatgagattttggtgccaactttcatagcaaaacaagaactttagtcactaggcccccacagctcaaggttgacctctttactgttcattgcctctctgtcatattaggtgaggaccaagacctgtctcagacccctaacagcaacattctccaaggcaaatgaggctgaagggggccacattcaaggatactttgggttcattggttcattagtctatgaggctgggaaagaaaggacttcggttaggaccactggtttatattctaaagaggcatccctgtttgacacaacatcaaggaaaaaagctctcactctagtgtaggtaagaataggggctaaatagtgtcaatgtcactcaattttttttcctctccccatccttctttttggagacaaggtctcactcagttgtcaggctggaagtacagcggctcggtcatggctcactgcaacctcaacctcctgtcctcaagcaatcctcccacctcagcctcccaagtagctggaactacatacaggtgtgcaccaccatgcctatttttttttaattgttttgtagagatggggtcttactatgttacctaggctggtcttgaactcctagcaagtgatcttcctacctcccaaagtgctgggattacaggcatggagcccctgcacccagcctcaatttttattttctgttctttgatttccaagaaatctgttcagatgatagtctttttaccccacctcctcatttggttcagtgtgtgttgatgagcagggcttcagacccacatccatcactgataggaccacatgcagaggactctgaccctactgcagtcattatgaaaaccttccaaaccaaaataagaagggtagccaacaccaccaccacctagccccaggagtcctaactttagaaaaggcagagtgagctgtgcgcagcatgcatctgtaatcccagccactccggaggctgagatgggaagatggcttgaggccagaaggtcaaggctgtagtgtactgtgactgtacctgtgaacagccactgtactctagcctgggcaacataccaagatcttgtctctaaatttaaaagaaagggaaaaaaaaaaaagaataggcagagtgaactttggggaagaaacaatcttgcctggcttgcttttcattacatatgtatatatatgtatgtatatacatacacatacacacacacacacgcagatacacatacccaatgacagtagagattttttttaagggtgcactctttgttgaatgaagtttccatatgaccaaaagtcttcaataagttctaaaactcttgcctctgaagatctgtgtttactcttaattcctacagaaaggtatccctaaactagttaagaacgatagccataactagatgttatagggcacacaggtctcagataccagaagctgacagtctccttccagacataaagggatacccagcagagattctttagagctggagagctgggaaacaccaaattatctgacatttagggtaacacaattctcattttttatatgggacagtatgtattttactacaaactacaaagactcagaggatggacagtgacagttaatatgattcctctcattgcccataggtaggccaccgatccaaatggatcctgagttcagacagaatccttacctcctgataaggttgagtgaggattattaggtgagccacagactaaggaatgtttcagaaagcagttttctaggtgtagtttggatttacaaaaaaaaaaaaaaaaaagttctccaggccaggcgtggtggctcctcaagtctagaagacccaagcctcaggcttcctccagaaaagcagtctgggagacagaatttacaaatcaactggctgaccggacgaagccccggaatcctgtgtcaattcgttttaaactaaggccagatgctttttggtaggctgcctcttcccgtgagctggtgggtacttcaagtctatgatttgattctcatttcttaaaaaaggatgagtatgtgtggtagttgggtatggtata

SEQ ID NO: 246399 - DNA, 621 bp, Homo sapiens
acattcaacaaataaagggctgatagagaattctgggaagtctgtaaagacagctgctgcttccaaacatgtgactccatttcactttagtgaaggcaacatcacagtgggaataaggcatacgtgtttaggcttggggaacagaagaagcaaaacttgaaatgaagaaagcaaagccctcagcaccttggtaaccggagtccctgcccagtcagcacactgcgttcccaaccagagctgggtgtcaggcttgggcaccaggcagatgcccatgcccgtaggtctccagcaatctttggctagtatgtcactctgactgccagtgggtacaacctgttccctctccccaagctgctaggacctgtcaccttatatgtgcctttgcaaacatgaggaatggccccttccagaattttttaccttacctgggatcccgccactgcctcctgccctccccacagcactgtcttcataccccgaagccaaggatcactggaccagagagacatctgactcagggttaaacagtcaaaggctgggaatgctcaattagatgttcttgaagctcttacgaacaaaatgattaggtcggtcaaatggtctagtgcaggctgaagtcac

SEQ ID NO: 246400 - DNA, 368 bp, Homo sapiens
gtaccataccattttcattattggggcttttaattaatgtgtttaatacctgataagggtagttgattcttagtattctttttcataattttcctgggtattcttacctgtgtattttttctgcatgatgctcacaatcagcctgtctaaaactataggaaaatgactctttgtaatgtcattggaataacagtttagattcagagagaacatgtgcagattacatgagtatattgcattaatgctggggtctaggcttctattgaacccaccgcccaaacagtgaacatggtacccaattggtagtttttcagaccttcccccttccctccctcctctctttcagagtctctagtttctgttgtttc

SEQ ID NO: 246401 - DNA, 1022 bp, Homo sapiens
gagaaacatacactcttctaatatttttgttttcttatttcagagactaatatatgtaatcgtttctatttttgagtttacagagagatatctccagttcctcttaccatcttgctttatgtaacatttaaagaaagacagcgttcaggaatttgaaaaccccatttcctctttaatgaagtggctgagatgggaagattcatgatgtgactaatttgaatggttaggactgtggtccagtagccataaataggggtctcaggttggtctgatacatagtaactcttacccagaaaataagtctctgcttcttctctttaaatgaagttgcttaattggttgccttgacacaggcttattacatcttacatcattaagccttcgctgtaacaatatttttgaagcacagacaaaagatgaatttgagtagctattattttcctggcaccacagatgcagagagagatgagactgtccctgctttgagagaacccgtagtttatttcaccttcttaaaagcctgctgttttagagttttttggatgcaaggaacagaaatcagctctagctagcttaaataaaggatttgttataaggctatagggaaatctcacataatttatttgaagaaagtacagatgggcctcacaggaattggcaaggtgtcaaagagccactattcaccatcttgatcccctctaattatctgagactagttagagagatggtggtggggtgggtgttcatggtttgtagagtggcgtttctcagatgtaaagcaagagaaagacacgtttaattctcctgaaaacaattacctttttccaggaatgttcaaaggtacttgggagggcttccaaaactaaataattgatatatcacactgatgattcaatttttaattaaaaaattgccacacacacatgatgaggaatgctaaaaaaccaagatatttttggttttaacttaaaaataatgtaaaatttactgaaaatttacttgaatagtacaaataactctct

SEQ ID NO: 246402 - DNA, 543 bp, Homo sapiens
tttctctagcttactttatttaagaatatagtatatcacacatgtaacatacaaaatatgtgttaatcaaccttttgtcatgggcaaggcttctggtcaacagtgagatattagtagttacgtttttgaagagtcaaaatttatacatggatgtttgactgcatgtggggttggtgccccaacccgcaagttgttcaacagtcaaccatataattgccatgttgtatgatagtcttctgaacttattcctcctgtctaacttaaatttcgtgtccttaagccaacatctcccccaaaccctcaacctcagcctcagtagccactattctactctttgtttctatgagctcagctttttagattctacatataagtgagatcatgcggaacttgcctttctgtgcttggcctatttcacttatcataatgtcttccagggtcacttatgttgtcccaaacgacagaatttgcttcttttttgaggttgaatagtattccattgtgtatatataccacattattcatctgctgatggacacttag

SEQ ID NO: 246403 - DNA, 618 bp, Homo sapiens
ccgtttagagggtaaagcgtgatttatagggggaacgaatcgatccagaggcaggcactgtcttgggagtgatccttcccagactggccaatcaggtatttctcctcctccccagagaagaataaaagagagagggagaggggccagggaagtcccttgtgctgtcccccagagagtggaagcccctccctctatggaaaccagaggagtgggagatgggattattctcccctaaatgtttcctctatagcccttaacagagtgtgcagttcggtgctttgagtaatcatttgattcgcacctgacgtcccccctggaatgtacaccattgaccggccacatgccacctggcatataacaggcattcatggtcacctggtggaaggaagggagggaggcctgggaatattcctttcctcctgtggcaactggtttggaaggaagggagggaggaacgctgagtatatactttcctcctgtggtgtatggattggaaaggaaggagggagggagggaggccaggaatactattttccccccatggcttatagatttggctgtgtgtcagcattacccaggggctcattaaaaacaacattcttagccccatcccagaga

SEQ ID NO: 246404 - DNA, 332 bp, Homo sapiens
ttctgcaggtagaggctgccatcagctgccatggagacccggtagtggcagaccttggcctgggcccggactaggaagggttcagagatggagacccctgccttggctgccagctgccccgaccctcccaccccagaggatgctggccacaacccactaaggggtctggctcagacctagctggggaccctgagatggtcagagctgtgtggaggagggagtgtgggcagccacaggctggggcggggcagcgagagcggcccaggttggagcttttctgctgacggtgtgcacagagtaggcacttaataaatacttgtagaatgaatgag

SEQ ID NO: 246405 - DNA, 830 bp, Homo sapiens
taggcctggaatgcagtggtgcaatctctgctcactgcaaactccacctcccaggttcaagcgattcttctgcctcagcctccctagtagctgggactacaacaacaacagcaattctaaagtctcttcagtaggacttgaccttgataacctctctggaagatttatctctgtgcatcacatttaaaaacatatgtatgtactctcttagaaactgtatcgattagggttggattcccttgtgatcattttactgtttcaaagatctagctgatgtgtcttttcagaataaagtttttaatatttattttgaaaaactttgtcttcatggcccagttgttgtcatgtgctcagttatacatgttatatatgctaaaggagaatgttgtttggcctcattccttttttttctttgctgtaaagtgggaatgtcttcctgaattgtatgttattcccccgtgagaaaatggaggccgaagatagtccctagcttgaagatgataaaacttttccaggctgtgtacttaaggggattcatttattcttaacgcttctataagtttgcctttaaatatattcaattctgtcttgatttctgaattttgaagtgctgtgtttgtttttaacaagatacatgtattcagcttttaataactgtgtttctggaggaacttgaaacaacagccatctgtatgcatgcctgcatgtgtcttttgcttgtaaagataccttccttgcttcttcagagtgaagctgggtttttctatttaaaaattaaatttggcatgttaaaatagcaaataaagctctgttatctggcatacttggaa

SEQ ID NO: 246406 - DNA, 702 bp, Homo sapiens
aacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcgtttatcttttaaagtaatttttatattataatgaatatcacttaaggatttacattattttgaacttttttttttttttattctcactccagtgtttaatgcatcaggcaatgtctgttaaagattacatcctcagggtgactacctttggattagactcctggtcctccaccactttcaccctcatgatatgtc

SEQ ID NO: 246407 - DNA, 194 bp, Homo sapiens
agtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcag

SEQ ID NO: 246408 - DNA, 453 bp, Homo sapiens
cacaaaacctgcacacaggcagcaaaaacaagccacatgcacgtgaagccacctagcacagttctataaactggctataaacccctttctttctcatcttatttctcactaaatacagtgctttcttccagccgaatccagtggttctgcgtgcccaggagtgtgcgttttgtgctctctttggccctcaccatcccccgacctcctgaaccaccacctctggcccgcacaatggtagcaaacaaaatgtgtgcacagcatgttgaatgtttccgacacaaagagatgatacatgtttgagatgatggatacgcttattcccctgatctgatcactatccattagaagcatcagtttgtaccccataaataggtacaactgattatgtgtcaaaagtgtaaaaaataaggcctaagcaaatataaaaaatcaattaaagttattgataatgaa

SEQ ID NO: 246409 - DNA, 332 bp, Homo sapiens
tattctttcactctgcagctcttaatccttccattttattcttatactgagagataattagtgttctagcaggcatataacataattttccacctccagacagttctgatttattgggagtggttttgttgtatgctgtgttaagcaaacaatggttgagtgggaaggtatgttaatatttattgccaaagtttgccaatactatccagtgcccagtgacacaatgacagcattcaaaatacatgtttccattcttaccctagaatctagtcacattacagttctgccttaaggaggtggaatagcataatggttaggatttggagccaggc

SEQ ID NO: 246410 - DNA, 200 bp, Homo sapiens
aggttctaaatgtagacactaacttgcgccccttccacatcctgtgttcaacgttcattcttattttgtctgtacatgatctaaagtgtaaactggaccactaacatctactttgaatgacgttgtttcaaaagtaggcaaggttctgaaaaatcttgtctgattaaaataaaaatgaataagaggacttgatgtgcaat

SEQ ID NO: 246411 - DNA, 405 bp, Homo sapiens
tcacggctctgtgaagtgtgttcagtgaagtgtaacattaaagaacaaaacgatccactgaacttctccagtcagtgtgggagcttaattttccattcaagctttcattcaccaagataaaccacatttgatgataccttgatagctggctagaaactcattaatggcatacatcttttactgtaatggatctatttcatcctctcataaagataacatgccatattatacagacaaagctaaaagacagcgcaaaatctagggatccaagataaattaataggtaaaggtaggcttaagggaagcattgaatagtattttgcactacccctggtgggataagaccatgcccagaattatctttggagatttaaaaacgcatctttgcaccttttaaagtgctcc

SEQ ID NO: 246412 - DNA, 421 bp, Homo sapiens
ataatgcccaatgcaatgtaaatgctatgaaaatgatttttgtgttgtattgtttagggaataatgacaagaaaaaagcctatacatgtttagttgaaatgaaaccatccactatttttctgaatatttttgatccacacttggttgaatccgtggatgtggaacccgcagatacagaaggctgactgcattttgttatagcagccctagcaaacataattaatgactttaatccagatggtaaatgcagaagagaaataagtttctgaggaacattaatgaattcagtattgggtctactgtttgaggtttctattcatgtcttataggcaaatagacatgagggtcaggtgatcaagagagagttatggactgaaggcatagatttgacagccatcaatatattgatggtaatgcaaaa

SEQ ID NO: 246413 - DNA, 375 bp, Homo sapiens
cagtgataagtccttccctatcagtaattattttaaatgtaagtggattaaacccatcaatcaaaagataccgagtggctgaatggataaaaaacaaaaacaaaaacaagatccaacgtatatcttgtcttcaagagactcactttagatgttaggacacatataggctgaaagtcagaccatagagaaagataattccacgtaaatggtaaccaaaaaagaacaggagtaggggaagatgaagtagagtttttgtatatgattgacattatcatcttaaaataggttgttacaactatttttatgatttttatgcaatttcctacggtaactacaaagaaaataccaacaacaaaaagaaaataatgtcattac

SEQ ID NO: 246414 - DNA, 323 bp, Homo sapiens
aaaataaacatacaatagagaggatcagcaaagccaaaagttagttccttggaaaagttgatagaacaaataaagccttggcagaattgatccagaaaaggagaaagaaggcccattaatcaataagaagaatgaaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaa

SEQ ID NO: 246415 - DNA, 561 bp, Homo sapiens
tctggccacacatttccttgcttgtcaaatgtgtccagcaggctgcacctcggggcattcacatgcctttccctctgcctggaatgctcttctcctaggtagccacgtggctcactccccggcctcagtggggaaggagctttgattgcccattcatctgagaggcctcccctgcatcccactccccaaatcaccctccctgggactcccgttctccacagcacctctcagctccttcatgtctgtccgcctgccacacatggagtttgtctttgttccctgccagaggctctccaagaatattcctggaagaattgaatgttgccaattcagctgcccccctgcctggagtcctctgctgcctgacagtccacgaatcccctcccgtcggccttggctgccaccagcctcccccaccagcccatgcaggccactcctagccagagcgagggccttctctgcactctgcctggaatcgcccacgtggctggctcttccttctgtggtggtgcctcctagagagggctgccgggcacctggctaggggagacatttcctggg

SEQ ID NO: 246416 - DNA, 749 bp, Homo sapiens
gggggcggggcacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctct

SEQ ID NO: 246417 - DNA, 747 bp, Homo sapiens
cgtggtcggctgtcgccataggaacggctggtgcccagacggcgcctgcccaggctgggaaggggcggtgaaggcagctcagacctccaagaaccctggagccccctgtgtggccaggcggagccacagaagcctgatgaaaacgggaccccctccccctctctcttctcatttttgattgctcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctct

SEQ ID NO: 246418 - DNA, 602 bp, Homo sapiens
tcataactagattgtgatttgttttgagattcttatgaccgtacaggtcataagatgtaaacattacttgcagcatgtgtctgtacctatgtatttgtttaggggagaaataatcttgactttaagtttttaaacatcttgttcctattttaaaaaatgacatgtgaatctgaaaagcttaatttagtagtaaggaagtaaaatgcttggtctttggtagcttttatcgtttatcccactgtttggcattcagtgttctgtagcttttaattcaacaaacccacatgaagtccctcctctttgtgctttttctgaatagatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctct

SEQ ID NO: 246419 - DNA, 798 bp, Homo sapiens
gggggcggggcacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcggtaagaacagagcatttcttgacgctggccccatcacccttctgagaactgccatgtgtactttcaacctagccacccagaatgctagaatttgctcttgattctatttccaagcatctaaaatgagagttggcttctgtgtcaagtgtgaggattttagaaagatggattacgcagtagtgcacagctgtctgtctgctctgttttataggatattatttttcgtttaaagagagatgagggagagaacaggcagtttaaagggatagtaggcaagttagtataaaataaaatgcaagccagcagaatctgtaagtttaaaatgaacacaa

SEQ ID NO: 246420 - DNA, 501 bp, Homo sapiens
gatccattattatcaggcataattaaaggggaaacagttgtggatgctgagactgactccaagtcttctaaatgagtgtggatggtgtcttctgaagtctttgacaccgtaatgacttcaggaatttggtcaaagatcaaggtgctctcatcagatccaactcataatgagagacgccagttgtactctggagcacttcttccttaatttctgatatgtctagctttccaagaggtcctgaagcagaaggtgcattcacatggagaagttttggctctggaaaactaccagtattccttcaactttattattgaggaagccaacataaatcaacacgattcttttcccacaaaagttcctttccaacctttgcagctgtctgcccacagatgtttcacatcactgtacttatggcatttttgtcctatgggccatcttctctgcttctgttgcgagacatgagacagattttcctaataaaacttaaaacccccaaaaaca

SEQ ID NO: 246421 - DNA, 614 bp, Homo sapiens
gtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcactccagcctgggtgacagaacaagactgtctcaaaaaaaaaaaaaagtttgagggaatgggttccttctcttctgcccttctgccatgtgagcacacagtgttaaacccctcggatgaagcagtgttcaaagcaccatcttggaagaaaagactgagccctcacaaaacaccgaaactgctggtactttgatcttagacttttgagcctcctgaacatgagaaataaatttctaaggtaata

SEQ ID NO: 246422 - DNA, 916 bp, Homo sapiens
  misc_feature (594)..(594): n is a, c, g, or t
  misc_feature (599)..(599): n is a, c, g, or t
gtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattaattaaaacaagcttcagaaagtaagcttttagaaatacagactgaaaagaacaaacagaagattgattnggacngtatggaaaactcagagaggataaagatcatacgacaaaacctacagatggagataaaaattactactgttattcaacatgtgttccagaaccttattttcggggaagtaaagtcaattgggcagaggatcctgcccttaaggaacatggttctgcaagcttgagaagaatgttgacatgatgtatataagacttccctttctgacatattttacattttctggcaatctcaactcttatttggaatacttctgtgcattgtctgtgcaccgtaattttgaaagctatcataacggttaccgtgtagtacagtgggg

SEQ ID NO: 246423 - DNA, 840 bp, Homo sapiens
  misc_feature (518)..(518): n is a, c, g, or t
  misc_feature (523)..(523): n is a, c, g, or t
gtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagcatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattaattaaaacaagcttcagaaagtaagcttttagaaatacagactgaaaagaacaaacagaagattgattnggacngtatggaaaactcagagaggataaagatcatacgacaaaacctacagatggagataaaaattactactgttattcaacatgtgttccagaaccttattttcggggaagtaaagtcaattgggcagaggatcctgcccttaaggaacatggttctgcaagcttgagaagaatgttgacatgatgtatataagacttccctttctgacatattttacattttctggcaatctcaactcttatttggaatacttctgtgcattgtctgtgcaccgtaattttgaaagctatcataacggttaccgtgtagtacagtgggg

SEQ ID NO: 246424 - DNA, 378 bp, Homo sapiens
tcagacaatctagcagctcaacttcttgatttcctactctaaaggacctggctagggaggagtgccatttctgaagcaaagcaagagccagtgagacaaaatcaaagagaagcaacagtacagatagaggaggaaactagtaacaatagaactttataagaaaatcaccagataaactgtcattccagtggtttcaagtatctattctcttttgtgtattctcataaaagccttagagtcagcaacgggacaggtggtgtcattcctctctttctccagggcagtgagggcagcagctgagcccaggctctcggtgaagtggtggaaaactatcactggagcagttgggctggcagcagtggggatgagggagtttca

SEQ ID NO: 246425 - DNA, 339 bp, Homo sapiens
gcctcccaaagtgctgggattagaggcgtgagccaccatgcccagccgattcttaaaggtggtaagccccattctccccacagaactcgctctgtactcttaagcttctttctcagttcctaggaccaattcaacatgagatggtaaaaactgaacagcatctgcttatttattctctctagatctagacagggttgaggcactgctttgcttgacaccttctttttgcaggttggacacctgtgcatgtgctcagcctttctgatgacgctgcctgcctgccttgagttggttgacctggatgtccccctttttgttcctccattggcacagagctcc

SEQ ID NO: 246426 - DNA, 649 bp, Homo sapiens
gaatcaagaaataatacaaggtatcagaattcatctgataagttccatctcctacacagaggtattacttcccccaaaataggtagatgtcattgttatttgtgaaaaggaaatttaaaaaatcaatgaaacatcataaattataaatatagatataaaataaatacttgctaaatgagagaatactattaataaaaggtcattctgtatttaatcgacaaatacaaaatgtatcgtgtgggcttgtaaactgtcaagctgttaaaaatggatccctgattctgaaaaggtagcacatgaagggcaagtactgaaaacaaggcatgctttttaaatccaatcctgaaacttcagtgagctctaaaaggacatttgctcgagtccagggaatgtggaacacagcatgagaaatgtgaacattcttggtaaactgacatcatcatgacaactctggcagggctccaagtgtctgaagcagaacgaagtcttgtttatgaagtgggagaaagaaacttgggctttctgatttacaccttggcaggaagcagaaatggttaaaagaaaaggaacactttttatatacagtaactggcaattttcagtgaagaaatgggaagaagagaaaagaaagctatttgaaaagttgaaa

SEQ ID NO: 246427 - DNA, 403 bp, Homo sapiens
tagtgtttttgtatgtaataaggttttgtattaccttattatacaagaatggttaaatggattttcactgaatatgtagagtttagaagttgctctggaagaagtgctttctttcactctagcactctcatcttgcatctatactatgttactgttgctgctgattctcttgaagtttactctgctggccagattctcccctgctcaccagtagtgaaacctcatcttgatcttgggcaacaaaaactttctcctgcagtgcaaatgactattttttgttttgttttttgatggggagggcagtgtcgtttttttttttcttttttggagtgtggggagcagcatgtaccagttatccaccactcactcagaggtaccttttctcgacatgggaggattccac

SEQ ID NO: 246428 - DNA, 110 bp, Homo sapiens
ggtataattggtaatgaacagtacttttgctaattatctttactgtcctcccctgaagtatagtgaacagagaccaagtgagccaatatcttgtgtcatatggctataga

SEQ ID NO: 246429 - DNA, 362 bp, Homo sapiens
tactccagcctgggctacagagtgagactccacctcaaaaaataaataaataaataaataaataaacttacgtatgtatgtacgtacgtttgtaaagggggggttccaggcccttcagaaaaacagtcctgggttttactgtatttactgggtttaaacaagctaagctaggggtagtttatttagcctttaaaaagatttgcatacatatcaaagggacagaggaataatttataaatactgggtttttcaaagaaatgctgtgaggaaaaggaaggagagaagatctctttccctttggaaacagtgaaaattcagttttaaaatttttactatatgtttgcatgacaactaaaaaaaaa

SEQ ID NO: 246430 - DNA, 261 bp, Homo sapiens
gaggaggggagtggcctaaggtggggcccggtggccccttcttccaccctcagccagttcttttctacctgtgtgaccttggaatcccagacacccaccactcccccagcctttcacaaacattacacagtgtgtgtgtgtgtgtgtgtgtgtgtgtgtgtgtgtgtgtgtgagaatgcatttttttattatttctggacattttatttatttatttatttatttcgtgacagagtgtgagactccatccaaaaaaaaaaa

SEQ ID NO: 246431 - DNA, 491 bp, Homo sapiens
cttttttcatacccccaggggtatgttaacgtttttctgacaaccttccagagtttttctgtgattacacacgttcacagacatttaaaaaaaatagaaatgggatcatacttctcctgtgatgcctgatattttcctgttttacagaagacagcgtaattgtttcagggtccaggagttacgtgcctaattattaacagtaacttttactttattaaaacgtattccacgcccagcccagaaattgatttctatttgccattctccaaaagacaaaaaaagttggtttttttttttttttcggtcttttgtttgtttgtttgttttttaagagatagggtcttgctttgttgcccagactggaggtcagtggcttttcacagctgcagttatagcctactgcagcctcgaactcttggcctcaagcaatcctcccacctcagcctcccaggtatctaggacaacaggcatgcaacacaaagcacagctct

SEQ ID NO: 246432 - DNA, 563 bp, Homo sapiens
tctaaaggggttgaacccttttaaagtcttttaaaaattaatttttaattttctaagtgatataggaatatattcttttcatttaaaaatgaaaacaattagggattatggctaaattcacttttgatcaccacccccacacccataccatcaccacccatccccatccccatccacataagccttccccattccccaggggtacctgctattattggtttggtgtatgtcttgcttgttctttttctgtgccctggcggatataaaccaatgggacatagacattactggagtgagagtttgtgtggtgtgtgtgtgtgtgtgtgtgtgtgtgtgtggtgtgtgtgtgtataacatgtaagctgtattgtaccaaacccatcattctataatgatgtgttttacatgatgctacatcttagaggtcttactatgatgtggatatgtatatattacttgagtagtttccataaaccatttttcatcagtgcctttttgacgttactttcgggaaagaatctggggcttcattaaagacccaatgattctttttaaaaaaaaaa

SEQ ID NO: 246433 - DNA, 353 bp, Homo sapiens
atttttgcctgtctggtaggtatggaaaaggtatttcattgtagatttgattttcgttttgcttattactgataggttgagcatctttccacttcttcactgcccatttggttttcttttctgtgaatgccagtttgtgtcttttgtccactttcctattgcagtgtttcattttttcttattgattcattggtttccttcatatattctagatgttaaccctttgccagttacataaactgcaaataatttttcccagattgtggcatgtcttttcactattttaaaaatgaattgtgatgaatatacatttaaaattttaatggagaaaatgtattaaccatttcctttct

SEQ ID NO: 246434 - DNA, 456 bp, Homo sapiens
atttaaaacatgctaagaaaaatgtcttgaaattaatagcaggttcccagtgttggcaaatacgtaaggaccacagataattccatcccataatataccccagcctttctagggcaaaagaggaataaatgacccaacacgaagaaaaattttggattttgtcagttctccaccattttcttaaacaggcagaaaactaaactaaaagctagaatttgttaatgtcaaggaaatgccctgaaaatataataaggaaaaaagaggccgaggcaggtggatcacctgaggtgaaaccccgtctctattaaaaatacaaaaaattagctgagcgtggtggtgctgaggcagaagaattgcttgaacccaggaggtggagactgcagtgggctaagatcatgccactgcactccagcctgggcaacagagcaagattccgtctcaaaaaagaaaaaaaaa

SEQ ID NO: 246435 - DNA, 532 bp, Homo sapiens
tgcttttagatatatattggttgcaaaagtttggcattaatgatttccctctgcttatgtgtaaatgcctatgttccaaagctttgccactagatattcaaatcataaattgtcatgtaagccagtcttccagaaagaaaagctatttcagcaaaatgatatttcacatttagacaaaacagtagtatttagacaataatattttgacaaaaccattttcaaaactgcttaggaaaaaggggaaatattatacttaaaggtaatgacctctgtcttgaatagaggtgagtgggttggtgacaactggtttggaggcttttgtgggggactgtggtgtcttttggattgtgtcatcagctccttcatcaagtaagcgtgtagctgttattgcctattgtaaaacatgaattgatgtgaacagtactcaatctcttacattatatgaagtataacttcctctcttttttgcctataatacatcctttaacttttacagattaaaaaaccactgttagacaaagcaaaatggaac

SEQ ID NO: 246436 - DNA, 629 bp, Homo sapiens
catggccacagttcagcagctggaaggaagatggcgcctggtggacagcagaggctttgatgaatatgtgaaggagctaggagtgggaatagctttgcgaaaaatggacacaatagccaagccagattgtatcatcacttgtgatggcaaaaacctcaccataaaaaccgagagcactttgaaaacaacacagttttcttgtaccctgggagagaattttgaagaaaccacagctgatggcagaaaaactcagactgtgtgcaactttacagatggtgcattggttcaacatcaggagtgggatgggaaggaaaacacaataagaagaaaattgaaagatgggaaattagtggtggactgtgtcatgaacagtgtcacctgtactcggatctatgaaaaagtagaataaaaattccatcatcactttggacaggagttaactaagagaatgaccaagctcagttcaatgagcaaatctccataccgtttcttttttttttttttcattactgtgttcaattatctttatcccaaacattttacatacagctatttcaaagtgtgttggattaattaggatcatccctttggttaataaataaatgtgtttgtgctaataaaaaaaatga

SEQ ID NO: 246437 - DNA, 380 bp, Homo sapiens
tccagcctgggtgacagagcaatactctgtctcaagaaaataaataaaaactaataaaaaataaaaataaagtccactgaagtgtaaactaaagtctttgtcccactgaaattatttattgctttcactggacatgttaggattaaaaatttgcctgtgagatgcagaacattgtgtataaaatgctaccttttgtgtagaaagaccaggaaaaaataagattatgttttgcttgactacatgtaaagggactctggaaggacacataagaaattggcattttggtttggcatggtggctcacgcctgggaggccaaggcaggtggatcacctgaagtcagaggttcgagtccagcctggccaatatgacgaaaccccgt

SEQ ID NO: 246438 - DNA, 363 bp, Homo sapiens
caattccctaagctgctataaaatactttactttttccttgtaagaaaagttttattttcatattcttaattaaagaagagggttcagaagcaagatacaaatcagtttggtccttacgggcaaactgcactcatgatgtgcattttcactttataagaattagatggtaaatatctgatgtagcctacaggaagaagggctagcactaaggttccatctcaagcaaacctggcttccacatgttccctcagaggccgggcgcggtagctcacgcctgtaatcctagcactttgggaggccgagaagggtggatctcctcaggtcaggagttcaagatcagcctggccaacatggtgaaacgc

SEQ ID NO: 246439 - DNA, 492 bp, Homo sapiens
caggaggcttgcttgagctcaggagttcgagtccagcctgcacaacaaagtaagaccacttttcttaaaaaagaacaatgaaaaacctgatataattgattttcctcttgtgattttttagctcccttaaagtatattttaaatcatcatggtttaatatctgaatcatggtttttcttctttattggttatttggttggttttcttgggaaaagaggttggtactagtccaatttgcacgtttgtagaggattctatacacatgtagtcctacatgtacacacacatacacaaattatttataaatatataatatatatgtgtcagagaacataaattaatgttatattgtgaagcttatatataattcagttttgcagatgaatttattcaagagcagcttatggagattaaaactatacaacttagaaattaaatactgaattttaagattttttttctttcctaaaagccatactttctttttttttt

SEQ ID NO: 246440 - DNA, 423 bp, Homo sapiens
ataagtggacagagtctttttttaaaaaatattgaggctaactgtaaaacttagtaaattattttaaatagaaattactgttttgtcacataaaataagaactgtgatttatgcataatttatgcatacttctaacttaaaatttcttctaagcatatcttcatatatgataattaaacagaagcgttcatctcatgtaactatattgcttttctgtctcgatgtagtcataaccaataatccaatattatttcaacattttttcctctggtaagatagatgggcaattcagctccttctaatataatcatttcccttaaatataagggagttcttcgtgtgctaatatgaaacaaaaagtctccaagacatattgttaggtgaaaaaaagcaagatgcggcatttttcttaccatttgtgta

SEQ ID NO: 246441 - DNA, 141 bp, Homo sapiens
tcctgaaaaggttattattaaattctttcgcgtaatgcccctttacaaatattgttaaacattaatttacagaagaacttaaatcttaatttcaagggtggcataagactatcgctttgaaattgtatctttcgcaagtta

SEQ ID NO: 246442 - DNA, 464 bp, Homo sapiens
attccagagtcaaaggtcataagaaatctcattataatttacttttcggtgtatgattttatagtgcctcactgtagctggtcataaagtttatcacttactagcactataggattcattatgtaatttgagctattatttaaatctggctgttctttttataattgtttttgaaaataaatgaagacatagaggatggatgattagcataatgaaaactggtttcatgaaacattcacactatagtgtactctgttcacatctagtctgttcctttctctttttagtgctggttataaccctctcagttaatttcaagactcatcaatcagtagcgttttttttgccccctgaaagtttactcgatagtcttaagagactgaaagagtagttgtagtgaaaggaaaacaccaagcttggcactctggatctaaggatttcctagcaaaaaaatacagtggaga

SEQ ID NO: 246443 - DNA, 478 bp, Homo sapiens
gatgccaaagaacttggcgtaccacaaagtagaaatgtgtatacaagtcaccaacaaaatgtgatgggagccatagaaaggcagcaattaatccagggggtgggcaagtgtccagaaaggaggcaggtaaagtattaacagtgacaaggagctgaggggccaaacaactctcagagcagagcctcccaacctctgccgtcacagcatatgaagagaacgtcacctggacatggaactcactgaaaatactcattccacgatctattgatgatcagaaggataggatattatgcattatgggaaatagtaactactaagaatgcatacagtctttaaaaatcctttcaatctttttacatgagatatttgggctgtttaaacatgaccttatttttcattcctatatatatgtagcctgtaattcaagcgtctaaatggattgacagacaatttctattaaagtgttcattgtgtctca

SEQ ID NO: 246444 - DNA, 342 bp, Homo sapiens
gacagtaaaaggaaaaaattggcggggcgcaatggctcatacctgtaatcccagcactttgggaggctgaggtgggtggatcgcttgagcccagttcaggcaacatgacaaaacccccacctctacaaaaaaaatagtcaacatgacaaaacccccaatgtctacaaaaaaatacacaaaacatatgagccaggggtggtggtgtgcacttgtagtcctagctacttggtaggctgaggtgggagtatcgcttgaacctgggaggtggaggttgcagtaagctgaggttgagctgttataccccaacctgggtgacagttgaaagagtgagaccctgtcttt

SEQ ID NO: 246445 - DNA, 256 bp, Homo sapiens
ccacttcctccctcagctcctccccctccccatccttctgttgccacctccttacaggtatttccagaaaggcacaccaataaacagcatgcacccaaggccccgtctcaggctctatttctaaaaaactcaacctaagccatgcacactggctcacacctgtaatctcagcacgttggaaggtcaaggtgggaggatcacttgagcccaggagttcaagaccagcccaagcaacacagcaagacgccatctctac

SEQ ID NO: 246446 - DNA, 366 bp, Homo sapiens
actgtccgttcactttctcatttgttcattcatttgcttgttcgttcctagcctgtcagattctcttctgagccaggcaaatcaaggggtgcaatccttggcatcgtgcatctctaggattaaatgctttaaaggataggaggtaacagagtggccccggggaagcccgatcggagtggcgggcatgctaccccaccctgcaaatctccctgcactgtccctggggcccagctgggttccccacaccagttgttctgtgctgccgtttcttcttttatcgctgtattttaaacactttgcacatcgggaactattcttgtgcatcgtgggttttctggtgtgtgtggaatcccttcctgagaatgc

SEQ ID NO: 246447 - DNA, 468 bp, Homo sapiens
atcatggtagaaggcagagttggagtgaggagcttcacgtggccagagcaggaggaagaaagagagtggggaggtgctacacacttttattttactctcagtttcttaagagagacacagatagcaggaaaaagcattgttctcactttacggtgatggaaagctagaccaaacaccatgttgtcaacttttctcaaacccgtcagagagctaagttcacaaagcaaacaacaggacctcaaatctaaggagaagcaggtaacataaggatagacaaagtgtgaacctggacttaaacggggcagatggccatggatactagtaaggggaggttggctgggttgactggcaaatggtgaaggccaagagcacattggtgagatagtgtgaagtcaccgaccaccacagaaatccagagtctgaactgccttcagggtttttctccaaaaactctaacaggcactcaca

SEQ ID NO: 246448 - DNA, 313 bp, Homo sapiens
actgtcaatcaaaaatatttgaaatataaatggacagttgcatctgtactgatgcagtgcatgtactgtacatgtgcagacctttttttcttattattccataaacaatacagtataacagctatttatatagcatgtaaattacattaggtattataagtaatctagagattatttaaatatataggagagctgggcatggtggtatgcacctattgtcccagctatttgggaggctgaggtgggaggaacacttaagctcaggaattcaagtccagcccaccctgggcaacacagtgagactccgtctcta

SEQ ID NO: 246449 - DNA, 425 bp, Homo sapiens
tgcttcaagtgtggtatggcagcacccatctgctgtgtccatctacactttattatatatctatgcacctcatcagggaagcacgggaacccgcaggcactgctagtaggaaggcaagctggcctggccattctggagaagaacatggcagtatactcagtcacattccagtcgcacagcctgtgatttgggtatgcatcatggataaatgttcattgtagtgttatttaggaaatccaggagctggagatggaaagcaatgtgcttgaactaggtaggatgtatacagctcaaatgggccaactgttaaattttcaggaatttggtgagctagtttttataccccgttattatttaaaatcaaattatataaacttaccactaaataacatatatttttaaaagtaataaatacttaaaacaca

SEQ ID NO: 246450 - DNA, 360 bp, Homo sapiens
agttctgttattgcaccccacctccagatgccaaattctgtatttgttaggattcagtttgttctctcatataaaagaattttcggccgagcgcagtggctcatgcctgtaatcccagcactttgggaggccgaggcaggtggatcacctgaggtcaggagtccaagaccagcctggccaacatagtgaaaccccatctctactaaaaatacaaaaaaattagccaggcgtggtggcgggcgcctataatcccagctacctgggagggtgaggcaggagaagtgcttgaacccaggaggcggaggttgcagtgagccaaaattgcgccactgcactccatcctgggcaacaagagtgaaa

SEQ ID NO: 246451 - DNA, 403 bp, Homo sapiens
ctgaatatctacaggcaaaagaatgaaattggatttaagaatccaatcttacactatacacaaaaattaactcaaaatggattaaatacttaaatgtaagacctgaaattgtaaaattcctagagttaaacatagaaagctctttgacattggtcttggccataatttttttgtatatgatcgcaaaagcatagacaacaaaagcaaaaatagacaaatgggattgaatcataccaaaaactcctgcaaagcaaaaacaaacaaacaaaaaaaaccaaaaccaccaacaaaataaaaatgcaacctacaaaatgggagaaaatatttgcaagctatgtatctgagaggggctgaatatccaatatatatatatatatatgagaaaatcatacaactcaatagc

SEQ ID NO: 246452 - DNA, 460 bp, Homo sapiens
ttgtgtctctgacattcttctgcctcctgcactttaaaccaaatcccccaaagcagcattcttctttacactggactgacgattaagccagactggtgaaagcaacagagtggctggtgggaaagagcttctgaccaggagtccccagtccttacctggctccaccaggtacaaccccagtcaagtcacctctgatctctgggcctcatctgtaaaataaggatgaccattcttgaccttctcatcttgcaaggcagctatggaaataaagtgagatagccagaagattcaaagtgcttcttaagcccacccctgtctggggcttggtttgattctatggtcttcatctctcattgctgtttgctgatgttagtgttatttccctccttcccttccctcccttcctccctcccttcttctttcttcgtttctttcttttcttattttgagacaaggtctt

SEQ ID NO: 246453 - DNA, 417 bp, Homo sapiens
aattcaaagatgaaagtcaagattcttgttcttgtaaaacttttgaatttaataaagataaagcaacatttctgcaaagaaggtagaaggacataaaaccaaattaagagatacatacaatggccaagaaagcacctaagagaaaagtgactgatatccaactacagaaattagagaggaccacgtggaggaggtgataatgaattttgaacttgaaggacaactagaattccagcaaatgaagatgaagagaagcacatttcagacaaaaggcacgaaaagacacagtggtgaaaaagttaaggaccagtttggggaatgacttatagacatttcttaggtgtgtagtggtgaaggaaaatagtggaagatgtctgcaataaaattataaaatcttttgtatgtaaacttgagtca

SEQ ID NO: 246454 - DNA, 374 bp, Homo sapiens
caggagaccgaggtgggaggatcacctgagcctagggaggttgaggctacagtgacccatgatcgcgccactgcactccagcctgagcaacagaacaagactctgtctcaaaaaaaaagaaaagaaaagaaaaagaaaaaagagcgctaggcttgtgggtgctttcccttccttggtgatactaacatctgtcgctggcagggcacttcccagcccagatcaaaatgaagtgggctttccctactttatgtcctcagatcttctctactacccagtgagggacgaactgacactttattacggaatcacagatgagattccagaataaagattctttattctttccaaaataaagaagtagtatgattgtgata

SEQ ID NO: 246455 - DNA, 407 bp, Homo sapiens
aaagcctttaagattctggcccagccaaggatgtcagatctcactgtcatcagcgcttctttgtctccctttccattctccttagtaaaatggcttggccctcctccccaacaaaaaaggagagcatggcaaaggaacacaacagtcaccctgagagacgtcacatatgatcatttgagcaataaaataagtaatacagtattatattataacccaaagtattaaataaatatccatgagtccatacttccagaaatacatgataaaataagtaactaaattgggagaaggaacagcttttccttgcaaaagaattacaaattatacatgtagatagtaacccctccaggaggtggagcttaatttctcttcctttgaatgtaggctgaacttagtgactcatttcc

SEQ ID NO: 246456 - DNA, 776 bp, Homo sapiens
catctctgggtcagaaatctgacaactcatggaaacagttcatctttgggcacttgggctcagcacactgggtagaaaagcctctcacttttaatcagagagccggatgacaaaattaggggtgtgtgtttggggttagctgggggtttgagtctcagctctgccatcacctagctaggtatcctcagtgctcccacctatcaaatagaagtggccgtgcccatcttttaggactatgatgattgaatgcactgataactttaagttactttgtgtagtgcctggtgtttaggatgtatacggtaattggtgattgttaatgaaatctaggttaaaaagataatcagtgcagtaccccatcctcctaccaccctatcaacgtttgccattctagagtttttagcaacttttagaaaccacacagggctttagtgcatcttgtcactagatggatttgctagttttcaggattctagaaggctccaaactcagatcatggtttggtccgtgacaaggagaaaaccttggttatatgcaagaccgtaacaaaatttccccatttcttttctttttttccttttttttttttttgccccgccatttttggaatttcttatagtctaagatgattcttactatactcatgtttccatcccaccaaaccttgaatccattgagactcaaatgggctctagagagcatgaaagagttaacgtgtccctgagtgcccagtttcttacaggattaggggaaaagtgactttatttttatttgca

SEQ ID NO: 246457 - DNA, 641 bp, Homo sapiens
tagctcatgctagagtgcagtggcatgatcataacttactgcagccttgacctcctgggctcaaattatccttccatctcagcctcctgagtagatggactatgggttcatgccatcatgcctggctaattttttgtactttttttttttgtagagatgaggttttgccatgttgcccaggctggtctcaaactcctgatttcaggtgacccacccacctcggcctcccaaagtgccaggattacaggcgtgagccaccgtgcccggcctgaattgtacatgttatatgtgtggagtttattataagtaaaatgtacctcaataaagtaactaaaggagtttaaactttttttggaataagagataattctaccttaaactgattttgaaatgttggctttgtttccagaaagatcatccacccaacaaaggttaagtcacttcaggcactactaagaactagtgactgtaatactgttacttagctccattgctcctttgagtgaaacagatataggaagcctggaatcagttctgcccacttattaagttatgtaaccctggtcaagcttcttaacctcctccgccttaggttccttacctctaaaatagagacataacatatacctcaaaaagttgtg

SEQ ID NO: 246458 - DNA, 617 bp, Homo sapiens
agtaaatgggagaaactttttccaaaagcagaatcagcagattttcatcatgatctgggaagccgtggggaggtgggtggagaagtcagcgaagaataaaggagccaaaggtgattccgaggtttgagcttgagttactacacacagacagcagaaatctcaaggaaagacttgattttatggaatgatgatgattttagtgttagacataattttaaagttctggagggaactaggtaaacaatgtcaagtgaggcactggaagtgaccttagatttggagtccaaaacagaagccatccttgcaggtgcacattttagaaattgtatagaaaaagacaggagaggccgggtgtggtggctcacgcctgtaatcccagcactttgggaggccgaggcaggcagatcacgaggtcaggagttcgagatgagcctggccaacatggtgaaaccctgtctctactatcaaatacaaaaattagcagggcatggtggtgtgcgcctgtaatcccagctactcgggaggctgaggcaggagaattgcttgaacacttggccctgggaggcagaggttgcagtgagccgagatcgtgccactgcactccagtctcaaaaaaa

SEQ ID NO: 246459 - DNA, 802 bp, Homo sapiens
  misc_feature (13)..(13): n is a, c, g, or t
  misc_feature (16)..(16): n is a, c, g, or t
  misc_feature (26)..(26): n is a, c, g, or t
gcttctgctgccngcngtcgctctgncgatccccatatatccgccttccggagataaatgtggagttttccaggtggaggaaaggcaagtacaaagacatcaaggctgtgaaagtgcttggcatgttcaagaagtagcaataaaggcagtatacctggagcagagtggaaaagcaggagaattgtaggagagaaagggagagagatattaaggtgctagatcatgtaaggactttgggttttatgctgagatgggtgctgaggagtgatgtcatctgaattaggtttttaatgaattattctggctacagtgtagataataaagtgtaagagtaaaagagaaaatcaattaggaggtaattgaagtagttcaggtgagatgattagatcaggattgtagtattggaggttgttaagaagtggtggaattctcgattagaaaagtgagaaagaaaaagacaggattcatttctctgggaaaaaaaaaaaaacaagatatttcagggacatgaagagaggagtagactaaagagaaggcaacaaaggaagaaaataaacaggattcctgaaagcaggagtattcaattgtgtcagaaattggaaataaatcaattaggatttattgataaccaagcaatttgaatggggagtggttggaacagaagccaagtagtagttggttgagtaataaatgtgaatagaggaagtggaggcagctaggaagacaactgtagtactaagtaaggatggtggaggctgaggacgacggtgaccgtgtccttgccccagacgtcactcgtgca

SEQ ID NO: 246460 - DNA, 1120 bp, Homo sapiens
cacctgaggtcaggagtttgagaccagcctggccaatatggtgaaaccctgtctctcctaaaaatacaataattagctgggcatggtggcgcgtgcctgtaatcccagctgctcgggaggcaggagaattgcttgaacccaggaggcgaatgttgcagtgagccaagattgtgccactgcactccagcctgggtgacagagcgagagtcagtctcaaaaagaataaaataatgttgggagtgaaaaaaataaagcagggttaggagggataagaaaatggtgggggcactattttgtagagcatgatcatagtgatttttgagcctcatttgaacagacatctaaaggaatcgaaggagtaagcaatggagataaatgtggagttttccaggtggaggaaaggcaagtacaaagacatcaaggctgtgaaagtgcttggcatgttcaagaagtagcaataaaggcagtatacctggagcagagtggaaaagcaggagaattgtaggagagaaagggagagagatattaaggtgctagatcatgtaaggactttgggttttatgctgagatgggtgctgaggagtgatgtcatctgaattaggtttttaatgaattattctggctacagtgtagataataaagtgtaagagtaaaagagaaaatcaattaggaggtaattgaagtagttcaggtgagatgattagatcaggattgtagtattggaggttgttaagaagtggtggaattctcgattagaaaagtgagaaagaaaaagacaggattcatttctctgggaaaaaaaaaaaaacaagatatttcagggacatgaagagaggagtagactaaagagaaggcaacaaaggaagaaaataaacaggattcctgaaagcaggagtattcaattgtgtcagaaattggaaataaatcaattaggatttattgataaccaagcaatttgaatggggagtggttggaacagaagccaagtagtagttggttgagtaataaatgtgaatagaggaagtggaggcagctaggaagacaactgtagtactaagtaaggatggtggaggctgaggacgacggtgaccgtgtccttgccccagacgtcactcgtgca

SEQ ID NO: 246461 - DNA, 430 bp, Homo sapiens
atgagtcctgaacttttgtcttgaggctagaattctccttcaaacagcagttttaacactcaacttctttcttgttttttccacttgtcaactcatgaacacctcaaccttgttacatccaaagccaaactcatggcttggagtggtaggtgatggctgtaatcccagtgctatgggaggcagaggtgggaggattacttgaggccaggagttggaagccagcctggaaaacacagtgagactccctatctacaaaaaaaaaaaaaaaaaaaaaaaaaaaaagctagcatggtgatgtgcatctgtaggatctgtagtcctgctacatggcacgctgaggcaggaggatcacttgaccccaggagtttgaggctgcaaagagttatgattgcaccaatgcactccagcctgggtgacacagccagagacc

SEQ ID NO: 246462 - DNA, 398 bp, Homo sapiens
ctgggatgatggatggctttattagcatgcttcaattttatatttatcaaattaaaccagcagccaagggacacttaattaagattctttgtcatcagtcagaggagagaagatgggggagagaaagggcttatgacccatattctagaaggaaaggtttaagtgcccaaaataatatgtcagaggcccttgggagggtttggtggcttgcagtaatgagggctgtcttcaccgtgggaatccgaggatgggttcgagtctttcttccttaagtgttttctctttattaagctctcatcagagatgcgacatttattcagtgctggtcctccatgttaacaaactcgtcgcatgtggtgaactgaaaataagtggagagtagggtaaaatacgaaaaa

SEQ ID NO: 246463 - DNA, 447 bp, Homo sapiens
ctgggatgatggatggctttattagcatgcttcaattttatatttatcaaattaaaccagcagccaagggacacttaattaagattctttgtcatcagtcagaggagagaagatgggggagagaaagggcttatgacccatattctagaaggaaaggtttaagtgcccaaaataatatgtcagaggcccttgggagggtttggtggcttgcagtaatgagggctgtcttcaccgtgggaatccgaggatgggttcgagtctttcttccttaagtgttttctctttattaagctctcatcagagatgcgacatttattcagtgctggtcctccatgttaacaaacacaccatgtctgtaagatatcagagcacagggcagccagggagtctgggttcaaatcccgactctccttactaattgcataatcatgggcaagttacttcatt

SEQ ID NO: 246464 - DNA, 374 bp, Homo sapiens
ttttattaagtaatgggaagggaagtaaatcatttattttatggctaaacatatatgctcattattcatattatatatcaatggttccaggggaaaaatagatgcacatttgatgtgcaaattatgtaaaagtgtttaggacttggctatatatgtttctttggtggagaaatatctatgtgatagagatttctttgggaaagatgacactcacaaaaaaagccagaaatttctgttttatagattttgataaaatgtatgaaataattttcgcagccaaaggaaagtatagcacagtatattatggagagatgttacagctcaggaaaattaatacatgtcagctgtttaataaattatgcatttaattattg

SEQ ID NO: 246465 - DNA, 376 bp, Homo sapiens
cctttctggcagtgacgacctacccacaggagaacatgcctctcgcaaaagatctccttcatccctccccagaagaagagaagaagaaacacaagaagaaacgcctggtgcagagccccaattcctacttcatgggtgtgaaatgcccaggataatataaatcaccacggtctttagccatgcacaaatggtagttttgtgtgttggctgctccactgtcctctgccagcctacaggaggaaaagcaaggcttacagaaggatgttccttcaggaagaagcagcactaaaagcactctgaatcaagatgagtgggaaaccatctcaataagcacatttttgataaaaataaaaaataaaataaaataaaataaaaa

SEQ ID NO: 246466 - DNA, 463 bp, Homo sapiens
acctctgtgaaaacagctgtgccattccaattgtgtatctggtggtggcatctgcccccttcctatgaatgaatgtgctccctcaaaatggcagaagagtataggtggcaggcacactggattggagctgggagcctaaggcactgcttttagctttctctgctaactggctgtgggacattggagaacccccctaccaccagctctttgggtttcattttctctatctggaaaggagaggtttggactgggtgacttccaaaaggtcctttcagttgtaatactcaactatgctgtttgaagaagcaaaataatctttaattcatttttctggccgtcctaaagttgttgtgaagtgtacatgagatgttctcggcaacatttttgttgttgtttgttttacttttattgattggttttcaaccatttgaaagttataatagacccagtctttatataaaaa

SEQ ID NO: 246467 - DNA, 376 bp, Homo sapiens
aagggtcctaaggtcaaccagattgggagctttctacattctctaacccacctccgtggaaatgccccatgcctgcagtgcccaggtgtgtatcaaaagcttcgaaaagtcacacagccaagaaatctgctgaattctattcagccgagggtcttccaaactaactggaccatgggccctctcttggcctgacacagcctcaagccactctggggatcctgacttggcatgcatggccagggagagcacttctgagagcaggattgtcattcagacaggggtgtgcagacacgtgttagcagtggacaccaacacacggtaattttcctgggcaccaactctgaggaatgaagtctttaaagactagagtaaagcc

SEQ ID NO: 246468 - DNA, 496 bp, Homo sapiens
acagcacatcataaatcccactgttcgtatactggctaagagtcaaggctagatattcaggcatccccagagctttcccagtccagctgtaaattaatactttactacacagttcctgacaatttaatctaataaaaggcaaaatgatgatggtagctgcattgtataaactacagtaaaatttattaaatgctttaatatgtattaacttatttgaactttataattctgtgagctatatgggaaaattatttttatctccattttatagatactaagactcagagaggttaagtgattggcccagttcacataccttttgtgttggtagagtcagttctagaagacaggccttctgccttttattttagattttttttcaacacttcctgccaaaagtagatataaagaactatttacttactttctaactgttctatggaacagtgtgggaataaacaaatatatttaaaaccactacttatttccccccaaa

SEQ ID NO: 246469 - DNA, 443 bp, Homo sapiens
gtaatatcagaaaactacttgtcagattgaaataaaatactaattgatattatccctgcccactggtggcaatttagaacaacttttctataaaattctctttggtaaaacagcattcaggtatttgaagatagaatcgtgttcccttaagtattcatctaacattctcaggttcattaactactcatttggtgccatgaattccaactgtctttaccagttccctcacccattattctctaagcttatattttttctccagctataataaggtctacttggcaaataaaaatttcacatatttaaaaattacatatatcagccaggcacagtggctcatgcctgtaatcctagcactttaggagtctaaggcaggtggatcacttgatgtcaggagttcgagaccagcctggccaacatggtgaaaccccatctctactaaa

SEQ ID NO: 246470 - DNA, 328 bp, Homo sapiens
tacgtgcacatccaggcacagcacctttccttaaacttatttatgacacagagacctttgctcacatgttttcctgctgaccctctccccaccattaccctatagtcctgccacatccccctcactgaaatagtagaaatagtgatcaataaatactgaaggaactcagagaccagtgccggcgcgggtcctccatatgctggcaccagttccctgggcccactgttctttcgctatactttgtctctgtgtcttatttcttttctcagtctcatcccacctgacgagaaataaccacaggtgttggggggaggggctgcccccttca

SEQ ID NO: 246471 - DNA, 349 bp, Homo sapiens
caaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctc

SEQ ID NO: 246472 - DNA, 452 bp, Homo sapiens
ttccctctccttggatgtaagtgaggaagcctctagagtctagaagctactgacagacctctcactaccacgagggcttgaggaccaagacagtaccgtgagacagatccagtggcacctcagagctgctgttctgaaggatgtcatgaatatctcgcccaagctgcacaggacttttcagttacttgacaacgtatctctttcattgcttcctgggacctaccgctgaaagcctctaactggaactctctcctaccaactgacgctcccacagtaggcacagtgagcacataggaatagaaagctgattcctggtactttgcagcttgactccttttagtggcttcctggtctagatggagtaaaacctgggggatctacttctggtattggttgtatgaggaagtcaagggatttcccttggcagaaagtaagtaaaaaaaatggacaaa

SEQ ID NO: 246473 - DNA, 510 bp, Homo sapiens
tgctctgttgccaggctggagtacagtggcatgattttggctcactgcaacctctgcctcccgggttcaagcgagtctcctgcctcagcctcccgagtagctgggactacaggcgcacaccaacatgcccagctaatttttgtatttttagtagagacagggttttaccatgttggacaggatggtctctaactcctgaccttgtgatccacctgccttggcctcccaaagtgctggaattacaggcatcagccaccgcgccccaccagcacacagactcttaactggaagagagtggggaaaagggaattaactttccccttttttattttctccttatttatgaatttatttaataattccacaggctctccaagagcagaatgaaattcagggcagatcctccctttcaaaagctgagggagctacttgtgaaactcccaaatgagtgggagtaaaggaaagtgtgttggaccaagcagcaggtcatggggtcctcatccaggctct

SEQ ID NO: 246474 - DNA, 410 bp, Homo sapiens
atagatgaccatattcttgaaaggggtgagaaagctctccagtgtctctcttataagggcaccaatcccattcacgaggggccctgcactagtgacctaatcacctaccaaagtccccacctcctaatacgtcaccttgggggctaaggtttcagcatacgaattttgtggggaaacaaacattcattgttagcaaggggagtatacaattacctaatacatgctttgagatgctgaggatgtacattttccacaaaagtctgtctttttgtaaatctttagcgtcaatagtcaaacccgcccttcagaatttctaaattcaaagtaggttccactctttttagtcagtctttcctgaagagattttaaaaatgcctaaaatatgatgagaataaataatgccatgttaa

SEQ ID NO: 246475 - DNA, 220 bp, Homo sapiens
tcatcatggttttgaagcctagtacatgaacatccagagtcagaaaacagatacatgtggatgtgactagtcagtttattttaaaaagaatttacaaaaagatttcttcaaatctgttatttttaacctttttggcatttggagtctactaggaatcaaaagagtgctgttgaaataacaatagctaatgtttattaaactcttaccattctaaaccctt

SEQ ID NO: 246476 - DNA, 425 bp, Homo sapiens
cgctctgcagcccagcagaagggcctgagggatggccagggcgggagggaggaacagaagttcaaggttcccagttgtgggcaggagactcagcatcggtccctccagcccccggcagcaggagcccccatgtgtccccgggaatgcggtgtccacgcctccctctttgcatccctgcagcgcccaaagggactgaagctcccagcacaggggaggcgcccagcgtggctgcagaggaagggaacgcaccgcaggtgggaggggcccagctgatttctcagcgtcacagtgaaaggcacccgtgatgagacagctcgctctcggcagtttcaggaccctccttgccctggctgctcatggggaacatttgaaatgcatgtgggggcctccgaattttgaattttaataaatagttgaatcagcgt

SEQ ID NO: 246477 - DNA, 352 bp, Homo sapiens
gggaaggggagagtgggaaggcactggaagaggggactttgcacactgcatgctgcacctaaatgtggccctctgctcacctttctgctcccaggaagtgggagttcaggtggccccaaggtctctttcaaattctcaaccacattccgaggacagaaaatgaatttcatctctatgcactacctgctttgccattcattaaaatgcctgtgattgtgttctcatgttaacatacctgtttcatttcatgctcctttactcccttctcttggttcccttgtacaataaaacagcagcatgaaacaaaacaatgctaagctctccttcactgtgtctctgtggtgtcacattt

SEQ ID NO: 246478 - DNA, 251 bp, Homo sapiens
ttcccaattctacacctcatcaggggactatggaggaattctaatttgtcccctaatcaactcacaaccaattgagcaaatagttaaggtggtcctgaaactactctccagtcccggggacatttggaatgcattcttacttctcttctgaaacccatagacctcatccttcacaagcaaacaaaatgtgtccatgtgcccaaacctttgttttcattcagtaagaaggcaataaagtcccttttctgccc

SEQ ID NO: 246479 - DNA, 552 bp, Homo sapiens
tgcaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattggtgagtggcggtgccttcacccttgtcgccgcctttgatctggtttcacactgaggaatgctgggttgtctgtgtgcttgcataaagaatctccaacagc

SEQ ID NO: 246480 - DNA, 844 bp, Homo sapiens
catggtggctcatgcctgtaatcctagcactttgggaggctgaggcaggtggattgcctgagttcaggagttcaaaatcagcctgggcaacatggtaaaaccccgtctctgcaaaaaaaaaaaaaaaaaaaaaaatacaaaaattagctaggcatggtaagtgcatgcctgtaggcccagctacttgagggggctgaggcaggaggatcactttagccccggaggcaaaagttgcaatgagctgagatggcgccactgcccttcagcctgggggacagagtgagaccctgtttcaaaaaatgtgaggcattacgtttatctgacttaggattgggctgtgttttgtattaacattttttgtagctgtaggtgtgagaactaatatttcctccagtgttcttatttttgtttactttgttgtcttggggttccttagagacttcttaaataagatctgagacatgcagttatatatttttcttttttagttttttaattccttgcaagtattgcacaaatgcagttctttgagtaacgtcctgttgttatacaaaagccttcgtggccaggcatggtggctgacaattgtaatcccagcactttgggagtccaaggcagacagattgctttagcccaagaatttgagatttgtagacaaatggagacatggcgaaccgtctctacagaaaatacaaatattaaccaggcatggtgtcatgcacctgtactcacagctactcaggaggctgaggtaggatcatctgaacccgggaggcagtttgcagtgagccatgatcatgcccctgcactccagcctgggtgacagagcaagaccctgtctcaa

SEQ ID NO: 246481 - DNA, 707 bp, Homo sapiens
attcgcggccgcgtcgacagccccggaggcaaaagttgcaatgagctgagatggcgccactgcccttcagcctgggggacagagtgagaccctgtttcaaaaaaaaaaaaaatgctgggcatgttttactaggtaaaagtaactgagatacataagcctttagtgtgaggcattacgtttatctgacttaggattgggctgtgttttgtattaacattttttgtagctgtaggtgtgagaactaatatttcctccagtgttcttatttttgtttactttgttgtcttggggttccttagagacttcttaaataagatctgagacatgcagttatatatttttcttttttagttttttaattccttgcaagtattgcacaaatgcagttctttgagtaacgtcctgttgttatacaaaagccttcgtggccaggcatggtggctgacaattgtaatcccagcactttgggagtccaaggcagacagattgctttagcccaagaatttgagatttgtagacaaatggagacatggcgaaccgtctctacagaaaatacaaatattaaccaggcatggtgtcatgcacctgtactcacagctactcaggaggctgaggtaggatcatctgaacccgggaggcagtttgcagtgagccatgatcatgcccctgcactccagcctgggtgacagagcaagaccctgtctcaa

SEQ ID NO: 246482 - DNA, 409 bp, Homo sapiens
tgtatggttgtataatttgttgactgcacaaaagagcctggccaaaggggcaagctgaggctgaaacgtagcccctgctctgtttgctccgtaccctggcatgaggctgtgccgcctggaggaagggacacctttttctaatttgacaaagatgccatatgagctctcagaggctctgttaatgctttatgtgtgttaccttctctactcctcaaaacagctctgtgggctagatatgaataccctcattttatagatgaggaaatccaggcttagtgagttcaggtcactgagttaagtcacttggtaagggataaagctaggatttgagcctgatgccaaagcccatgctctaaaccagtaggccactatactggccccatccctaagtgctcaataagtgaaaaaa

SEQ ID NO: 246483 - DNA, 787 bp, Homo sapiens
aatcctgtaagtcatacacatatctctgtctccctctgacagacattgatttagaaaggaaagactagattcaacccccaggaaacagctgttctccttagataaggaaatcattgaactggcttttaatgttgtaagagaaagggagagaaaaaggaaaagagagagatttactacaggagcaaacaacaaaaatccgaactacctagatgacacgacacaatttataattcacagaacataacttaattatcacatttcttgatagctgactttaaaccacaggttatgctttctcccaaagcaaaatggccagccttgccattgatagcaaaacaaaacattctgagaaaactcgggtggcatgaaaaggttaaaagagaacagctgaaatcttgagacctaatgaagctgcaacacctgacaggccactcctgagagcacaggtagcttgaagaacgctaaataccaaggaaaatgtttcatttacctgttaaactagcaagttcacattgaagaatgatttaatacatacacatgcacaagactaccggaattcatgcaaatttcccaaggtattcagtgctggagtactatatgcccaaacttcagaaattttagaaatgaagatagactttaatttggttgccaggaatgttccccctttaagaaatttaaattagattctccttttctctgttgcttcagtcaaagtctctactggaaccttcataatgtcaacattaaaagaaaaatcatatctcagatccttgttctgatactgaaa

SEQ ID NO: 246484 - DNA, 487 bp, Homo sapiens
gagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggccgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaa

SEQ ID NO: 246485 - DNA, 535 bp, Homo sapiens
gtcttggggggcggaggataagcaaacccccaaatcctcagaaatttgaggaattacaaggaaagagtaaccatacacagattgggaaaaaactacaaaagtagaggtgttaatatcctcagagagatgagaagacaccactaagaacaggatgttataaaatagtaacaactggcaaccaataacaagctcttaaaaattaaggaaatttccggctgggggtggtggctcatgcctgtaatcccagcctgttataacttttgtagcacttacttttttttttttttttttttttttttgagacagagtcttgctctttcgccaggctggaatgcagtggtgcgatcttggctcaccgcaacctccgccttacgggttcaaatgattctcctgcctcagcctcctgagtagctgggaccacaggtacgcgccaccacgcccagctaatttttgtattttcagcagagatggggtttcaccatgttggccaggatgatctcaatatcctgacctcgtgattcacctgccgtcagcc

SEQ ID NO: 246486 - DNA, 380 bp, Homo sapiens
gtcttggggggcggaggataagcaaacccccaaatcctcagaaatttgaggaattacaaggaaagagtaaccatacacagattgggaaaaaactacaaaagtagaggtgttaatatcctcagagagatgagaagacaccactaagaacaggatgttataaaatagtaacaactggcaaccaataacaagctcttaaaaattaaggaaatttccggctgggggtggtggctcatgcctgtaatcccagcactttgggaggccaaggcgggcagatcacgaggtcaggagatcaagaccatcctggctaacacaggtgaaaccccatctctagtaaatatacaaaaaattagctgggcgtgtatggtcgggctttgggagtc

SEQ ID NO: 246487 - DNA, 419 bp, Homo sapiens
catggagataggatgtgagccagagaaggcattaaaatttttccaatagaaaaatactaaagagtaaaaaggtaaagagaggccaggcacggtggctcatgcctgtagtcccagcactttgggaggccaaagtcagaggatcgcttgagcccaggagtttgaggccagccctggcaacatagggagacctcatctctacaaaaaaaaattttattttattttatttattttatttcattttatttatttattattatttttttttgagatgaagtcttgctctgttgcccaggctggagtgcagtggtgcagtctcggctcactgcaagctctgcctcccgggttcacgccattctcctgcctcagcctcctgagtagctgggactacaggcgcccgccaccacgcccggctaatggtt

SEQ ID NO: 246488 - DNA, 151 bp, Homo sapiens
gtagagataggctctcactgtgttgcccagactgttctcggactcctggactcgagcagtcttctcacctcagcctctccaagtgctgttagtaggattccaggcatgagccaccatgcctgctctccacctcccttctgtcgtcttctct

SEQ ID NO: 246489 - DNA, 362 bp, Homo sapiens
gggcttcttatggagacttcattggttgtctgtggttgaggcatgggcatcatgtcaaaatgtgattggaaaggccgggtgtggtggctcaggcctgtcatcccagcagtgtgggaggccgaggagggtagatcacttgagggcagaagttcaagaccagcccggccaacatggcgagactctgtctctactaaaaatacaaaaattagctgcgcttggtggcgcgtgcctgtagtcccagctactcaggaagctaaggcaagagggtcgttcgaacccaggaggcggcagaggttgcagtgagctgagattgtgccactgcactccagcccgggcaacagagcaagactccatctcaatta

SEQ ID NO: 246490 - DNA, 383 bp, Homo sapiens
ggcactgtgagcgctctcctgatttttggttcttatgtaggtgctttttttgtgtgttaactctggtccttgtggggagggtggcggagtggggacacaccatcagtggagccttccatttagccatcttgctccacactatccccctcagttcttaccttcaacttcttcagaggcattttatagcttgtcccattgggttcagctggcttaggcgggcacataaggctctttccgatctggcctcaccagacctcttaagggttatttctcaccatctttcctcagcattagccataatacccaatgacccactgtttctcagcggtggcacattccctctcatccaggggcctgaacatatgctatgctttacctggcta

SEQ ID NO: 246491 - DNA, 791 bp, Homo sapiens
cattaacagattattgaccaacaggcaggggaggttaatatgctccaatgaataaagagccatcatatattttataatggagactaacaggttgatgttgctgagaaaataatatggactttgcattcaatgatgtatcttttcacaaccatatctttgataaacacaatttgggttatactggcagggattaagtagtggaaaatctcttagaagaaatgtgcttctactgtcccccttaccaaaatagaacagatgagccctaatcagagctggtaactgtaatggtgattgctctgaggaccaatgtatataaacatcactatttgaatacctagatttgggcaagtaataaggaggaaagttttgaacctgagatacccagattaaagtaggaccttttgagatgggctaaacagttttcaagtcagtagcaccctgactttcagaagaagcagacagaaatcccctcgctagaatccatattgtatgtttccaggattttaacagactaagatcaggcaggtcacaatcatttttcaccaacttgatgaggaggtaggacattatatgtgagaattaggcaaagcaatgaaactgagaatttaaacacttaaggagttacagatattggagttattaaacatagaagatagagtggctgtatgtacttatttaaagaaataaaagatgaaccacaaaagtgagcaagtaatgaaaaactgttgacagtaatcaggaagatctgaacaagaaccacatggaacctctaaaaatgggaaatattgtag

SEQ ID NO: 246492 - DNA, 356 bp, Homo sapiens
atttttttgttgttgttattaacaaattaaatatctaaagacaaaaagattattgaatggcttctgctctggagtaagaaatctgaataaggttcaatttggttaatatagcttcataccttgccctcttaacatcattaattaatttcccaggctgaatgaaggagagatgggctccctccctcttttctgcatggagcacttctactcaaccatttggaccctacagataccctcttcgccctgttcttattcgttatttccctcctcatataaaaagctaaaatgttatctataatttatctagtttaattgtaaagttaagcaagtgggttttaggaataattaataccatg

SEQ ID NO: 246493 - DNA, 319 bp, Homo sapiens
gagtggcaccaacacacccaggcagacgctcacattatgaaacataaatgcagagtgaacaaagagtgttgcaaatcactcagcttggctagctgctgccaaagcaattcagtactcctcatgaagcctgctctgcattccagaaaacaaaaaaaatagaggcctgataagataaccaggtaattaatgaagcaatttccccttcctgctcacatgcctgtatttattttttaatataaattatcatcatcttaagcaataagtacactatcttcctgtaacctttaagaacttagccaaatggagcagaacaaacagt

SEQ ID NO: 246494 - DNA, 746 bp, Homo sapiens
tggagtacagtggcatgatctccgctcattgcaacctccacttctcagttttaagtgatttctgctgtctcagcttcctgagtagctgggattacagatgtgcatcacaaaaaccagctaatttttgaattttttttgtagaggtggggttttgttgtgtggtccagactggtcttgaacatctggccttaagtgatttgcctaccccagcctcccaaagtgctggaactacaggcatgagccaccacacccagccctttctatctttttgatgtggacattagtgctataaatttccctcttttcttggtttccagtgattattttattctatcttggtgagtcatcagggaaataatcttaaatttacaatcaacatatagtttaaatccatataattgtgtgagaagaaccctttgttatttgaaggtgatgtttgaaagattttctaactgtgccttttagttagtcttaaatttctaattgtagttaaaaacatgccattgtcatttctgacattttaagtatatggtttagaagtggttagtatagttctattgttttgcagtaggttttagataatttgtgtcttacaaaagtaaaagtgaatactcattacttatgaaagaagttagttagcttgcttcttaaactttcactccaacctcacctttgtgttcacgctccttaatctccttagaggtagaacaaagaactctggatgttatctcagactacgagagact

SEQ ID NO: 246495 - DNA, 1785 bp, Homo sapiens
tggagtacagtggcatgatctccgctcattgcaacctccacttctcagttttaagtgatttctgctgtctcagcttcctgagtagctgggattacagatgtgcatcacaaaaaccagctaatttttgaattttttttgtagaggtggggttttgttgtgtggtccagactggtcttgaacatctggccttaagtgatttgcctaccccagcctcccaaagtgctggaactacaggcatgagccaccacacccagccctttctatctttttgatgtggacattagtgctataaatttccctcttttcttggtttccagtgattattttattctatcttggtgagtcatcagggaaataatcttaaatttacaatcaacatatagtttaaatccatataattgtgtgagaagaaccctttgttatttgaaggtgatgtttgaaagattttctaactgtgccttttagttagtcttaaatttctaattgtagttaaaaacatgccattgtcatttctgacattttaagtatatggtttagaagtggttagtatagttctattgttttgcagtaggttttagataatttgtgtcttacaaaagtaaaagtgaatactcattacttatgaaagaagttagttagcttgccttaggtagatagcaagagaagagtccctggaaagtccctggtcagtgcctcatccctgcataacatataaagaagcctggaaaaaatcaagctgcagacactaacaagggaactagcatatgttgttgtgcttgggagacatgcccgtggctgcacagatagaaaaacctctggcccatttggataaaaacttgtagaaacctccagctcactcagataaaggaacaagaacgacctagcatagaaatgcctttgtttggccaggcacggtggatcatgcctgtaattccaacaatgtcggaggcagctgtgggcggatcatctgaggtcgggagtttgagaccagcatgaccaagatggacaaactctgtctttactaaaaatacaaaactagccaggcatggtgctgcatgcctataatcccagctacttgggaggctgaggcaggagaatcgctagaacccaggaggcggaggtttctgtgagccgagatcgcaccattgcactccaggctgggcaacaagagcaaaactgcaaaaaaaaataaaaataaataaaaaaagaaagtacatctcaaaaaaaagaaagacaagaaaaagaaaaaaaagaagcacttttgtctttgtacagtcagtgggctcccaggaaaatgttccttctctttttgttggcatgggcactgtgggatctggtgcattccggtcgacactctcgtttatttggactgtaagtctgacctctatgaataattacttcagcccctgagtgctcccgggccaagctccttggccaaactttcaccttagcttctgataagtcttgggccaagctaagcagcatctatcaatcatcccttcagctcctgattgatcccgggccaaaggcctgggccaagctgagccacacgtttttcaagacagcctgtgaactaggcacgtatccttcccttcccagtccataaaaaccctggacccagcctcgtagagggcaccactttcagacacctatctctgctggcaaagagctttcttctcttgcttcttaaactttcactccaacctcacctttgtgttcacgctccttaatctccttagaggtagaacaaagaactctggatgttatctcagactacgagagact

SEQ ID NO: 246496 - DNA, 694 bp, Homo sapiens
aatgctaagtccaaagtggttaagtgacctgcccaagctctacaatgccctcctgaactcggatgtcttcatttcctgtgccagactcttaaaaaaaataaaaataaataaaaaaagaaagtacatctcaaaaaaaagaaagacaagaaaaagaaaaaaaagaagcacttttgtctttgtacagtcagtgggctcccaggaaaatgttccttctctttttgttggcatgggcactgtgggatctggtgcattccggtcgacactctcgtttatttggactgtaagtctgacctctatgaataattacttcagcccctgagtgctcccgggccaagctccttggccaaactttcaccttagcttctgataagtcttgggccaagctaagcagcatctatcaatcatcccttcagctcctgattgatcccgggccaaaggcctgggccaagctgagccacacgtttttcaagacagcctgtgaactaggcacgtatccttcccttcccagtccataaaaaccctggacccagcctcgtagagggcaccactttcagacacctatctctgctggcaaagagctttcttctcttgcttcttaaactttcactccaacctcacctttgtgttcacgctccttaatctccttagaggtagaacaaagaactctggatgttatctcagactacgagagact

SEQ ID NO: 246497 - DNA, 1023 bp, Homo sapiens
cgcatattctgcacctctctctccttgggggttgatgaagctgttcccgtccacgtatagctcccagtctattgatgcccaaggctggtcctggaggttaggtctgctagagtaaatttgagtccaacacctctacacagttatgctcgacagggctttagctgccgggagcaaggtggtgggttcagggtgtttccagtttagtagatcaatggttgaaaagggctgatagatgaaagtctgttgtcccccccaaccccccggatgtgggcctggtcattataatagacaggtcctcgtgtctccctgagaggcatttgcatagcctctcagatctgagatggcccacttgactatcctgatttccttccttggtctctcgaagctccgatcctccccttcaaggtaaaacctggagcgtgttagctcctgaatctcatttctgagggggttgttggcctcagtaaagcggggtaggctgggatatatggagaaagaatttctgttatctctggcggctcccgcaaaactggcttctcttgctgtttctgggactccctttttaactctgtctgccggcgaagctgctcttttacttttggctttttcgcaataagctgttcaacagggctaaatttatgctggttttgcctatattatatttaaccatgagtcaatataaaggaatttgatctaggtacactggctgccctctgacccctgtcaccaccttaaatacatggccaatagttccctgtctatagttccttcggtgggccatctaacaccaaaagagggcaattctaattcacacagagttcttaacctctagggggttaacttaactctataatctcccacagaacctttcctaaggttctgtaacatgcattttaatagagtaagttttgatgctttgatgactttccttttatttttctttttgaaattttttaacatagttcctagcggagtgggcttactttgtgtctgacctatttttctcttgaaacaaaaaaaatt

SEQ ID NO: 246498 - DNA, 465 bp, Homo sapiens
agccatgcctgtgggcctgaggaactgttaccatccactggaccaagggagcagggagaggatgatgggccggtgtggagagggcctctgactgctgctgtggccacaccatggaaatatggcagagagggagtcagagtgacagggttctggccatccactctctcttttcagtctcttgcttgtgcctccccctgatcacgcccaaccagagccagaggtcctggagaccatcagtgtagtccgtatgggtcagtcccctgggaggactgtgctggatacagaaggtgggaaatggatgtggagggcaggcagagcatttagcaaggagaaattgctgaatggagaatataaaggggatgggaggagaatgaatgatccatgtaaagtcagaaggaagggccttttgcctggtagtgtgctccactgcttaccttccttagggatgaagccatttactgagaa

SEQ ID NO: 246499 - DNA, 237 bp, Homo sapiens
agaggcctctttgaaagcctctgcttgcattaagattcccaactaatgactttaagtctgtctgaaaacttgaaatacctaactgacagaggataaaacttagatccacaacttgactcgacagataccagtctttccgtcattgtcccacataccagcaagcgatctggagcagataaaacgtagaattgaacattttcctcaaattaaagtaaaaatatggcttaccttctcacc

SEQ ID NO: 246500 - DNA, 400 bp, Homo sapiens
atgtttgggaaggatactggtgcaataggcttcctaccatcaccatgcagctagtcttacccattccagctctggtctctgtaacatggggaaagatacccagtttagaccagtatctgtcaagttcactgttaggtctttaggcaagaagtgtcccctttacacttcagtcacctattaaagcaattatttgcatctctcttgctccgcagactgagtttcttaagagcagggcctgtggttttttcagagttgtctccagtggaaaggagtgaagttatagaacactttagtgcacacaaatgtcctaaacttttaagattttaaaaatttaaaaaagatattctccaaaagcaccctgggtagggagcatgttaggcaactgtgctacgatattatc

SEQ ID NO: 246501 - DNA, 457 bp, Homo sapiens
ccggaagataatgccatgtgaaaatgtcgtgaggtgcccattctcactgacagttggcattctgatgttcagtaatcattgcttttctgtagtcaggtggaaagcagaggaaaaaataagtagtgcttgtagaactttttaaaaactgacctagggtaccagctggaagggaataggcatgcagcattttcaggaaaagaagaagaaggactatcagcgctccaactaaaattattagtggatgaccacagataaactctgctgaagaatagaagaagctcccaaacggcaaaggtgtttgtctggtttgttcattgatgtgtacgtggagcttaggacaatacaggcgctcgatggatatttgttccgtgaatgaaattgtcgtttaaacagccaagttgtagaattaaagttattcatgaatcacataaaattattaaatgtgtgaaaaaattca

SEQ ID NO: 246502 - DNA, 404 bp, Homo sapiens
taaaatgtgtgtaacatggaatactttttttaaaaaatggcagcatttagaatacagacctatttagcaataagcactttacttttacttttcaaagataaactaatgtcaagcctatggaattagttgattaatctgtttagtagtcttgtttcaacaggtatcccaacacagactcatccattttcctcccaatagttaaggaaacatatataaagtttagttctgttctcaatctacctctcttctctcatgtattcttgaaatatcaaatgtattgattaggctgggtgcggtggctcacacctgtaatcccagcactttgggaggctgacgcaggcggatcacctgggtcgggagttcgaaaccagcctaaccaacatggagaaacctcatctctacca

SEQ ID NO: 246503 - DNA, 496 bp, Homo sapiens
caggcgcccctaccccagcctcgctgtggccttaccgtttgatctcagactgctgtgctagcagtgagtgaggctttgtgggcataggaccctccgagccaggtgcaggatgtaatctcctggtgtgcggtttgttaagcccgttggccctttctttgactaggaaagggaattccctgaccccttgcgcttcccaggtgaggcgatgcctcgccctgcttttgctcacacacggtgcgctgcacccactgtccggcattccccagtgagatgtacccggtacctcagttggaaatgcagaaatcacccgtcttctacgtcactcacagtgggagctgtaggctggagccgttcctatttggccatcttggctccaaccccaactccttacattttattatggaacatttcaaacatgtagaaagatagctgaatgagacagtgagtatgcttctaatagaatgtacctgtcacccagcttcagcagttaccagct

SEQ ID NO: 246504 - DNA, 159 bp, Homo sapiens
tcctcacatacaaaaaaatagcaaggtaccttaaaaaacatctcatgtatacgtttacagattaatacacatataccaggaaaaaataaaagctgtaatgttccaaagcatcggtgattaaggaccaatgagaaactaagataaagcaattctgaactt

SEQ ID NO: 246505 - DNA, 1332 bp, Homo sapiens
tgagacagagtcttgctctatcacccaggctggagtgcagtggcgcgatctcagctcactgtaagctccgcctcccgggttcaagcaattctcctgcctcagcctcctgagtagctgggactacaggcatgcgccactacgcctggctaatttttgtatttttagtagagacggggtttcaccatgttggccaggatggtcttgatctcttgaccttgtgatccgcccacctcagcctcccaaaggcgcaggctcagatgtgcttatttctttcaactttttttttttaaatggggaagagcagagttcatttgggaatgcttatacatagggattggattgttcatattagtagtaaaaaatgtaggccttattctctacattaccaaatttttaaaatattactatatggtaatcaatgccaggtacagatttgttggttccccaaactgaattgatatcagtatcacagtggagtcttttgaaaattaaagtccaggattaaattatatgttgtcaccattcaccaccactaccaccctcccccaccaatctctcccaccggttaaactcgtcttctaatcctgtagaatcacatgaactaaatgaagaagtaagaacttgaaggctcagactgacactgttacaaactagcatcttcagatgcatggtatttactttaaatgtgcttatatacagtgtagagaagctcttgtataagaagacatctatgctagctaacttagtagtagtagagggaacatattcagtgagctgcctttatatctgtagtgtcggagacttgttactggttcatttgtggttatcagttgaaggttctgttcctgagatgtgcaatagtagtgttgaaaggtattgtttaatagtgatggggaacagacatattggacttttttttccatattaaattatttagtttgcatgcctgtttgaaattggacctctcagcagcactttgaaatagttttaattaggttaacattttgtacattaaataagtagatatagatggttgatttaactagatgtgttaaattttgaaagcacaaaggtattttatctttttgaattaaaggagaaaagccattgatttgttttcacagacagtatttttaataattaactgtctcagcacagaggtaccttggaaccaagggcaccattgaaactcagttgaagcaacttcctagtaaaccattttagtgagtcctttttgcataaatctatagcctctcagaggtgtgaggctgtcacagattggtgatctgctatctctttgagatcaactaatttggagaagtgtgtgtgtgc

SEQ ID NO: 246506 - DNA, 1252 bp, Homo sapiens
tgagacagagtcttgctctatcacccaggctggagtgcagtggcgcgatctcagctcactgtaagctccgcctcccgggttcaagcaattctcctgcctcagcctcctgagtagctgggactacaggcatgcgccactacgcctggctaatttttgtatttttagtagagacggggtttcaccatgttggccaggatggtcttgatctcttgaccttgtgatccgcccacctcagcctcccaaaggcgcaggctcagatgtgcttatttctttcaactttttttttttaaatggggaagagcagagttcatttgggaatgcttatacatagggattggattgttcatattagtagtaaaaaatgtaggccttattctctacattaccaaatttttaaaatattactatatggtaatcaatgccaggtacagatttgttggttccccaaactgaattgatatcagtatcacagtggagtcttttgaaaattaaagtccaggattaaattatatgttgtcaccattcaccaccactaccaccctcccccaccaatctctcccaccggttaaactcgtcttctaatcctgtagaatcacatgaactaaatgaagaagtaagaacttgaaggctcagactgacactgttacaaactagcatcttcagatgcatggtatttactttaaatgtgcttatatacagtgtagagaagctcttgtataagaagacatctatgctagctaacttagtagtagtagagggaacatattcagtgagctgcctttatatctgtagtgtcggagacttgttactggttcatttgtggttatcagttgaaggttctgttcctgagatgtgcaatagtagtgttgaaaggtattgtttaatagtgatggggaacagacatattggacttttttttccatattaaattatttagtttgcatgcctgtttgaaattgagagctcatgaatatagatggttgagtgtatcagtcttcaaagcatttaaaacatacttttgtttttgttttatcagtgcaatttgtttttgaagacgccggaaaactatttcatttaacctgagcaattaaaacgtgtcaaatcacagctgtcacagttaggtttgataaaattaattgttagcatccttattactgggccagctgtgatatttctggatttgactatgcactggctgcaggaaaacatgataaaatgtcaattttagatctctaactaaagaccgttagac

SEQ ID NO: 246507 - DNA, 605 bp, Homo sapiens
ttaggccagtgtggtggcatgcgcctgtagtcccagctactttgagaggctgatgtgggattatcacttgagcccaggtgttcaaggctatagtgaactatgatcacaccactgcactccagcctaggtgacagagcaagaccctatctcaaaaaaaagaaaaaggactatgacagcaaggcaaaggaaacatctaactgcttaggggagttacctacggttttaaaaaggaggtaataaggagaagagaggagagcatgcacaaaatatgagcaaatagaacccatcaaacttgagaaactgaaagtagttccattgaatccacaagaatggtgggaaacaaaattcgacatgtaggataggatcaaatcataaaaaatcttaacacagcagaactatcccaacatttcagtggctctcaaaggaaggccctgaaaagctggtggctgagcaaagcttaaggagacaactaatagaggagaaagatatggttctgctaacagcacttcagaatatttgaagctttattccaagtagctaattaaccactgccaaaataaagtaactgggacaatctttccttacttttataactagcccttatt

SEQ ID NO: 246508 - DNA, 382 bp, Homo sapiens
tagccccttctcagggcaggtctggttctggtcctcggggctcccacagaagtaaaagttgagcccctttcaagagtcactgtcagggggttggggacaatggctcacactcagcattttgggaggctgaagtgatggagttgcttgggcttagaagctcgagaccagcctgggcaacatagtgagacccccatctctacaaaaaaatatacaagtagctgggcatggtgattcctgcctgtagtgccaactattctggaggcttaggtgggaggatcacttgagcctgggaggttgaggctgcagtaatcatgccagtaatcatgcactccagcctaggggccaaagattgagaaacagcctggctcaaaaaaaaaaaaaa

SEQ ID NO: 246509 - DNA, 944 bp, Homo sapiens
tctccctctcgcccaggctggagtgcagtggcgcgatctcggctcactgcaagctccgcctcccaggttcacgccattctcctgcctcggcctcccaagtagctgggattacaggcacccgctaccatgcccggctaatttttttgtatttttagtagagacggggtttcaccatgttagccaggatggtctcgatctcctgacctcgtgatccgcccgcctcggcctcccaaagtgctgggattacaggcgtgagccaccgtgcccagcaaaacctgctattttcatttactgtatatattctttgaaaatctgaacctggatattaagtaaagggtaaatttcataaaaggcttaaagtgaatctataggaaacctagaggctatatatcttgatatatttaagtattacaagaagtctttgcttatactttcaaaattaacaaactatcaacaggatctactatgtgtgttcaggcatgtaaagtgctcttttttcttcagagggagggacctctgatgctcctcctggagcatccttgatgaagcatgcagaaaaagtaacagtgcatttccaactaactggtctggaaaggtggtcaatatatcatttaaaatagacatttcaaactgtatctatctaattgccctattatggtaaagcccaaagcacatcacagttgtactttatgagaatatcagaatctctcattccaggaaactaccttagtcttttattttagaacattactctttaaaaacaaacaagattaagtttttgtaaaaattaaaatctgactagagcttataataatttggaaggtcacggaaattctagatatatatgtttagtaaatggacttctgcttgtctaaaaataaatggaagtgcactgtatcttttccaaatgaatgggtacataattggcgggcaacctactcacc

SEQ ID NO: 246510 - DNA, 257 bp, Homo sapiens
tatttcagctttaaaactcaaattttgtgtacattttatagtatagaaattagaattataaaatgtattcacatatgcacatcattgagcttcaacagttatcgacttagggccaatcttatttcatctatatttcactcgctacaacttgcccactccttattttggagctattcacagtcactgtatcatttcatctgtaaacattttagatgatagaaccttaaatgatggaaccagtttctagaggtttgatt

SEQ ID NO: 246511 - DNA, 145 bp, Homo sapiens
agacttcctggaagaggctggatttaaggatggattttaatgaaatgttacttttggattgatcaagaggaaaggaaagagcatttgcatatcaggttcagaaatatacatcagaacataaattaaaaggaaataaaacacacta

SEQ ID NO: 246512 - DNA, 431 bp, Homo sapiens
aggctaaccaacttgcccaaggttatacaatatgtaacgggcagaaatagaattcaaacccaggtggtccagttacagagttttaatttttaaatatctaattccttttcaattctttctttttaaatgaagctaaggaggaggtctcagtttgttgttactgtttcttttatgtttttctagtacttgcttctctcccattttgacaaagacatagtatacctcaggtctagaaacaagatgtgattcttggtaaagttcctgtactgtacatgaagtggtatatcacctgaaggaagaccatggtaagttaaagttaaatactataaatcctaacacaatcctgtgaaacaatgagttgtagctaagaagccaacaaaggagataaaatggaattagaaactatacttacttattcagaagaaagcata

SEQ ID NO: 246513 - DNA, 386 bp, Homo sapiens
ggcacaaaagaatgctttctgagcatgcctccagctgaatgcaagtggacagtaacctttggaatttgctgcctgctgacaaaacttttaaattaatcctggctctggaaagtggaagtcctcagagtcctcattacttcatgctacaaaaatacaaatgcccacagaaccagaaatgagcaaagaggcagtttggcagtgagaaggacatgggtgtggaggtgaatataagtaagtagctaatatcatctcaccagtgggagcccagtatgtttggaagccggaacacccacgtgctcagatctcttcttgggatacaggggcagatgtgcacaccagaatgacggaagcttcctttagcctttgagaggagcttggtctccagg

SEQ ID NO: 246514 - DNA, 345 bp, Homo sapiens
ggtggtgatatggaagacagtgtctggcccaaagtggggagtgttagaaactttgtggggagtgagcttcgtccacttttgggaatttggcagcagagaagctgctgtggtcagcccaggtgtgttacactgagagagagggctcagcaaactggagatcgcagactcctgctctctcaggggatagtgcagagggcccctgaaaatgtgcactagggccaggcacagtggttccgcctataatcccagcatgttgagaggccaagtcaagaggatcacttaagtccaggagttcaagaccagcctaggcgatataggcaagcctcctcatctctactaaaaagt

SEQ ID NO: 246515 - DNA, 453 bp, Homo sapiens
atccatattttttccttggaaataattattttcattttgctggaccacgttttagagagcctcacttctgttgatttgattctgagcaatgtttctgagctggactgaccacagagtaagatcttaccttattcatggctgtgaatcatattgagccatttgtcttagctgtcatgcaatttgctaattaggtcattctaggggttgagggaaatgaaagactttgaaataatcattaccttctcagaacaaagcagcagcagttaaatgcttttgcccagtcattttactctgatgttcaataaattcagaagtggaaggtaagttgggatcttactgttgcataattatgctttccagtttatctgaagattgtgcagaagatatttaaatcagtgtcttacacagttataagttgtatatttctgtttttcttattacattttttatcat

SEQ ID NO: 246516 - DNA, 330 bp, Homo sapiens
aagcaattatatagcatacaagcaagtaacttacaaagacatagagatctataaaatatacataactataaaattcatgtaacagcattacaacatataatttaatattttaacattttcaaaaggtcttttagaattacaaagactattaagcataggatttcaaaagtcagttgtgttgtggatgtttgaaatgtcacttctcttaaatgctcttttattaagtttaacactaaataacagattttactataccaaaatcaaagaagaatgcaggcagtcaggcaaatccaaaagcagaatgatttactgtgtcaccaattctaacaa

SEQ ID NO: 246517 - DNA, 334 bp, Homo sapiens
tgcttcaaatcctttggattctgttactacacttcatcctgatatcaaaactaataatatgagtattggttcaccttatccaggctttgcaggagagtccaagtggaatcttagtggaaacttcgtttcccaagtagaaacttagtttctgacacgtcaccactactctcttttgaatccagcaactgcatatttttgcgaccagcaaagtctgagacaggcccattattttccccttgaaacagccaggctgcagccttcctccaatgcagggaaacacagtgatgaatagaacataattattggtgttcattataagaggcagcccaaacta

SEQ ID NO: 246518 - DNA, 621 bp, Homo sapiens
atgtggatcacacttcccttaaggacaaccagtaaatccatataaaaatatgaaatcagctggaaggcattagaactgtcaaggtagtacagaatactagaacaagatccaagaaatgatctaagtccagtgaggtgaaccaaagcatctagtgggctttcactttcagattatttgcttatctggaagaggcagctgagggtactgaatggcatttttgatagcctcataggactagagagaagaaagttggaatcagagactaagggttgggaccttggtactttgaattatacccaaaatcaactacattctaggaataaaggtgaacttgtagtaaaccagcccttccacagactgtagcccaactgcaagtcatctggttgacccagaaaaatctcaatacctaaaactggtttgtgatgaccaacaattattggagctcccagatagctggcagaagcaaacaatgattctctctagaagaggagtaccttcggccgggcacggtggctcatgcctataatcccagcactttgggaggctgaggcgggcagatcacgaggtcaggagatcgagaccatcctggctaacacggtgagaccctgtctctacccaaaa

SEQ ID NO: 246519 - DNA, 450 bp, Homo sapiens
taaacctcttctctttgtgaattacccagcctcatgtatgtggtttttttttttatagcaacacaaatgaaccaagacacagagggcacaatcatgacagaaattcttgttccgctctctgttttaatttagaggttgataatatccagtattggtgagcatacgagaaaacaggcatccttaccttgtgtgtgggaatgtggattaagggtttttggaaggaagtgggcagccttttcattttaaatggacattctttttgggccagcgtctcacttttagatgtctgatctacataagtatttgcatacatgcttagatatgctaaggttttccctgtagtattttcaaaggcatttttgcagggtaatttaaaaaatcgtggtaaagaaaaacaaaatttaccgtcttaagcatttctaagtgtacagttagcattgttgaatagca

SEQ ID NO: 246520 - DNA, 451 bp, Homo sapiens
ggccatatttttcaaaaagaaggtcactacagggacagctgcttttagtgatgcaagccagagttttgactatttggcagaatgcttcttaagggccattattctatctgttgtttctcatgtgtcgatttggtgattctgcaaatctcaactttcagctctctaaagtctaatgggccttgtaacttgtcattttccctgcatggattgtctactgaggcaagatgtttggcgagaagtaaaagactttctaatggtcccataagactggagccaaaaagtatttgttgctaactctctcttgacaaaagtcagttcttagtccatctgttcaccatttgttaatttgcattggcttgaaacctgtttacaggtgacatgctattgtgaggacacttagaaactattttaggcattagggcaatcaacagactgttctcatgccaaaaaa

SEQ ID NO: 246521 - DNA, 810 bp, Homo sapiens
acatttacagagtcaaagtaaagggatggaaaaagatattccatacagatggaaaccaaaagcaaataggagtagctatacttatatcagataaaacagatattaaatcaacaatagttaaaaaaagacaaagaaggtcattatattatcataaaaggatcaattgcagaagaaaaatgtcatttctaaatatatatgcatcgaataccacagcaccaagattcataaaacaaatacaactagacctaagaaaagagaaagacagcaatgcaatcatagtaggggacttcagtactctactgacagcactagacagatcattaaggcagaaaatcaacaaagaaactctaggcttaaattggactctagaccaaatggacctaacagacatttacagaacattctaccatacacctgtagaatattcattcttctcatctgcccatggaacattcttaaatgaccatatgcaaggccacaaggcaagtctcaaaaaaattttaaaaattgaaataatgtaaagtaccttcttggaccaaagtggaataaaactagaaatcaataacaaaaggcaccctcaaagccatacaaatgcatggaaattaaataatctgctcctgaatgattgttggatcaatgatgaaattaaggtggaaattttttaaagttttgaaacagatgaaaatagacacaacataccaaaagcatttgacgtacagcaaaaacagtgctaagaggcaattttatagtgttaacagcctacataaaaaagatagaaagatctcaaattaacaatgtaacattgtacct

SEQ ID NO: 246522 - DNA, 583 bp, Homo sapiens
acctgtatttgttattgcttctcaagaagtgaggcagtgagtctatcagttgaattttctaatggggtaaaagttactgtaaagggtattaaattaggtttgcctatgctgctagttaagtctcaacactaagagcatcctgcttctgaattacctagcacttatgtaactcaggagtagttcttgtattctttgggactagaaataaagatgagttttagactttgttatgccagctgtgcagtaaagggatctaccaaaagactccaagtagaatgtttaacttccggatcagtggagggggaaaatagaagaaaacttagttgattgaaaaggagaaaaaagaactttggaaattcaaattaaatagaaacatagacaataaggtagttgtaataaattcagatacatcaattatcacaagaaatgagcttaagctcattataatcatacatagatcagatttttaaaaatctagctatatgctatgtataagagacactaaacataatgacaaaaatgttgaaagtaaaagaaatctacagagggtgggaatgatggaaaacaaattttttaattttta

SEQ ID NO: 246523 - DNA, 492 bp, Homo sapiens
aacagatttcttcactgtttccgtgcttcccacttagcaccaaccagagaaagctgaatacactccctggccagttccataggatgttccgattccagctactcgcctccagtgtccccagacagcagcctccggcagggctcacctgggaccttccgttttctcatcataaatccccagacccctgcctttgagtctctgctggacacacaccctggagccctgcctttgagcctctgctggacacacaccccggacccctgccgttgagcctgtgctgaacactcgcagtggtgaccgacgcccccaccacagcaagccccgaatacacagcctctgtgtgttcccactgagttggtctttgtttattttcacacttaaattacacactataaaaaaaccacagttgttaatattgccacccatctcaccaaaaaagcctctatatattgtaaaactgtcaagctcaaggtgatgaataaaagtgaccca

SEQ ID NO: 246524 - DNA, 397 bp, Homo sapiens
tgcagtccccatccctgtatactctccctgaccaggcttctccacagctgccaaacttctggatgaagaccacctgggctcctttagaatgtctatgctgctccgtggcctgatccatgtcagtttttggccaccttgctcctcaaggtcttgctctgctccttcttggcatgaaccattgtcctactaaaggaagtcccactttctccccatgacttgcaacaccagcagacaacgttatccttcagaaatttttatttctggctttttattattctccttgaccattactccctcactcattcagtttttattgtatgcctcccataaggcagtccctatgccagatgatgggacataacagttctaaaaataaataaaatcctagcagactaca

SEQ ID NO: 246525 - DNA, 478 bp, Homo sapiens
agagttagtgcattttatgtgtggcccaagataatttttcttcttccaatgtgactcaggaaagccaaaagattggacactcttgcattattatttagattttttggtcaagtggttgtgtatttatctctgctaaatattataaggtgtcaagattttgcatgatgcttataaagttataaatgcagctgaaaaggaaattatctttgtgcaattttttgataaataaggcatttaatattgttggattaatgaaaacagctaaatcctgagttgtttgcaaaacacacacacatacacacatttatttaactttaaggttcttacttaggtataaacacctgaaattcacaggttataaaaatgtttaacagggaaataacttcaaatgatgactatcacaattttcataagtaatctacgtaaactactaaaaaattaattaggcaaatgtaatggaataaatgcttgtaaataa

SEQ ID NO: 246526 - DNA, 717 bp, Homo sapiens
gagggtggggggcggtggggggttggccctaaggaagaactgaggacggaagtagctttgctcccaggcaagagctgaagttcccgacccctgggaggagagggccaggaccctaggcttggagctggagctggggtaacttccagggggagataaagacacagctacccgaatggggaagccctggctactcacagctgttaaaggagggggggcagagaaacgtttccccaagagcctgagcccagggaggtggcagctctgccaggggcccaatgttggcggctcctgtcccccacagcctccaggacgcccctccgtcctctgcagcaccttcgtttacaggtcgtcttttctattttacacctgcatgtcctttgcatttcagattctttagattggatgcatggtcacgctgggaccgagaagagccactcgacagtgtattccccttttagcaataaagtaacaccatttccttctcacaggctgcctcctagcccccaacccacctatgacatccactcgtctccagtcctgccctcccacccccaaaaactgggtccactgctaatttgtcaaaaaggtaattgtttaaaaaaaaaaaaaatcccaaacagaaacagatgggaatcctgtcctgaaatgtctgaacacctgactgttgacacttgaacatttttatattataaataaaatcagaaataactcctgttt

SEQ ID NO: 246527 - DNA, 577 bp, Homo sapiens
gagggtggggggcggtggggggttggccctaaggaagaactgaggacggaagtagctttgctcccaggcaagagctgaagttcccgacccctgggaggagagggccaggaccctaggcttggagctggagctggggtaacttccagggggagataaagacacagctacccgaatggggaagccctggctactcacaggtttacaggtcgtcttttctattttacacctgcatgtcctttgcatttcagattctttagattggatgcatggtcacgctgggaccgagaagagccactcgacagtgtattccccttttagcaataaagtaacaccatttccttctcacaggctgcctcctagcccccaacccacctatgacatccactcgtctccagtcctgccctcccacccccaaaaactgggtccactgctaatttgtcaaaaaggtaattgtttaaaaaaaaaaaaaatcccaaacagaaacagatgggaatcctgtcctgaaatgtctgaacacctgactgttgacacttgaacatttttatattataaataaaatcagaaataactcctgttt

SEQ ID NO: 246528 - DNA, 526 bp, Homo sapiens
gagggtggggggcggtggggggttggccctaaggaagaactgaggacggaagtagctttgctcccaggcaagagctgaagttcccgacccctgggaggagagggccaggaccctaggcttggagctggagctggggtaacttccaggtttacaggtcgtcttttctattttacacctgcatgtcctttgcatttcagattctttagattggatgcatggtcacgctgggaccgagaagagccactcgacagtgtattccccttttagcaataaagtaacaccatttccttctcacaggctgcctcctagcccccaacccacctatgacatccactcgtctccagtcctgccctcccacccccaaaaactgggtccactgctaatttgtcaaaaaggtaattgtttaaaaaaaaaaaaaatcccaaacagaaacagatgggaatcctgtcctgaaatgtctgaacacctgactgttgacacttgaacatttttatattataaataaaatcagaaataactcctgttt

SEQ ID NO: 246529 - DNA, 322 bp, Homo sapiens
aaatcttgtcaaaccaggaggctaaatagcttcacaaatgtaaaacacaccaggccatttcctctaaacagaccttaaagggttaggccacgtgggtcacccttgtccaaatgagagccgacctgggggcctctcacttgtacagatgtggtacttattattccattgcagtagctttgcttcaggttgtagtgaataatgatatcgttttgcataattccaaattagagtgtgtgtgtgtgtgcctgtgttcatgttccaaacatttccaattacacttgtctgttaaacacttgaaagaaaaaatcaagagacaattcta

SEQ ID NO: 246530 - DNA, 410 bp, Homo sapiens
ttttttttgcgacagaatctcactctgtcccccaggctggagtgcaattgtgcaatcttggttcacggcaacctctgccccctgggttcaagagattctcctgcctcagcctccccggtagctgggattgtaggcacacaccaccacgccctgaataggctttatcctgctatcttccactaaacaaaaaaagaaaaacaatccttttcccttgtttcatcttctaacattgatttgaactaaaggaggataaagaactcaagaaaatgtaagtggcattttatcagtgataatctcaggcaggagcaatagaaaaacacaatcagacaaaggttcttttgtggacattcaagagcaagaaggagagggaactatggccagctgttctgggggtggagggtggagaggga

SEQ ID NO: 246531 - DNA, 477 bp, Homo sapiens
gtcatggccccttgaagattctttgaggaagtggctgttgagctcccaaccccagggctggagcaggaggatcagacaccccggcctcagccccagagcatgaaagccctccccactcacccagctgctctgcagacccacacttgcacacaactccatgtgccactgaccagctctgacctcgtcctgggcaaggctggcggggcctagacccaaacccacaacagtgtgtggctcccagggaggcagcgtttcctgggcaccagctctttagagaatgccttcagaagtccccatccagcctctcccctcatgaaatcctgtccttgaatcatccagcctagccccctgagtagctgtgcatttccgagaccccgaatccataatattcatatgaatgaggtggagggcagggagaatcgctgccatttattcaacccttaataaatgctgggggctgcacaaagcaaaaataaa

SEQ ID NO: 246532 - DNA, 673 bp, Homo sapiens
caaataccaaactaaatttattttgctaagagaaattgatgaactaaaagagaaataagtacagtctaaatttttagatatatggggaaaaaccctgagattactaattgtgtatcacagtcctcttatgtatatcctgaaaatgatggtatcaatataatacgtacagtggatttacattttaaacttgatctattacttttgaatatttgtcttacactgaaaataaattctgacatcttcaggaaaccaatatgaataagctaaatattgacttaaaatagttaaaccccttaataacttccttcaaataatttctattatttcactgcttaagttcagcatttgaataacaaaggtaacataagtacttaagatctcaaaggcccattacattctattaataatgacaaaacaacatatttactgaaaatagtcttttttctttgccttccagttttacactttttaaaaaacacaaaattggacaagatcaaataactaggtggtaaaacactgactttaaaaaattacatctttaaacccatgagaatcataattctaagtatggccattgggggcaacttataaacctttgaccctttcttaacactatgtgactgatttttcacaaagtggttaacagactctgaggctccaaacatgtaaacaa

SEQ ID NO: 246533 - DNA, 588 bp, Homo sapiens
gatgtggctgagagaaaaatatttgtgctgtctgtcctaatcttcatttccttgtagttgtaaaatgtttcatttgttttattccagtattataagttgtgcccatgccttgtcaagactataaaatttttgatatcagggagccttgtttatctttgtattcttatcttgccacccccttcattgtcaacttgtctgccagattggtaccttgctcatagtaagtcagtgtctgttgtatgttgatccgtttgtcctttgaccatccagatctcaacctgactgactgtatgggtggtagagtagcttaaacaaaggcatgccacaaacagctaaatatggatacagaatccaagagcatcaaatgcagaacatttttcagatatttatagcctcaaagcaaagtcaattggctgaaaaagctcagcagcatagcgaaaggaaacgggagtggcaaagccagcctcactgtctgtgctttctggtaaacaatgagaacattaaaattaaatactttaccatgaatggatggggagtgtaggacactctgggagaaatttaagatcccaatctctaggattgcctgcg

SEQ ID NO: 246534 - DNA, 354 bp, Homo sapiens
ttctttaatgagtcaaattagattagacagatacctaaaaggcgttcaggaaagcattcgttgatacataaaatgtagattgattgagattaagtatagatcaacaccccttctccacaaagatcaacataaataaaaattccatataccaagaaagacagccaaatccttcggaggtttgcgtatttcaaactgtaattagtaacacaaaattcctggatgtttacatgttataagattatgatatatgaactctggagccaggctgacctggtataacagcaacattatttgctagttgggtgattcagctgcttatttcatgcacctaaacctgagtctcctcatttgtaa

SEQ ID NO: 246535 - DNA, 788 bp, Homo sapiens
ccatgcgagtgggagagccaagaacccagtctccgagcgggacaccacggattgttttatgaaaatggcagctgggacgtggaggaagagccacctgccagttggactggagccacaagctgcactgtgaacctggtcacttggtaccaatgccgtcagcccgtgggtatctgaggggacctgccaattggactgccaaattccccagtttgctcccagatattatagaaaattatttgtataaataatgtaaagaaaacacacctatggcaaaaacatatacatgttctttagcacagggtgaaatcataactggcgtcatctaaacatttcctcaaagatcagccaaatctaggtaaattctggtaaatatactatattcaaccttaaagcttaccaccattacatgcatggctatggtagtatggtatcaacatctaaactagtgaatctaacacaggtaagaattttaaaatgcccccagatgacttcaaggccaaatttctgctaaggtctccacaaaatggctattttcaaatatagcatattgtgactgggttttctgaggtactttcccccatactttttttgttctgggactgggggctgtggaagaaaagactgctttgcaatgctgcataataaatatggttttaaaagtgcaagtgttacaaatgtcttccctaattaatcacactcctatataagtgaaaaggtaatctgaaattttggtggaaaattacttctgctgaaactaatcttaaggttggacttctttattcattagt

SEQ ID NO: 246536 - DNA, 380 bp, Homo sapiens
aacatatatttcctagctctctactaaggggatctagaatcaatgatactctagtaagaaatgagcacacctaccacccagattctatctcctaactgttatgctccactaaaagaaaccagagattcttgggagaaatggctaatccagggctggaacaaagaaagtacaagataggcctggaacatattgtgccaaatagaaagcaaagaagcactgttagatagaaagcaatgaagcaatgtcaaaaggacacacaaacccctgcttgaaggtactcccactggccatatatggaacaatttgatcataaaaataaattacaataatagattaaaatgtactgaataggaatccatgagtccatgctcatataaatg

SEQ ID NO: 246537 - DNA, 553 bp, Homo sapiens
agtatcagtacagattttagattgcctcattgttttttcattttcttaattcaaattgctgatgatgttttagaaagaatcaacaactttggccaggcatggtggctcatgcctgtaatcccaacacttttgggaggctgaggcaggtggattgcttgaggccaggagtttgagactagcagggccaacatggtgaaaccccatctctactaaaaatacaaaaattagccaggcatggtggtgcatccttgtaatcccaacttcttgggaggctgaggcacaagaattgcttgaacctgggaggtagaggttgcaatgagccaagatcacaccactgcattccagcctcagtgacagagcaagactttgtcaaaaaaaaaaaaaaaaaaataacaactttaacaggactctgatggtcaagaaccttagtgctgactgcaggagaggccatttaaccttaaatagctgttattccatcaaaacaaaaggcttatccttattataactttggcaaagctagaagggccaaggagaagtgactaagtatttgtta

SEQ ID NO: 246538 - DNA, 510 bp, Homo sapiens
gcccagggattaagtgttgaaatgacattaggtaacaggtttagagacagtaggaaaggtgtaataatagaagattggagacagatggagaacatttctgggatctagatttcagtactgttacagtaatggttgatgacagattccaaattatagataacatcaaaatagaaaataggtaatagttatgagaataaggatgttaaggaagtgtgaagctaaactgataagtgacagtgacacagtaattaacatttatgaagccaggttttttggcaagcctgttatatatgttatcttattaggtcatcataataaatcacaagtagatacgattacctgttttgcagatagagaaactgagttggggtagaggtgaggtgacgacacagagatagtggttattgggaactacagttgaagaaggctagaaatactgattaactttagtctgtattttaaaaacataaatctaaatataagtgttataaataaagagaataaacacta

SEQ ID NO: 246539 - DNA, 410 bp, Homo sapiens
tgccgttctgctcttgttgttgatgacacgctgagtccctgacctggctaagctccctcactaagaaagatgtgattttggtcacagaggagaccaggtgagggacagcaggcacagatgacaacacattattatcattcatttgttcactgactacccaagcaattggagtctgttggattccatgtgatggagaagtcgggaggatgaaagcctgcgtatgcctccagaggctccctaccaaatgatttttaatagtctgtatccctcccacaaacacagttggttactctactgggcaatgaagtttaaaggttggagaggctccaaatctgggcacagagaaatctcagcttaattgtcccaaactattaaaaaaaagacaacaatttgttgccagtacctggcgg

SEQ ID NO: 246540 - DNA, 333 bp, Homo sapiens
atgcaagcagcatcccctttgccaatacagacagccacagaagcactaagaaacattgcacccactcttctcttgggagctttatcttcttgtgcatccacttccttgacttacccctcatgtttggatatgaaaagattcactgtgcaatctgattgtacagtgcggtgtgctgtgatttcttagaccaggaaatatcagttgcttccttaaaattaaggcttgccatgttaatagtagccgtggtatataaagtgtcaaatgcattgcacatatcattttcaataaattcctcagaccttaactgttgtaagacctaacaagaaaaaaaaa

SEQ ID NO: 246541 - DNA, 237 bp, Homo sapiens
taatagcagcctgaccccatgggtgagtgtgctcctgggggtcaggacggtgatcttacagaacctaatgagggggcaggtgggcacgggaaacagctggatgcctgcaaagatgatcctgggatgagtaccctattctcacttggcatagcaggcacagaggcagagcagccctggttcacccaaccctgccacaggcagccatgtaaacttgaataaataaatccctttgcctca

SEQ ID NO: 246542 - DNA, 909 bp, Homo sapiens
ggtctagagtaacagtgtagcctaacagttaagttcatggctgatccaaaaggctgctagagcacacagctccaagtgcctccggagggcaactccacagaacatcacaacatggtgcccctagaattataccacgtggttgctctgcctacccagcactcaaatcatgctctatcatgagagctttgtggccctgggcaggttgcataccctttctctgctcagtttccctacctataaaatagtgacactgcttcctgcagttgttgctggcttgaatgagtgaacacgcatgatgcccttagcatagtgcctcacagaaccagcacttaatacatctttttaaattccattttgttgttattacttggttttgtttctagggcccactgtatacatagaactaggggtttcttcatcaattcaggctgccataacaaagtaccatagactgggtggcttatagacaacacaaatttatttctcacaattctggaggctggaagtctgagatcaggatgccagcatggttggggtctggtgagagtcttcttctaggttgcatcagtgccctttgtaaaggcactagtctcatttgtgagtgttgagtgctccaccctcacgacctaatcacctcccacaggcccggcctccaaataccaacacatattgggttaggatattgaaatgaattttaggggcacacaagcactcattccgtaacaagggggtaatggaaagaataggacaaagacacaaacgaaggaaagggaacagtgagagaaaggcaagcttgcaagatcatgagaggaaaacttgtgggtccttaaattggccaaaatggatgcgcttgctttgtgcccatcaaaatggggtctcctcctgctcccagcactgtctcctttattc

SEQ ID NO: 246543 - DNA, 529 bp, Homo sapiens
actataagacttacaaaagaagttaggagaaggaaaatgtcctggacaactactctaaatttacattaccttataaatgtactgaaatgttaactcagcatgaaataattgagatttgttattgttttgtaaagatgctaaataagaggggaaacagtacttcagagaagacgtctcttcatctgggcacattgcctaaaaagctgaaaattatcaacagatattattctaaatgggatttggaaaagaagaaattttgcggattaaattccaaatgaaattaagattactgtgggagagaaattgctgaatactggtctatttcacctactttcttgattagcatttgtgtttgacctctttatcatatttatacatttctattttctattaggtttttccaaaaaattgttttatagagtttttatgattttgacagttcaacatttatattccaagcaaaagtgataatctttttcaagcgtgtgttactaaggtcttagagaaaataaacccagtcatttgatac

SEQ ID NO: 246544 - DNA, 781 bp, Homo sapiens
ttttaatttcatttggttctgctctaatctttgttatttcttttcttctgctgggtttgggtttggtttgttcttgtttctctagtttcttgaggtgtgagtttaggctgtttatttgtgctcttagactttttgattgtagacacttaatgctatgaactttcctcttggcactgcttttgctgtatcccagaggttttgatcagttgcatcactattattgttcagttcaaataattttttaatttccatcttgatttcattgttgacccaaggatcattcaagagcgtatcatttaacttccacgtatttgtataattttgactgttcctttcggagttaatttccaatgttattccactgtagtctgagagagtacttgatataatttcaattttcttaaatttattaagacttgttttgtggcctatcatatggtctgtcttggagaatgttccatgtgctgatgaaaataatgtatattctgcagttgttgagtagaacattcggaaaatatctgttaagcccatttgttctacggtgtagtttgcgtctgttgtttctttgttggctttccatcttgatgacctgtctagtgctgtcagtgtagtgttgaagtccccactattattgagttgctgtctatctcatttcttaggtctagtagtaattgttttataaatttgggagctctagtactatgtgcacatacatttaggattgtaatatttttgtattgaactacttcttttatcattatataatgtccctctttgtctt

SEQ ID NO: 246545 - DNA, 448 bp, Homo sapiens
tgctggcggacccctgtccctccataggcagtgcaaagcacggccgttttcttttcaaagccaccaggggagtctttctctctagggtgccgagtcttatataaccaggatgacatgggcaagccgtggcttccttcacctttgccgccatctctcagttgtaagaaggcacttaggggagaggaccacacgaagcctgggccaccgggagggtcaccctggggactgttcaacacagctgatgccagttcagcgcctcctcagggccctctctctaagcactggcagatatggggcaacacaaagtcactttcacctgccatttcccagcaccgcgggtcccttgctcatccacctttgacatctgctggcagatacatggcaaggttggtgacctcttgaaataaaaatcaggagtggccactccagataaatttcttctgtaact

SEQ ID NO: 246546 - DNA, 448 bp, Homo sapiens
gcacataaatgagatgttccagtggagaatgtgtattctctgggtggactgttatcctgttcagtgcataatacggaggcaatgagaagagattaggaaccacagagcctcacttgtgaaagtcataaggagtaggaatttttaaagtgccatcccatctgccacctacatttcttttttccatagggtttaccatctcctaattttagttgttattttcattcttgattgtctatctgttcctgtgaacccacaagggcagatgtctttgtgttgaatctcctgagcccacagtctcccaagagatgtagtaggatgagtcagaactcccagtattttcacctaaaccaggaaaatttcaaatgatggggatactgagtcatccccaggcacctgctgtttggctagcctcaactaggagctgatttgcagtctgttcttcacctta

SEQ ID NO: 246547 - DNA, 797 bp, Homo sapiens
ctaatttaaaagggaaaaagtataaaaattaaactgtagctattgctaatgaatcaatttttctgcttccatgacatacctaactgaattttagtttcaaaacgtagtaatggcattttttatttgctttggtatatatgctgttacaaatttgcatcactgattctattttattttctgtgaaatacactctcccttaaatctggttttcaaccttttatccttgccggcacacataagggaaatgacatactttcttcattagtagtttttcattaaatgcagtgaggagtgaaatgtacattggcctggagtgattcaagaaactcagttgtgagtaaccaaaagaatgtcacactagcttaagtgcagaaggaaaattttgggctatgttcaaaggtgggccaattccatatatagttgctgcatatgttggggtcctggctttgtctggcttcattctctgatagattttctggaagttgaaaagatgtctcttaattgtcccagttctacattgtacccgtagcctatagcttcagcacacgtctagggagaactctgattggcctgagttacgatctgcccatccatgaacaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttc

SEQ ID NO: 246548 - DNA, 96 bp, Homo sapiens
gcttcatttcattcatttcgtcttccatcactgatacccttttttccaattgattgcatcagctcctgaggcttctgcatccttcacgtcgttctt

SEQ ID NO: 246549 - DNA, 457 bp, Homo sapiens
acagtggtaaagtgccctgtgaggtatgaagaggaagagatcgcgtcccagaaccactgtagctagaacctttgatgtcatcccagcctggaggcaccaatgtgtcctgccagctaactgatcggtcaccttggagccatgcttggctgtaaaatgttgataagccaggctcttttggtagagctttttaattaaaaagatgttgagacgttacttttcattttacaattgaaatcctaatagaatcattacactttcccgcagttaaattgcaatctgaagaaaaatagcacggccctacaccgttatataagggcactgcacgttaaacggacatcatcacttattgagcagtttttctgttagatgttgaatgagttagagatgtacaagagatctgcatggttaagttgaagtttaaagtaaaaatatctcagtgcactgcagtaaggagcta

SEQ ID NO: 246550 - DNA, 268 bp, Homo sapiens
cagattttagcatcctcacgggctccagcccatgcctgtgggttgcagcttgttctccccaactccacatcttttctgactacccgccctatgggcttcaagctccagcattggacaggaagagaacagccttacagagactacttcactacttcttctttatatgttaaccatactggaaattaggaacgttttaacaaaacttgtgaacatatttgcatctttgaataagaagaaaaataaaatgtctaaggaagtaccctataaa

SEQ ID NO: 246551 - DNA, 521 bp, Homo sapiens
cttgtgcacattatttaaaaatcagttcatgctgggcatggtggctcatgcatgtaatctcagcactttgggagagaaggttgcagtgaactgagatcgcgccactacacaccagcctgggcgacagagcgagactctgtctcaaaaaataaaataaaatgaaataaaataaaataaaataaaataataaataaataaataaaataaatcatcagttcatgtggccatgttccctctccctttccttcacatattatttccaattgttcagtagagatactgcctattatcaccttgtaaccactttcccttcaagagactatctctggcatcttacctaccttttcttcgaattttaggaactctgtactccaattctctatattccggctttgttccatattcctcttcctgcttattagtctgccagctatcatttacaaaacaaccactttgtatcagacactaagaacataaagtaattccagtctctgccctcaagaagattacattacggtggc

SEQ ID NO: 246552 - DNA, 523 bp, Homo sapiens
gcagcccaggcaacggcagaaccgctccggcagcggcggcggcggcagcaccagcagcgggagcgagcgcaacgctagcgcggcgcggggaccgccgcgctccttcccggctcctgccctcctctgccgctcgctcctctctcggcatccacctccttcccctcctcctgctcattcactctttccctcactctcccctcctcctcggcttctccccgactagcccgacagccctcgcgctctcccactccctctgcctgtcctccccggtcccctcctcccgctcattcactcgcccctctcccttctccactctctccccctgtctcctttcttcttcttctttcaccctccgtctctcacaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacgc

SEQ ID NO: 246553 - DNA, 411 bp, Homo sapiens
gcagcccaggcaacggcagaaccgctccggcagcggcggcggcggcagcaccagcagcgggagcgagcgcaacgctagcgcggcgcggggaccgccgcgctccttcccggctcctgccctcctctgccgctcgctcctctctcggcatccacctccttcccctcctcctgctcattcactctttccctcactctcccctcctcctcggcttctccccgactagcccgacagccctcgcgctctcccactccctctgcctgtcctccccggtcccctcctcccgctcattcactcgcccctctcccttctccactctctttattgactacatgcttctctcgcacccgaccttccgaagacgccgctatagccaggcgccctgtcggctagtcgggggggatcctcagagta

SEQ ID NO: 246554 - DNA, 498 bp, Homo sapiens
gacttctttagtatactgatgtgccatttatcttaggaacaaaaatgctttaaaaattaccagcttaaggccgagtgtggtggctcatgcctgtctgtaattctatcactttgggaggctgaggcagaaggatctctttttttttttctttttttttttttttgagacggagtctcgctgtattgcccaggctggagtgcagtggcacaatctcggctcactgcaagctccgcctccggggttcacgccattcgaggcaagaggatctcttaagcccaggagtttgagaccagcctaggcaacatagcgagaccccatctctacaaaaaatataaacattagttgggcatagtggcatgtgcttgtcgtcccagctactcaggaggctgaggtaagaggatggcttgggtccaggagttcaagggtcccatgagttgtgatcatgtcactgcactccagcctgggtgacacagtgaaaccctgtctcttaaaaaaaaa

SEQ ID NO: 246555 - DNA, 248 bp, Homo sapiens
gtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagc

SEQ ID NO: 246556 - DNA, 301 bp, Homo sapiens
aaggccttgctttccacacccaaagtgccatggaaaacatgaaaatgtgctttctatcaagggatacggtcagaaatcgaacaaaatatttcctacctgtctatatcattggagaaattgttctaggtcctttaaggaattttaggacccttactaacacctttcttcttttccaatagcatcatctgtcttagataatagttggccctctggatccctgggttccacattcatggatttaaccaaccacagatcaaaaatatttggaaaaacaaaacaaaaacagtaatacaacaataga

SEQ ID NO: 246557 - DNA, 184 bp, Homo sapiens
gttctgagaaagctggtctctctgtgcacatgtgtactattttaaaagagggggcaatacaaaggggatggggcttgatcaccaaaagtcagcacaatgaaaacaaacaataatggataatgagcactagaattcaaattagcagctgttttaaaaagatgggtttccaggagccaagatggcc

SEQ ID NO: 246558 - DNA, 640 bp, Homo sapiens
tgtcacccaggctggagtgcagtagcgctatctcggctcactgcaagctccgcctcccgggttcacgccattctcctgcctcagcctcccgagtagctgggactgcaggtgcccgccaccatatccggctacttttttgtatttttagtagagatgggatttcaccgtgttagccaggatggtctcgatctcctgacctcgtgatccgcccgcctcagcctcccaaagtgctgggattacaggcgtgagccaccgcgcccggccatcactgcaacctgttttatcagcaaggtctttatgacctgcatcttgtgccaacctcccatctcatcctgtgacttagaatgccttaaccatctgggaatgcagcccaataggtctcagcctcattttatccagcccctattcaaaatggagttgctctggttcacccgcctctgacaatagtagaagttaaaaaaaaataataacttctttaactccactccaggtggcatttcttagtgcctctgaaggttctgatgtagaaccagcccccagctcacccagagcaaggaaagatcatgaaaacccaagcagaagcaagacactgggttccagcatcaatgctaagggctagaacattttctgatgttttgct

SEQ ID NO: 246559 - DNA, 440 bp, Homo sapiens
aaaaacagtggcttaaaatttaaaagaaatctgaagactggcaggcaactgctggtatggcagccccatgatgttctcaggaaccctggatccttctaacttcctgctgtagtatcgtaaggtgtgaccttcaatctcacattctcaacatggttgcaaatcgtcagccatgctgtgcatgttctaagcaagagaaagctaaagaacaatgaaaatagtgcatgtccataagtcagtcccctttgaggggcttttctggaagtctccacccaatgataactactcattcttaactgaacctagttgcaaggcaatctgggaaatgtagtccattctttctttctcttccctctttttttctttccttccttccttttttccttctctctctctctttccctataatgacctgaataaaattggatctattagtaaggttt

SEQ ID NO: 246560 - DNA, 469 bp, Homo sapiens
cattggggctttagatgaactcagaagtactttacattactttatttactgtgtcacttactcacttttgactctgagctccacgagggcaatcacagtgtcttgggcattttagtgatactaatacttagctcatgacctaatgtgtagtacttcctcaataaatggttgttgaggcagggcgcagtggctcatcactgtaatctcagcactttgggaggctgaagcgggtggatcacctgaggccaagagtttcagaccagcctggccaacatggtgaaacccggtctactaaaaatgcaaaaattagctgggcgtggtggcacgtgcctgtaatcccagctactttgggaggttgaggcaggagaattgcttgaaccctggaggtggaggctgcagtgagccgagatcgtgccattgcactccagcctgggcgagaagagtgaaactcggtttcaaaaaaaaaaaa

SEQ ID NO: 246561 - DNA, 267 bp, Homo sapiens
cgaaatgagtcgccacttcacacccactaggatggctttagtcaataaaaagaaacattacaaatgtcagtgagaatacaaagaaattggaaatcttatggattgcaactgggaacataaaatggagcagtcgctgaggaaaagattttggcaattcctcaaaatcttaaacatgcagttaccacatgacccagtaatcccactcctaagtgtacatcaatggaaatgaaaatatatgcctattcaacaacttgcacatgaatttcc

SEQ ID NO: 246562 - DNA, 330 bp, Homo sapiens
ttgagacacactatcatgacttaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaat

SEQ ID NO: 246563 - DNA, 373 bp, Homo sapiens
cagtcgctgggtcttacagtaactttatgtttaacattttgaggaaatgctattcttttccaaagtgactgcaccatttcatatttgcactagcactgtacggacattcccatttctctgtcctagtgagtgtgaaatggtatctcactgcagttccagtttgtatttccctgatggctaatgatgtggatcatttcatgtgttcattggccacagagaaatgtctatttggattctttacccatttttcaattgggttatttgtctttataggtttgttgttgttgagacagagtcttgctctgtcactcaggctggagtgcagtggcattatcacagctaactgcagtctagaactgctgggctcacgtga

SEQ ID NO: 246564 - DNA, 491 bp, Homo sapiens
ttaatgttttttgcagctgttgtttatccatgaattattattgcaatgcttaaccggagatagaaactcaccatgagcgtatcaacctttcctcttcagaagtttcacttcagtttgaaagaaaacgcaactggtgaaacaattgctgtgtgtcataaattataggtatctgacattcattacaaggaaagcaacagtcaaatatcatgggactcatatttatttatgtctatattatctgtagatattatagataatatatatgtatactttgacagagaaggaagaacaccactctggagtgtttaatctaccatagtttgatattgtctttcttgtttgtgccaatttgaattacttggttctgttttttggttatctgcaattagtgtgctatttatttccagaatagaggaaactgaagcttactctgtgtacacaaaagaatactgtacccattcagtcatgtacaaatagagttatctcatgga

SEQ ID NO: 246565 - DNA, 348 bp, Homo sapiens
agggcagtatctctcgattcataaaagattggtcaccatgacccaaatggtggccattaggccccaagtcccacagtgggcgttagattttaacatgaggtatcaggggataaatgtttatatcattgcatcccctccctagccagccaaaggtcatgttcttctcacattgcaaaatataataatctactcccaattgtcccaaatgtgttaggttgttccagcatcaactcaaaattctagagtctcatctgagacgcaaggtaaattcttatagctttgagcctgtaaaattttttaaaaaatgttatttgcatctaaaatattaataaaacagtggaagagaca

SEQ ID NO: 246566 - DNA, 386 bp, Homo sapiens
ggccaaatgaggtcctagtaggccagaggacttttcaccagtgaagtgcagtgtagttggaacaggtaggtcactgctggccagggaatctcaacctcttcaggctgcctcaggcagagtggggcccttggggccctggagacctggcagtccccacatggtgtgaatcttttgctagagcaaatccaggccagctgctctgaatgttggtgctgccaaactttcaataacctgggacccttgccagtcaggatgttctccctgggtctgatttgcagtgcaaattgactcttagctgttccaaattctcttggctctcgattacccatcctcaggccccagtactcatcctctagtcccatcccccattctgtaactctgtctcc

SEQ ID NO: 246567 - DNA, 469 bp, Homo sapiens
gtggtttttctggctagttgcacttgcattgcccccctgcttcccttccctgagttcgtcttttgagtatcaaaatcaagaacactagattctggatatccccccgcgtgattccagtaaagactcacattatggaaataatccttttttacttttaggggaaaaaagcattattaattataaagaatataaaatatttctgtaatcacagcactttgggacgcggaggcaggaggatcatttgagcccaggagttcaagaccagcgtgggcaacataaggagacctcatgtctacaaaaaaattttaaaaattagcccggcgtggtggcacgtgcctgtagacccagctacttggaaggctgaggcagcaggattgtttgagcctgggaggtcaaagctgcagtgagtagtgattgcaccgctgcactccagcctgggtgatgacagagctagacctcttctcaaaaa

SEQ ID NO: 246568 - DNA, 194 bp, Homo sapiens
tgaggttgtcttgaggaccatgcatagtttaaagactcattgcacttccaaatctgagcatcatagttttaataaaacataaaatacataaaggtgaagatatatatggtatttctgaggatcaatattgtactcttaaacatgttgcatgagacacagataaacacatttagtccttttaaggaattcttaga

SEQ ID NO: 246569 - DNA, 374 bp, Homo sapiens
ctccctactctcatttcccacccgcatcccctaacctgacttgtataattcagtcctcccaaactcagcctgctctttcacacctccagacctttgcccatgctgttcccttgccctggaatgccattgttttctgacacattttgccacatagatgcccacttaattctgaggctcagttccgatgcctctgccttcaggaaacattccctattcctcccagaaagtcccatgacctctggctttgattctctgagtcccagatgtcgtcctctgctccagccctgaccaatgggcacatgggggtatgtctgtcttccattgcattctcgtccactccagcctggcagcagagaagactctgtctaaaaaca

SEQ ID NO: 246570 - DNA, 491 bp, Homo sapiens
tttttttttggagacagggccttgctctgtcacccaagttggagtgcagtggcatgatcatagcttcctgcagcctgaacttcctggactgaagcaatcctcccgcctcagcctcccaagcagctcggactacaggtgcatgccaccacacctagctaatttttttattttgtatttttgtagagacagggtctcactatgttgcccaggctagtcttgaactcatgggctcaaatgatcctcccgcctctgcctcccaaagtgctgggattacaggcacaagccaccactcccagtctaaagcactttttaatgctaccactgtcttttcaaaaatcccagcctgagttaaagcaaactactcccttccctgctaccactgtgcacacatgcacgtgcacatacacacagaagaattggtctcaaatggcaaaataaatttgattattcaacccgtcgacgcggccgcgaattagtagtagtagtagtag

SEQ ID NO: 246571 - DNA, 356 bp, Homo sapiens
ttcattagagaaataaaaatgagcaagatttgtgattcagaatattaaaagttaagaatccatgaatagccccttaaaaatattgtcaaagcatcatggtatttgtagtggtgcttaaaaaagaagcagcagcagctgttctaagccaagcactgcttgaaaacaaaacaaaacagaacaaaaccttatatttaataaaatggagaaatttgggaatgtccctagcgtaataatgccttctactgacatttaaagtcagcttaaacatcattagggaagactatgactgtttctatgacctctagtcacaaatttaactaatttaaggttaactaatacctctttcagagttggcc

SEQ ID NO: 246572 - DNA, 394 bp, Homo sapiens
gggtcagtttaaatcagcctgtatctgcagaaaaacagttgggatgggcgggggttgggagggtgttcaaagcaacactatacttttgaaaacatgacccaacattatgcatagaaacaaacttaccaagaccggtaatagatgctgtggctgacttacctgaacatatgaaaaaattgaccctccggttggtatcatttttttatgttgtcaacatttctgtgaaaattttaagttcctagagaaagtataaccttgaaaaagaatcgtcaggtcaactaatagacaaagacaaacaagtattcatgggaatctataattgctgaaaagctacatttgaccttaaaaattgcatgttggagctctggcaaaataaaacaaagccaaaaagaaa

SEQ ID NO: 246573 - DNA, 586 bp, Homo sapiens
gatttgcatttttctaatgattagtgatgttgagcattttaagatatatctattgaccatttgcttgtcttcttttaagcaatgtctactcagatcttttgattgttttaaaaatattgctattgaattatttatgaatttcttatatattctggatattaaaaccttatcagctgaatagcttgccattttttctgcattctgtaggttgtctcttcattttcttaattgtttactttgctgtggcagtagctttttggcttgatgtaatctcatttgtctatgttttcttttgttgcctgtgcttttggggtcttatccaaaaaattcttgtgcagaccagtgtcataaagtgtttcttttatgttttcttatagtaatattaccatttaggatctcacatttaatactttaataatttttagttgatttttgtttatggtgagacctaggggtttatcttcattcttcactgcatgtggacctccagttttccctgaaccatttactgattagagtacctttctccactttgcatttttagcaccattgtccatagtaagttcactgtaagtgtatggaattc

SEQ ID NO: 246574 - DNA, 404 bp, Homo sapiens
cattaactggttattgatggtatttggaaatattgttaattaataaatgttgattttatatttagcaatgctgttcaacttttactttagttataatagtttgtgcacgattttggatcttctcaatggtcaatgctgatttgaagtttctctaatttctcaccttagccttcctaatacagtctctgtttaagttcctaacaaagaagagggggagagcaggaggaagagaatgaagaaaggccagaaagtcagataaggcataaactcaatgatcaggttcaaaataattttgacttgctactgaatgatttccactcactaattctgttaggtggtacctaataattcttgtgaagtctgttttgtgacttaatataaagtgatgaaattttagaaaacta

SEQ ID NO: 246575 - DNA, 463 bp, Homo sapiens
taaataataaatcatgtagttgccattctttgttgctttgctatatgatttgctgtaattggtttgtggtggagattgtgggttgccagctaatatccattctctccttttttcgtagtaaaacagaatcctgattttattctgggctgcagtgtgcccagctaaaagactatactacgtttcacagctttccttgcgaggtgtagccaatgggatgtaggcagaagtgttgaatgggttatccaaaaagattgctgtgttacttcattttctgtatactggaaactgggtgatttacaaagagaaggaatttatttcttacagttatagaggctgagaggtccaaggtcaaggggccacatctggcgagggtcttcttgctggtagggactctctgaagggtcctgaggtggcacatggcatcacgtggtgacagaactgagcatgctagctcaggtttttc

SEQ ID NO: 246576 - DNA, 304 bp, Homo sapiens
gaaatagggtctctgcagttgtaatcaagatgaggtcattaggagggccctaatccaatatgactgacatctttataagaagaggaaaagagacacaaacacacaaagaggatgccgtgtgaagacagaggggccgaggctcaagtgattcttctataagccaaagattgctggtgacatcaaagcgaagagaaagccgtggaacagatagatgctcccctagagcccttcaagaaagcacagccctgctgcctccttgcaaacagaaccatgaaagaataaatttctgctgttttaagtcact

SEQ ID NO: 246577 - DNA, 416 bp, Homo sapiens
ttataaataacttgtatctactcttctataatgtaaaataaaccttacctcaaatgaaatcttatttttaataaactattaattataactatcaattatttaagtagtaagagactgtatgataaaactaaatagtttctttaggaacttaaattgaagtaaagaattgtacataaattagtaattcaaaaagagcaacattaaaatcacattacacttttttagtgcttcgtgttcagacaatttaaaactatattataaatgttttattttaaattaatatttttctcatttaaattaattattctttgaacaattttatgtaaaactgtttttgaacaattttgattctgtttcatagatgtaaatctgtttattaaaccacaaatattgaataagctcatggcaaaaaaaaa

SEQ ID NO: 246578 - DNA, 355 bp, Homo sapiens
tcaaaacctttgcagtgctatttgttacctgtctgtattttaccaggtggccacctggagcctggttggtggtttaccccatgatttaggcgtcctggtcatttgtaggtgaaagttgttcacagtagaccaaggtttgagattttcttggtcactcagctgaggtgaagctgggctgctgtctgaacttgtaccctcaaggtgctgcccctttgaaggttagcccacactgataggtaatgccccaggaccccattcttggaagttaaaggactccagccctcatcctccagactctaaaaggactcctttcagcaaatgtgaccctagggccaaaaaagcagctggacatctg

SEQ ID NO: 246579 - DNA, 239 bp, Homo sapiens
gggatccggaggggcaacggaggagacgcagggcagcaaggagagaggacaccactcgcgcggcagcatccaaaggccagagtggggacccgcgctgcctcctaccctcgcctcgcatcctctgccaaatccgaattcttccagcccagcttcccgggctctgtcctccatatcgaataataatgacacatatcgaatcgcatggacttatccgacctcctcagaccccgtttccgccc

SEQ ID NO: 246580 - DNA, 1921 bp, Homo sapiens
  misc_feature (1329)..(1329): n is a, c, g, or t
  misc_feature (1346)..(1346): n is a, c, g, or t
  misc_feature (1358)..(1358): n is a, c, g, or t
  misc_feature (1363)..(1363): n is a, c, g, or t
  misc_feature (1376)..(1376): n is a, c, g, or t
  misc_feature (1381)..(1381): n is a, c, g, or t
  misc_feature (1495)..(1495): n is a, c, g, or t
  misc_feature (1562)..(1562): n is a, c, g, or t
  misc_feature (1590)..(1590): n is a, c, g, or t
  misc_feature (1618)..(1618): n is a, c, g, or t
  misc_feature (1703)..(1703): n is a, c, g, or t
gtggggtcccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggctctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggaggggggcccggtcccaccccgccccgcccgccaggggccttgccggccccntcaagcaatagggtccngaggggagaccnacccngagccccctcccntcccntccagggtgcccccggctttctcccagcaatagggtcgacgagacctagaaccgaacctcatctccgagttgggtctctgaagacgggggtgaggtgaggtagggagcgccctncttctcccgcctctgcgcccctggatcgcgtcgcagggactcaggtcttccccaccccttcccaagncttctagcgcagggcctgcggcccagangtccagggagccggcccctccccggcancaggccggggcggagcaggagcgggcgggcctgcagggacgcccctgcctagcagccttcgcggaactcccggcagtgttagacncgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgtttccgccc

SEQ ID NO: 246581 - DNA, 421 bp, Homo sapiens
tgctcaagcacagtttatgcaacaaaatgtgattcagaatctaatttcacaaaataaatccagaggagagacttgagggaaaagggcaaagatgtaactcaataaagtccatagcatcacagaataggatgatggtgatggtttctaaccttgagaatgtctaagtgggttcttcagtttctaaaatttatttatctgttcttggacccaagaaatcagaatagatcgtaacagaaaaaaaatgacctagctttcacctagacaagttagaaaatgcagaagtagcctggcagaagtacaaccatctgacctttgacaaaaccacagaaataagaaagaaaaggctcactatgcgatgaatggcgctgggatacatgactagccatgtgcaggacaattaacactgcagccctgcttgtca

SEQ ID NO: 246582 - DNA, 625 bp, Homo sapiens
tctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgt

SEQ ID NO: 246583 - DNA, 442 bp, Homo sapiens
gcctggaatacttgaccttctcaagcgggtatctcctagtcatccttactatttcagaacaaccatgttttctcacgctttcaggattaattcctggcaatgaaacaaaagcaaaattatcccattccacagtagattcggatgaaaactggaaataaaatcgggtacaactccaagaggagatattggagaagaaccaagctgggtctgcaaggaactgcatacgagatggcacacgtatttatgctgtctcaaggtcatgaccatgttaccatatcaagctgaaaatgtcaccactatctggacagttggtcatgttttattgggaatatatttttttcctctctgaatctattgtgaatgcgctggttggctgggttcagtaataaatatgtgagacctttcatttgaaaaaataaaaataataataatttgcattata

SEQ ID NO: 246584 - DNA, 415 bp, Homo sapiens
atgccagctactcgggaggctgtggcaggagaatagtttgaacctgggaggcagaggttgcagtgagctgaaattgcaccactgcactccagcctgagtaacaagagtgaaactccatcttaaaaaaaaaaaaaaagaaaaaaaaagaaagaaaaaagaaaagtcagttctccaaaagataaacaaaattgataaactgctagcaagactaaccaagaaaagaagaaagacaaaatatgcaaaagcatacatgaaaagggaaatattataactgatattacagaaatacaaaagataatggggactattatgaacaagcatacactaacaaactagaaaacctagaggaaatggataattcctggatatatacaacctatgaagaccatatatatggacaaatacaacctatgaa

SEQ ID NO: 246585 - DNA, 215 bp, Homo sapiens
gaaatgctgtgtcctgctccagttcttacctcattcctgctggcctgattgctgatgttgacagttgaccccacccacaacatggaattcaaatgtcaaagatggcaaagcaacaaaatagaaggatttggttcctgaaaattgtggagtccacataccaacagttctgaattgtccatggttatgtgaaaataaacatctatcttgcctgagta

SEQ ID NO: 246586 - DNA, 629 bp, Homo sapiens
aagcaatgtcgtttcaacaaagaactcagcaggataaatacgatcaagctcgtatctcacaaattatcacttgtgtctgaatgtcttccatttctgttcgtattcattcctaatggattaggtctcatcccccaagtatgtttctagtgaatatgaaaaaccctattgtcacatatttctttctttatatacaactaccatcatttcattaactgttgcttaaaggaacattttttaaaagtaatctgacacgttactttaccattttttgatcaatttatgttgtgtcttctttacatatactttgaagggccatatctgaaacagaactttcttttttcattaaaaaactagcatatgtgggctatctgcctttatattcattttattgactattttactatgaacagtcttatattttactttatattaattcctccagattaatggcaagtatttaacctaacatatggatccatctcacttaatattagtttaacttcatttaattcctttctttttactcataatcaactacttttcctgatgagatattaagaaagaagatatgttttggcacctctgtccatctctttacccatttcttactcctctaagaagggaagaaa

SEQ ID NO: 246587 - DNA, 483 bp, Homo sapiens
tgttccagacaaagcaaaaggagactgggaacctggagttgacctccttcctcagaaacaggaaggcagccccactcttcccctgaagcacagccccctgtccaaatacaagcaggcatctgccagcactgcctccctgactagggagcagcgaggccgagtcctcaccatcctaccagggagctttgtggatccccagtgctaccacttaaaatctgtgaaaccaagtcgggaacccttcacctttcactgataaaacattgtgaaaaggcaacaggcctataagtacgtgacatatgaggttgcctcagggtggacatgttttccgcttttgtccagatgttgggtggcccatcggaactctgtgtttcacaggggctgggcctgtttcccatcctgtgatgagtccttcccaattgaactcttccctagccagttgctaactagagaccaggaccactcccatctgacgtttgcttgttc

SEQ ID NO: 246588 - DNA, 645 bp, Homo sapiens
cagagtaatagtagagagacagagagagagaaaccagtagaacaagatggccagggaagaattctttgagcagatgacttttggaactgatgtagatgatgagagccatgtgaagacctaggggagaggccttccaggctaaaggaactgcactggcaaaagtcctaaggcaaaaactagcttggggtttggaaggtgtgcgaggggcgtcgtagctgaagcatggggagaccataaggaaaagcaagcaaacaacagattaagcagaagagtgacgtggttgatagacttatctgtgttatctgaagactggaatgtaggggacaagaatggaatcctggagatcagttaggaggcttttgccacgggcaagaggcaatggtgatttatatctggtggtgataatcaatgtggaggacagattagattcattctagcctgtattttgggaaaaaagtaaaaaggacttgtcagtagattggaaataagaaatgaaaaaggagtattaaggcttttcacactgaataactagatggatggtataagtgtatactgagatggggataacaggaagaggaatggttttaaaggagaaattaagagttttggtgattttgagagtcctagtagatttccgagttggga

SEQ ID NO: 246589 - DNA, 419 bp, Homo sapiens
aattccacaaggagcctgtgctttacgtaaggttagccagtcagcaaatatgtgtgtagggcgcaccataagccagagactgtgacgggggaggtgttcagtgtcactcttttaaggctagtagggactgctggttgggtcaccgttttagacaagtggttctcaaacttgaatagtctattgatttcttttaaagtatataaaaaattatgacctccagtgttatttttattatagtgttaagtattaaaaacataaagccacataaaacttcttaaattcttgtgccactataaaaaagaaactttgacaaattaagtaaaacttatgtaagttttataatattattcaaataaagggcataaatttaatacaatgaatggaaatgtctgaaactaaatttaacatattgtgcttag

SEQ ID NO: 246590 - DNA, 391 bp, Homo sapiens
actattcctgaatactacaccttcacctttcttgatgtattcccttgttttggtagagtatatctaccaatagctttctcagaaaagtacatggaggataattacattaaaaatgatatgtgtttgaaaatatctgtaataccttgacttggtttagaatttcaaattaaaagtcatttccaaaatttagagggtggttttgctctactggcttcttattccaatattgatagaatgccaaatttactcctgatcatgtgtctgaaatctgtacttctggaagttttatgatcttctttttaactccaatgctgaaatatgacaataacagtatttggtgtgggtctttgttcatccactgagctggacaattacacagcctttacaatct

SEQ ID NO: 246591 - DNA, 253 bp, Homo sapiens
acattaaaacaaagtataaaatgtttttatgtcatgtagcataagagtattacaagagagtattcaggtccttgctcaacttggctctgaaaacagatcctgctttgctatgattgtatgaagatagttttttcattatgctccattttcaaaattttagagcattatctgaaggagaactttatatcctcagcctgtgaaatctgtagtatggtggaaagagggtgtattgtagagttagatggttcttaag

SEQ ID NO: 246592 - DNA, 395 bp, Homo sapiens
tagcagcattatcacaaagacttttgtatatcttcagatatcagcatagcaaaagtaagatgtaaagttactatgcttatggaactcaggtttatgaacatttctgaaatttcaaaatttcattatttgagagatcagaacaaatcagaataactactatttttgctttttccttaggcagcaagatgagttcttttgttttttggtggtattaaaattttgttttgtttttgttttgcttttcttactatatgtgaagagcttagtcaccttgacaataggacacagtttgtgtatggccaatgtagtgccatcattcccttaagatataaattcctcattaaaaatgcatctttaatgtgcacatatcttaaataaaatcttaagaatgtcgt

SEQ ID NO: 246593 - DNA, 340 bp, Homo sapiens
aaagtgttaggattaccgatgtgagctaccgcggctggccaactctgcctcttaaattaaaaaaaaaaagtaaagaaaaaaagattctggaatagaccatcaaagcaaatgcaaaagctggcccctggttggcagtagacaagacactgggcctgcatcaagactctgtgtggcgcatcctggaaggagaggtttgggagagggagttagaaaagggggaaacactacaacagccacaaccctggaggcttaatttcaccccaggtcttcatagcaatcttgttttgtttttgatctccaaaaaggggtcagcctaggatttatgagatactccctcaca

SEQ ID NO: 246594 - DNA, 474 bp, Homo sapiens
ttcacagaggaggggaaatgtaggtcattcttttgaggggcaataaatgattattagggagaatgaatggaccttggagaacagaaattaagctgtaaatgatcctctttgcagttgagtgagccttagaaacagacatgatcttgtgaaaaggtcagtccaggtagggttatattcctcaatcttcttttttgcagtagataatgagatacatgggaggtgatggaaaacagttgttttctttggtggatccagttttttgtttgtttgttttttgttttttttttttgagacagactctccactctgcaaactccgcctcccgggtttgagtgattctcgtgcctcagccttccaagtagctgagagtccaggtgcccaccatcatgcctggctaatttttgtattttttgtttgtttgtttgtttttgaggcggagtctgcagagtggagagtctgtctcaaaaaaaaaaa

SEQ ID NO: 246595 - DNA, 449 bp, Homo sapiens
ttagtacatcaggggcagaggtgggccaaccttcttctatgtcaactggagacagggattttcaccaagatttctaaagcccagtaactggtatacagattccctaggcacagcttgaaaaccattcctatctggagagctgcaaacaaatgggacctagttcttcgttatttatggaaactttcaaaccttttttatcaccccaagttgcaaatactactcacagcctcttttcttggttgagtcacttttctattgttcagggaactgccagcaacaacttgtctctctctttttttgttttatttttatttttattttctttttatactttaggttctgggatacatgtgcagaacgtgcaggtttgttacataggcaaaccaccattgcacacgtacctatgtaagaaacctgcacatgcctggaacttaaaataaaagaaaaaa

SEQ ID NO: 246596 - DNA, 469 bp, Homo sapiens
gacatcacatgcatcatctctcacctggatcatggtagtcgtttcttaattggtttccttgtctccacccttaccctccttaagtgtattctcaacccagcagccagagagattctattaaaacacgtgtcatgccgtgccacccttgtgctcaaaacccttcagtctcctactctctgacctcattttcctccactgtgctccaccttcggttgactccagccatactcactgttcctcaaacattcaggcttgcttctgcctcagggcctctgtgcagactgttccccctgcctggaaggctgtccccctggtgcctacctgtcactttcatgtccatagagtcaccttatcactcaggctcttggtcactccatctaaaatgaaagctctccccaatgctgcctagctctttccttgtaacatgatatataattatatataattaaatatatacatgatatctatt

SEQ ID NO: 246597 - DNA, 518 bp, Homo sapiens
cagtgtattcgcacacagttgagaaaggccagggaggataacaagggctagaatatagggtcagctccctacagttgctgtaaccccctgggcagctccctttacttctctgagcttcagtgacctcctctgtaagtgaggataacatttcccagagtgaggattaaataacattatgcatggacctgcccatagacaatgacctagcaatggctcagtgagtgtcagtgatgattatccccaagtaaaataaatttgaatttaaaattttaaaaatggtcatttttgcatccattgtcttgagccaaatgggaaacggtttggttcagcctctaagcccctgcgggtaggccctgggtctttcagccctgtgtctgctggtacgcctggggctcaggaaatgcacatggtgtgttaaaaccaagtttgaatttgtcaaatcccaagtcaatccaggatgttcatttcttaaatgatacagtgagacaaagtttttttgaagaggaaaaagaaaaaaa

SEQ ID NO: 246598 - DNA, 6186 bp, Homo sapiens
ctttttattttgagcctttttgatactgaacatgatatctgagtgaagaatttttgttttattattaagaaataaatgtatcttgcttcttgagatctccctggcttcagcaatttgtagttatttccactatagaccattaagaatatatttcaaaggcaagctaacaaagttcaagtaaaaattattttttatatattacagcttctaattggcattggtttcttctcaggttaaagctgtatttttcttaaaggcttataaaaattttgctgaaaaaaatgttggtgcttcggtgcaggcttggaacctcttttcctaaactagataacttggtaccaaaaggcaaaatgaagattctcctggtctttctagggcttcttggtaattctgttgctatgccaatgcacatgccccgaatgcctggatttagcagtaaaagtgaggagatgatgcggtataatcaattcaactttatgaacggcccacatatggcacacctggggcccttctttggaaacggtctccctcagcaatttccacagtaccagatgcccatgtggcctcagccaccacccaacacatggcatccacggaaatcctcagcacccaaacgtcataacaagactgatcagacccaagaaacccagaaacccaaccagactcagtcaaaaaagccaccacaaaagcggcctttgaagcagccatcacataatcaacctcagcccgaagaggaagctcaaccccctcaggcattcccaccatttggaaatgggctattcccctatcaacaaccaccatggcaaattccacagaggttaccaccaccaggttatggacgcccaccaatcagcaatgaagaaggggggaatccttactttggatattttggatatcatggctttgggggtcgccctccttattattcagaagaaatgtttgaacaagattttgaaaaacccaaagaagaagatcctcctaaagcagaaagtccaggcacagaacccacagctaattcaacagtcactgagacgaattctacccaaccaaatcctaaagggagtcagggaggaaatgacaccagccccacaggaaacagtaccccaggactaaacactgggaacaacccttcagctcgaaatgggattggcccactccctgcagtcaacgcttcaggccagggagggccaggaagtcaaatcccatggagaccaagtcagccaaatattcgtgaaaatcatccatatcctaatataagaaattttccttcaggaagacagtggtatttcactggtactgtcatggggcacagacagaataggcctttttacagaaatcaacaagttcaaaggggtcctcggtggaacttctttgcttgggaacgtaaacaagtagctcgtccaggaaatccagtttatcacaaagcttaccctcctacttcaagaggcaattatcccaattatgcaggaaatccagcaaatctcagaagaaagcctcaggggccaaataaacaccctgtaggaactactgttgccccactgggtcccaaacctggccctgttgttcgcaatgaaaaaatccaaaatccaaaggagaagcccctgggtccaaaagaacaaataatagttcctacaaagaatccaaccagcccctggagaaactctcaacagtatgaagttaataaatcaaattataaactgcctcactctgagggttatatgccagtcccaaattttaattctgttgatcaacatgaaaactcctattacccaagaggagattccagaaaagtcccaaattctgatggacaaacccaaagccagaatttgcccaaagggattgttttagggtcaagaaggatgccatatgaatcagaaactaatcagtcagaattaaagcacagctcatatcagcctgctgtataccctgaggaaatcccttctcctgcaaaagaacattttcctgctggaagaaatacttgggaccaccaagaaatctctccaccttttaaggaagatccagggaggcaagaagaacatttaccccatccttcccatggttctagaggaagtgttttctaccctgaatataacccatatgatcccagggaaaactcaccataccttagaggcaatacatgggatgagagagatgattctcccaatactatggggcaaaaagaaagtccactctaccccataaataccccagaccagaaggagatagtcccttataatgaagaggacccagttgatccaactggagatgaagtctttcctggacaaaatagatggggtgaagagttgagcttcaaaggaggcccaacagttaggcactatgaaggtgaacaatatacctcaaatcagccaaaggaatatcttccctattctttagataatccatcaaaaccaagggaggatttttattacagtgaattttacccatggagcccggatgagaattttccatcatataatacagcttctactatgccaccacctatagagagcaggggctactacgttaataatgccgctggaccagaagaaagcactctatttccttcacggaattcctgggaccacaggatacaagcccaagggcagagagaaagaaggccgtattttaacagaaatatctgggatcaggcaacacatttacaaaaagccccagctaggccaccagaccagaaaggtaaccagccctattacagtaacaccccagctgggcttcagaaaaatccaatatggcatgaaggtgagaatttgaactatggcatgcaaataactaggatgaattctccagagagagaacattcatctttccctaacttcatcccaccaagttacccatcaggtcaaaaagaagcacatttatttcacctaagccagagaggctcttgctgtgctggtagctccacagggcccaaggacaatccactagctctacaagactacactccatcctatggtcttgcacctggggagaaccaagacaccagtcctctgtatacagacggtagtcataccaagcagacaagagatatcatctccccaacaagcatcctaccaggccaaagaaacagctcagagaagagggaaagccaaaacccttttagagatggtgtgtccacgctgaggaggaacacaccatgttctataaagaatcaactgggccaaaaggaaattatgccctttcctgaagccagttcccttcaatcaaagaatacaccttgtctcaaaaatgatcttggaggagatgggaacaacattctggaacaagtttttgaagacaaccagctcaatgaaagaactgttgaccttactcctgagcagcttgttattggtacacctgatgaaggctccaatccagaaggcatccaaagtcaagtccaagaaaatgagagtgagaggcaacagcaaagaccatctaacattctgcatttgccatgctttggctccaaattagcaaagcatcactcttccaccaccggaactccatctagcgatggaaggcaaagcccatttgatggggattcaattacgcctactgaaaatcctaacacattggttgagttagctactgaggaacaatttaagagtataaatgtagacccacttgatgcagatgaacacagtccatttgaattccttcaaagagggaccaatgtacaggaccaggtacaagactgcttactacttcaggcctaggggttatccaaccaagcattcttggggaaagagaaatcactgacattctataccaatggttcccaaaattttttccccaagacttaattaagtgtctgactgtcttggtgatccttaagttttctcccctctcagcaataggagtagcgacccaggtggagctgagattaggcctctggggatcaccagatctagcactttcacagattagtgcagaccttaaaaaagcaagaaggccatgaccatccctgcctcgaaacttgcaagtcacttgtctgagttagtttccttttgcttgatgacttcttttgctctcaaagttccatacttgcaaaattggtttttcaagactgaaaggcagattaactttccattctacttatggagatccacacatcagtatagtcctgatgcactgtacgttttttgcttgtgttgatcttgtcaggtttttttcctactcaatattctcttcaagcattttttttcttccactgccactctctttacctttatcatttctttttcttagctttcttccttcttttctctctccctcaaccattctgtatttagctttctaatcctcatctttttctctctgtatatcacttcttacatattaaattagctattttaaccatttctagtctcttctttatgtctacctcctccattatgtcttcgtctcttccaacctatctgttctgtctcccaatgtaccacttatcaactaatccctctcctctctgattcctttcttcccttcaatttatctttttccctgttacaccattttcatcttaagactgcatgtcactctcttcctttttgtatccactctccaaatcgtaccctaaatttttcttgacccagcttaaccatcattacagaatatattttggaaatggtagacactgatagctactttgtttttagttatcttagggtctctaccaagtagacacagttcagttagagagacgtatttaaggagaagggaaggcaggatacccagaactagcagcctagggaaaaggcttaggaagatggagaatgaggaactgaagaaactgccgctctgagactgcacatccaggaaaaaagactaggacttgccacacactgccaattcataatccgcaggatctgtagaagacattttgggaaacactgtcttaaataaaaactcaatgtttagttgtttttttttttttttactagttcagcataagggattctaccagtatgtgctactactaacattcttcatgtccatgcagaattacttacagacactctttcttggtatcttgaataaattgtgtaaattattttgaaaagtggatatttctatatgccttgcttataatacatcagggattattattcttattaataacatgttggcctattatctggatgtcccttgcctagagcaggaaaaaagtctcagaattacctaaaaacatactttataactttaagagatttcttaggatacatcttcaggggcagatttcataacaacatctcaaaaatttggggaaacacaacgttgaaaacttcctaagaaaaggaatcttgcccttgaatcttctgaagtacctagcacagtgtcttcaacatagaaggtacccaataaatatatatcaattcattttttaatgactttcaacactcccatgaaaacaccgtagtctgcttttcctgaaaggtgactgtctaggatgctgaatgagccaccactccgtagctttatatattcagcaacatttccatcatagaatttcagcgttagaagggatcttagaggtagattatccaggccatcccctactgcttacattcccctccccctggccagttttatattttaatcacacattgaaaaattcattaacttattctgtataaaactgtcttttaagaattatcctttcaaaataaaaatgttattgtttcactagtttatttttccaaatgattttttttgaaatctcaatatgagtactttcattacaagatactcacttcacatttcaccaaaatgcatgggttcacataattgttttggcagatatgttgacatatctgaatttataagacactgctacttaaactaccatctgagatcgctgcaatgtaaaatgtaaaaagtacagtgtgacacttccaaactgtcttgagcataagtaaatattttttctaaaaatgtatagtgtgaccaaaggaacacatattttgaatttgaaaacacacagtgaaaagaagggaaaatgtctctccagaaaataactgttttctttttttttttttttttttttttttggtttttgttttgagacagagtcttgccctattgcccacactggagtgcagtggcaccatctcagctcactgcaacctccacctcccaagttgaaacaattctcgtgcctcagcctcccaagcagctgagattacaaatgtgtgc

SEQ ID NO: 246599 - DNA, 340 bp, Homo sapiens
aattcaaaggctgcctgtgtaactatgcatagcttattacttcctttcttcacaagtttagacaagtttgatcatgggaacaatgagaaactatgctcatgattgttcttcaggaagatttatctgatgcagtgcctgagtgtggagagacacaagagttaagtgattgataaggaggcaaaaccttgggagaaaagagcttctggaccagggtcttgacctagtggaaaaagattggctggatgtggtagctcacacctgtaattccagtactttgggaggcagatgcaggaggattgctggagccccagaatttgataccagcctaatgtctctacca

SEQ ID NO: 246600 - DNA, 431 bp, Homo sapiens
tctcaaacttcaagagaccaaggtgggaggatggctgggctcaagagatcctcctgccttggcttctcaaagtgctgggattgtaggcatgagtcactgcctgtccatataaagtaacactcttgaactcactatccagacttgaggttttgttaagttactgttaaaattttgtcaattttgctcttgagttttcaaaataaacaggtcattacagataaagttgaagttccctttgtcccttccccagtaccgttcccctccctttcagaagcaccaccatcatatattttttctatttttatcatagatatatatccatggataacattataaggcttcagtgcattttaaaaagaggtccaatggttatgatataatttataactttagttttccatcgcacatttttaaaaaagttggcggccggg

SEQ ID NO: 246601 - DNA, 270 bp, Homo sapiens
gcagagagctttcaatccatttccatggagtttccctcttggatgagtggacagacaagggtcaccagatatgtaagggaagatttgaatatgaatatcagaagtaaaacaaagaagaaaaacctattgaatgaaacactgatggggaagaaaatttccagaaaaaaatgttaatattttccaaaagagaagatatcacagccataaaacagtaatttttaaaaattcagagaacaaagagctcttggaaattaaaaccataataggaat

SEQ ID NO: 246602 - DNA, 363 bp, Homo sapiens
cagccaacaaatgcttactgagtgcactgcattaggatctaggaggacatgatgatgaactagtcttcaaagtgcttactttgtagatacaaacagacagataaataaaatatgtaaaagttgtaattgatgcagtgaaggaagcaaacaaggggaatgaggtaggactaggaaagagagacctattttaggtggaatgggaagagaaggcctctctgggaaatattattcaagctgaggaccaaagcatgctccaggatcagagggtgccagtcatctgtggaatggtggtagggtagaaagtggttctggaaaagagaatgcaaatgtgggcaagaccatgggatatctgaggaactgagg

SEQ ID NO: 246603 - DNA, 374 bp, Homo sapiens
gtttgcacacatataagatggtgttttttccttcatctctaatgatttcataaggtctcagttctatatgacatttggattttgaatttataataccatgtttatatatttaacatggacacatggcaagtgctgggaattaaagctaaatatagacttgttgactgaacaatcaaactatctgcttgtcttagtccattagtagtagtttcactggtatggttgatagaaagcactcaccctcctcatacgtgcatgagacgaggccaagaagtgattcctgtgtaaattggcagccatgacagtaatgatgtttgcctaaaacatgtgtcagtaataggaaagatgattaggcaaagaagaaaaagtttaaa

SEQ ID NO: 246604 - DNA, 453 bp, Homo sapiens
ggaaacattagagtagaaaaagaaaaaggatttgagaatccagtaggaaattcagttaatcattccttccctgttactcaactaccttaacattgtcaggtttacctgaacataaacttcattttcttaattgttcttagaacgaagggatatgtttattgaaatcagtaattaagaatattttgggacagttatgatttacttagccagtgaagcagtttctattcccaaatccaggcaaagagaacaataagattaaacgtaacctaagagatttcctttttgtcaaataatgtgattttgctatgtatagaggagatgtctatatgtaagggcatatttatgaccagtagttcctaaaattaaggggactattattgtgttactcaaggtatcagttgtataggatacattatgtcatatttcaaacaatgtttataaagagattagtat

SEQ ID NO: 246605 - DNA, 457 bp, Homo sapiens
aaaagctacttcaccttaatcaccaataattgaatataaatcagggattatatctgcttatttagaatgaatgtcttcactgatgcattccttagttaacttttgatgaatgtaccagtttgcttggtgattgttattgccttctcagactctctgtaccttttttgtcaatttaaaacgtaacctagagagctgagtatgctgagtacttaggctagatatgaacaagctggacctcttaaagtcacagttggttgtgaaattagagattctctaggaaggattcctttaccctctagtaattccaaacctctctgcttactgatatttaaacaattcctttaagagaggttcttttactcaacaattaagagatgggacttcaaatgtaaatactccaggagagagttaggtttaaaactaaagtgtcaaagagagccagttttcagcctggggt

SEQ ID NO: 246606 - DNA, 616 bp, Homo sapiens
gttggggtgagggctggcctgtctgaggaggggcatttgcagtgctggagcaagccatggaggacaggaattgctccagtcagaggaacagcaaggacaaggggcccaagacggcatgtactagaggctccacgcatagaaaaagccagccatccccagtgctgtaactgagtggccagtggtgggaggtgaggtcacagacgcggagggggcatacatgggtctttgtaatagttaattttatgcatcaacttgactggatcacagtgtgcccagatatttgatcaaacattattctgagtgtttccgtgacaatgtttttggatacaatcaacatttatttaattggttgaagacctgaatagaacaaagagttcaattctctcaagtaagagaagtcctcctgtctgactacttcagaattgggacattggctttttcctgcctctacactacaactacaccatcaagccttcagacatggaaaggaaccacactattggctctcctcggtcttcagcttgccaactcaatgcagatctttgcatttgtcagccttataaccatgtgagctaattccctaaaataaatgtcctcatttaaatgtatttcctat

SEQ ID NO: 246607 - DNA, 438 bp, Homo sapiens
agtatttacaccatggacatcagcaaatgcaaccaagacctcccgctaccctggagagctgggtttaagacatttgccagcacaccactgcccagggaccagtctcagctccagagctgtgggttattggtaaaggatgtgatttcattgagcctcagtttctgtatctgtaaagcaggaatctatcacttatgaaatatcctgtgcaggcacaatcttaggtgtggaggatacaatacaacaattgggacattggctttttcctgcctctacactacaactacaccatcaagccttcagacatggaaaggaaccacactattggctctcctcggtcttcagcttgccaactcaatgcagatctttgcatttgtcagccttataaccatgtgagctaattccctaaaataaatgtcctcatttaaatgtatttcctat

SEQ ID NO: 246608 - DNA, 451 bp, Homo sapiens
atttattcacagactagtcccttctgccttctgggcaggtcacatctgaaagattatcctctttgaatcagtttgaatgttctagtgaccaggccacacagtttctcttgacatttaaaaataaagcttccagtcttgtcactaatggatttggggtccagtacccttaaaatcacctcagagctgcctgaatccatagactacttgcagaatcactggttttacttggatcaagccatctgagaagatttttatatacctcaacatattaaaggtatgaaaagatcatgcagaaaaaaacctgttcagcttcatctcacatagtatttctgccacttatttcaccacagatactttgttaatatcttggaactcttgtttttagaaaaaagcattggaaatggaggagactgtcaaggacaataataaatgatggtactgtaaacaccta

SEQ ID NO: 246609 - DNA, 408 bp, Homo sapiens
aaatgtaacatacacatacaatggagtattatgcagccttaaaaaagagggcaatccgttcaacaggttacaacatagataaacttcaaggacattattatgctaagtaaataagctagtcacaaaaggacaaatagtgtatgattccactcatatgaagtatctaaagtagtcaaaatcttagaaacagaaagtagaaatatatttgctgagggctggagggtatggggaggggaaattagtttttaatgcatatagtttcatttctcaagataaaaaagttctagagatctcatgcacaatgtgaatatacttagcatttttgaactatacacttaaaatatgattaagatggtgaatgttatgctatgtgtttattaccacaataaaaaatatttttgttgctaa

SEQ ID NO: 246610 - DNA, 497 bp, Homo sapiens
ttgttttcaaagatttacaacttcagggagacaaaggaaactccagctcatctcccacatcattgattgagaggaccattttctgactgtctgcacacgtttcctatactaccctttaatgcaacaatgggatgaagagatgaagacttctagcaggctacctcagaaaggttgctgaccaaaggctgtatggaccaaaaagtcataacaccaccctggatgaaaggacatttacctaaggaattacccgctctcaattcttcccaggtgcatgtagtatagattaaataaggtggttgtatggcaacagagacattattagaaacattcttcttgaagtttgacaacaaagcagtagatgtgtatctactacagagttgttagtgaaaaaaggtatgtttgaagtaatcaattggtattcattttaaacagtaatggtcttactgaagctaagtttaatacatgctgtgtttggaagtaatttctttaccactgtg

SEQ ID NO: 246611 - DNA, 457 bp, Homo sapiens
gtcctcctgagaaccagctaggtcccgaccacttgcgcatttgaatcatttctgatctgggtttctggcctgggctctgcaggccctagcacccaaggaggccaactcactgaagtagcctacgcttcaatgtttggctgtttgcatttcttgacaaaggaaatttgttgggcttaagttgccaagggtttgcatctggatcctatgatgtttggctttgggagggctgtgcgcagaactggctctggggcctccaccggcctccatgtaattaacttaagtgcttcgaagatgaaagcttatttgcctgatcctggattatggcatgtgccgtgaaggtaggcagagcagacctcgccagttatctctcgctattgaagtttccaaagaaaccagtggtggacagtggaagtcaggaagtttgggcatgttggaatttattaaatttgcagttaaa

SEQ ID NO: 246612 - DNA, 461 bp, Homo sapiens
gagcacttggcagggagtgataaagaactcaaagtgcgttgtttccttcagaggagctcaacagcatcagtccttaaagaacagcacccccggctgggtgtggtggctcacgcctgtaatcccagcactttgggaggccgaggcaggtggatcacgaggtcaagagatcgagaccatcctggccaacgtggtgaaactccgtctctactaaaaataaaaaaattagctgggagcttgctaaacaagtggggcctcacctcagacctactgcattaaaatctacttttagcaagatccccaggtgatttgtaagcatattaaagtttaaggcgcgtgcctgtagtcccagttactggggagactgagacaggaggatcacttgatcttgggaggcggagatagcagcaagccgagatcgcgccattgctctccagcctgtcaacagagcgaggctccgtctc

SEQ ID NO: 246613 - DNA, 411 bp, Homo sapiens
gcctaggggctaggatgtgatggacatattctataaacacaataaatattataaaacagagtgaatctaacctacacatgctcagcttggagtaattaaaaagaaagaattatatatatgaacattcaaatatttagaaggaattataaatatatgtgtgtatgagtgtgtgtgtgtctgtgtgtgtatatgcatgcacagagaagaatatcagtttcaaagcagtctgtactgccttgatattggagatattgcatcaactttctgcccaaatactaattgttaatttggttgattaggtcttgatgggtaatcctgtggtgctggtttcaagtgaccataatttagaatctattgactctaagtttcttcaagtaatgcctgttaaatcttcccccccaaaaaaaagaa

SEQ ID NO: 246614 - DNA, 456 bp, Homo sapiens
ccccctcccatttctccactctcatctgcctccctctcccccaatagccacagtgttactattattgtcccaaatccccaagctttcccatcccaggacctttgcacaggcagtttcctctgccttgtcctggctttttaaatgacaggcttcttctcagtttaactactttcctgctgggtggggtggctcaagcccttaatcccagtgactggggccaaggcaggaggattgcttgaggccagaagtttgagaccagcctggacaacatagtgataccctgtctcttagggaaaaaaaaaaaagttacgaaattaagacaccacaggtgtgtggtggcatgcacctgtagttccagctacttggaaggctgaggcttgagcccaggagttcaaagctgcagtgagccatgatcgcaccactgctctcttgcctgggcaacagagcaagactccc

SEQ ID NO: 246615 - DNA, 253 bp, Homo sapiens
atttttgcagagggaatggatgctgttaaggatgtcatgaccggctgttgatgcccagaagtctggttgttcaaggcactatctgagactgaagaaacacagactttcccatcggttccctgaaactccccctcccttttgtctagctgcacaaaaactccctgcttcacctttttgttaagacagatttgagagatcttgccctcctgccctcttgccttggtcaaattgaataaacctttctctatctcca

SEQ ID NO: 246616 - DNA, 400 bp, Homo sapiens
tccataatccccggagaagcagggaacaggttctgtgggtggggtttgggctccccagcctgctttgcccagcaggggtgggggcagtggccctcatgagtccagacccccaggaagcagctggaaacatccagggggctgggatgggagtagggtcccccagatggccaagttttctccccttagcaaggcacaggtagtcatgcttccctgtcgcaggcaggcggctgcactgccttgctgtaggctccccttcccccctaagcaccaggtcccatcatctatcagacagccccaccctgttgtgtttttctgtccactcactccagcactggctggatggggggtttgggcccccaggaggcccagaaggagcccgttggggtctgcctgtctggtg

SEQ ID NO: 246617 - DNA, 433 bp, Homo sapiens
aacaattaatgagcttgcagacatgctatttgaaattacacagaggaaatggaaaatgaattttaaaaagtgaagcacacctacaggacctagaaaatagcctcaaaagggcaagttattggccttaaagagcaggtaggatagggttagaaagtttattcaaaggaataaaaatacagaaattcccaaacctagagaaaggtatcaatataaaagtacaagaaggttatagaacaccaaacagatttaactcaaagattacctcaaggcatttagtagtcaaactcccaaaggtcaagtatgaggaaaggatctgaaaagcagcaagaaaaaaaaaataacatagaatggagaaccaatacatctagcagcagagttttcagtggaaactcaaaagccagaagagagtgacatgacataaagagctgacaaa

SEQ ID NO: 246618 - DNA, 482 bp, Homo sapiens
ctcctgtagtcaccaaccctggctccagccagaccctcccaggcctctgcaaaagctgcagctcagcgaccacagcccttgtaggaggaagatttctttaacaaaaaaagcatggagcacccaggctagcatggccctcggagatcgtccaggccaacacagaagcccagcccaaagaggagagcactcagcaggctacagacacaggccgctctgcaatgttcgtggtggctccttaagagagcctctggtacgtgaaatggaggaagaaaaccttccagcgtttggcccatcactggcagcaaatgaaaaaccagactctgtgacacattaatcatggagccagctgctccttcctcatccttgtcagggctgtgctaagtgcccatcagccataagctgcttcatgagccttctctgagcacaggttacccaaccaggattggtggctgagaataaataaataaataaataaataagta

SEQ ID NO: 246619 - DNA, 459 bp, Homo sapiens
gaaagaggctatctattacggggaggcagagctactcctggttccttcttttaaatgtaatctatgagaaagccatcttcacaacgggaaatggcatcccccactgcaaaacgcacgactgtcattacctgggaatcaatatatttttttaaaccaaatatatcattatcaattgattttcctttttcctcttagcactccagagtcccgggtagcaggggaaagctttaatgtgatatgaaggatttggacaggtaaataagttattgtaaactcattctgccttatggtcagcttccctctgacaacgcaacgagtctttctcagatcctctcaacctaagcttttccagcggccgctgatagagatgcacgtgatccatatcaaatagccattttcaagctgaaggtggcaaaaatattatttttctcaaggatagaatgttctctttacgactaa

SEQ ID NO: 246620 - DNA, 329 bp, Homo sapiens
ctagcagtgagcaagactctatgggcatgggatgtgccaagccaggcatgggagggtatctcctggtctaccggttgctgagaccatgggaaaagagcagtatttggtcaggagtgtaccgtttctccaggtacagtctgtcatggcctcccttagccaggaaagagaaatcccccaaccccttgtgcttcccgggtgaggcaacaccctgccctgcttcatcttgccctccatgggctgcacccactgtccaagcagtcccaatgagacgaaccaggtacctcagttggaaatgcagaaatcacccatcttctgtgccaatcttgctg

SEQ ID NO: 246621 - DNA, 269 bp, Homo sapiens
gtaaagaaaatacaagactcatacgtggaaaactacaaaacattgttgagaaaaattaaaaacaagctaaataaatggagagatatcccaagtgcacatggatttcaatattatcatgatggcagttctcccccaaattgatttattaacctaacacaatccctatcaaacacccaggaagctttttttgtgagaattgataacctaatttaaaaatatctatataaaaatgcaaaggatctggagtagccaaacaattttttaaaaga

SEQ ID NO: 246622 - DNA, 595 bp, Homo sapiens
acacgctcccccacttctttccgtcctccagtctttcatgttccttcgtcccctccatccccccaaaccccaccctttcccttcaatcccaatcacataaaaatcttctaattgtattttttcaaacagacatcgagacattgatacaacaccttccaagataaagagacaagtgcgtcctgccacaagtgtgtgtgagtgtgtgtgtgtgtgtgtcacgatcaaacacgcgcttcatccctcagacacctctgggaaaaaagctgactggagatacccaagataataacgaggagctaaacctaatttcagcggaaccaatggtcccagcaccagcgcccaacatttacctttccttttcgcagtatgtaaccctttaaggtctcttgccagctcaagctactcggtgctcccatgcacccgcccagttagcaccccatttccaaatgctctgcaacctaccacatcttcgccgcctccctcggccaccgcacaagcagctccccgcgagcgccgaagcctcccgccctgccacccccgcccccggccggcctctggggtcccacacctcgcgcgcctacggtcgccgcggccg

SEQ ID NO: 246623 - DNA, 905 bp, Homo sapiens
ctgagattgagtctcgctctatcgcccaggctagagtgcagtgccgagatcgcagctcactgcactccaacctgggcaacagagtgagactccatctcaaacaaccaaccaaaaaaggaacatacatcgagtaaagaccaattttatgttacaaatacataactgatttgtaacagttctaaaaatatataagctgacaggttttgagaggtttcattagaattataactatttaattagaaaagtaaaattcaagcaccaatattgatttgtaatcattttaataattatcaagaaccaaaaaagggtaaaaatatctagcccctccaaataaggaaactagcaaaaaacaaaaagggataaataagcattagtaaataaaaatagggacaaaatcgttttagtgaatgtaaaaatttagcaaataacaaaatcagatgaaaacaaaagtttagattcattcaattcatctatgtattagagaaatacttgttcttccacttatggaattacctaaacaaaatgttgttgtatgtatctgtccatgcactatagaatacaatatttttaaaattatccattgctttgttactattagtgttttgttttctctttatttgcacatataaaccagagttgactgaaatctaacttaattctttgaaatcacttctcttttccctaaacagagaatattaaggaaaacaaagacagtggatgagtctcctaggtgtccaatgagagtgtgacctttcgctgctctgaaataggtcaatagtatgtcaaggttggaggatgagtggtgagtagtacaacaccaccatgaccagattaacttcagtgctgactgaaataaaaccctcaccagggactaatgctataggccaattccttgctttttctct

SEQ ID NO: 246624 - DNA, 372 bp, Homo sapiens
atacacatgaaaacccccaaggggaatccccatatcacagtgtagtgtgatatttgacattcgtgatcatctagagatgtacagaaaaggtgaatctgtgttctgtatattctgcctaaggcaaagaaatgtttagctctctttaaaatagttccataattttttctaaaaagctttgcttgaaaactgtaagcttcccatatctggagcatttcactttaaatatttggataaatatgttatcttcttacttggacatttcatgtgtttagggattgtcttctaaattcttcctaattcatatagctgctaacacttcccgcagagctaaaccattacagatatgaaataaagacctattgatttgactta

SEQ ID NO: 246625 - DNA, 330 bp, Homo sapiens
caaaaactggtttcagcataaatttcattcaaacagaattttcctaggtatatacgctctccccagaggctataaaataatgtattttaaaccgcctttaccatgggactaattttttagaattacatacaccctttagaatgttttaaaaattattatttaggacatagtgttagtttgtggtttggtggcagttggggaatcaacaattaaataattaatttttaactagtacttctcattccttagttagaaacctaactacctgctggagatcaccaatgctcatcagagaatctgtgacactctttctttcttagaatgacaaaa

SEQ ID NO: 246626 - DNA, 423 bp, Homo sapiens
taactcccacatcttccaagtaacacatctttttcagtacttgaataaagaaaatttggccagatgtggtggctcacacctgcaatcccagtgctttgggaggccagggtgggaggatcacttgaccccaggagttggaggttacagtgagctgtgatcacaccactgcgctctagcctgggtgacagagcaagaccctgtctcaaaactaaaaaaaaaaagtgtatgtgtgtgtatatatatatttctgtttttttactagaagcaaatgtagttttaagatattcttattgtctagatgtgtgcaatgcaacattaataaatattagtaataaattttaagccagaagagcttacagaatttgccataataaaaataaagtatttcacaaagcatgaagtattacctactaagtagaatct

SEQ ID NO: 246627 - DNA, 490 bp, Homo sapiens
cttatcatgaaggaaatacataataatgtaatataatgtccaaaggcagagatcaagtgaagccaaaaacatacatcaaaaatttagtgtcaccaattttcctgtcctgatatatgaatctcagctcagcgaattaacatattccctaccttttagactggcccttgaatattgttagagataagtgtccttagagatagagaatagtgtccttagagacagagaagaaaaaattattatgcaactttaaaaaattcacagatgagaaaattactcttcttgtcctagtgagggcgttcagtgaatgttcatataaatgcttatatgtggtttctggctctatgagtatttcccatgaaacccatagatgtataaaaaaagtagaaaatatttcaaataatactgacctactggaagtactttaatgctaagtttagattagttggatagcctataagtaggaatagcaaaataagtgcctataaaagca

SEQ ID NO: 246628 - DNA, 431 bp, Homo sapiens
aactaactggagataaaagatagctagtaaaatttgttatgtacgctgataatggtctaaagttgtctgtggtgattaacttttgtcttcctgtaagagagggaagatggaactcttctgtgcatttatgtcctgtttttaggaagggcagacagatttatctgtttcttttcaattgccttcagctcaaaataatccttatgccaaagtggcatatttcagggtggcatattctgctagggtccaaagggctttcagtaaccatgctggtcatcagcgaaatgggacacttagtacctccatgaaaaaaaaaaatccagctgactacactcatttaaaggaaatatactcatttaaaggaaatcttatgaaaagcattttttttaaaacttttattggaaagaataaagaccgcacatccaaaaaataaa

SEQ ID NO: 246629 - DNA, 477 bp, Homo sapiens
cagggactcgctatgttgcccaggcaggtcttgaattcctgggctcaagtgatcctcccacctcagcctcccaaagtattgagattacatgagccactgtgcctgacccttagagaatcttgaggctaagaatcaggggtgaccctgatcaagttccacatgacaaatctctccactggccttgggagcaggtgggaccagcgactggaccttcaatagaggaagaatgacatcaagggcattttggtgaagagccaccaaagagatgtgaccaacacccagatgcccttgcacacagcttggcacttacctggatactcaataagcaagctggctttggtgccacttaaaaagcttaaccattaaaaactacagtataatgtagtataataaagaagaataaaggtgactgctcaaagaagcaaacgaaatctccctcccactcatcctttttctgggcagactaaggatgtatcc

SEQ ID NO: 246630 - DNA, 475 bp, Homo sapiens
taactttagattcatttgtctcgactgtactgtgtcttcaaccatactgaatcttttttggttcttagatcagaacaagttccttctgggcttacatgttccttcagtatgttcgctatgtctgaggcactgtcctttggttgaaataatccttcttatcctttatgtgttatttcaggtgtcagttggggatttcgtggtaccccatgggtgtctgcctgccggtctctcttttctaccaggttgtaatctgtgtgagaggagtttgtcgaggtcatagtactatcttcagtaccttgtgctgttagtacggtcattaaatgtataaatgcagcatgggtgctccttgggctccctagatgaacaaatagatcaagttattaatattaaatgcctgtaatcccagatacttggaaggctgaggcacgagaatcaagaatcccttgaacctgggaagtggaggttgcagtaagcc

SEQ ID NO: 246631 - DNA, 291 bp, Homo sapiens
cacgccccagccacacccttgaacaggaacctttagtggagggcaggataggggtttaacaaggatccactgccctctggcatcaaccttccagggaggggcggccacttcccccgactcagggcagaggggcactccttcacctcctttccctgactttccatggccctgggggtgcaggggtgaggctgtgaaaacgtgacccatgggggaggggagtactgaggcctggaccctcccagattcctccaggagttcgaaactgctaaaacccagtgccaccagccacca

SEQ ID NO: 246632 - DNA, 408 bp, Homo sapiens
ttggctatagtttgtcaacccctgctctctagaatattctcagcccccgtgagtttccctcatacccctcctggtcagtcccccaccagtgatacctctcctcacttcaaacatcatgcattggccaggcacagtggctcacacctgtaatcccagcactttgggaggccaaggcaggcagatcacttgaggtcaggagttcgagaccagcctgggcaacatggtgaaaccccgtctctactaaaattacaaaagattagccaggcgtggtggtgggcacctgcagtcccagctatttgggaggctgaggcatgagaattgcttgaactcgggaggcagaggttgcagtgagccgagatcgcaccactgcactccagcctgggcgactgagagagactgtctcagaaa

SEQ ID NO: 246633 - DNA, 458 bp, Homo sapiens
ataaactcagtatcattttttgatatcaaatttagttatcaatttagtactagaaccaaattacttcacaaaccatagtctgttgtgaccaacacccctggcagaaaatttagagtagctctaactttgggcagctggagaataattaagatgctttttgatatgctggtgatgaaactaggtggtcttcagaaacctccctgaaacaaaggctgattcccacaccccgaaatgtcaccagagcccgagtctgaggtgggtccacagctctcacccagatctcttgtctccaccaaaaagagcacttgcctggctatcatgttctgttactgtttgtaaaggaaaaatagaatagaaatgcaacactaaattgcccgtgtcactgagtagaaagtgtgccaattatagtgcagatcaaagttgatttttaataaaaggcttgtgtttaggctttgata

SEQ ID NO: 246634 - DNA, 340 bp, Homo sapiens
atttttagtagagacggggttttcaccatattagccaggatagtctcaatctcctgacttcatgttccgcccatctcggggctcccaaagtgctgggattacaggcatgagccactgtgcctggccgagaccagtgaaatatttgtcacagttcacacacctagtaagagctgcactgggatgtaaactcaggtctacctgactcagcacccacatgctccttttggtagccatgcaacttcttccaccactttttcaggatattagactcacagaccgtcagagctggatgggatctcagggatgatctggttccagcaatctggtttgacagattaaa

SEQ ID NO: 246635 - DNA, 619 bp, Homo sapiens
ttctgaacttgtttcctgttgggaagggagcccacaaattggggtaatttcagcccctcctgttgacagggtgtcacttcccactggcacctgtgaccctgcagtttcatccacctcttttcaactcctcaaacctgaggcagccctcagaactcacagccaagggccatttacaaacctaaggcaacgtttggagactgggaggggctgtaattcacagggcagaggacccgggctcctgccaccctggaggagtggcctagagcctcaggtcacactgggtctcccaggtgtgaggagggcgccttggtgcgtttgcttttttgggagccctacatttctctcatctgcgattctacagttctagaattgtcgcagtcctgccgttcatcctgtgtccctccagtgcacattttattagtaattcttgtttatactcttgctgcttaaattctagtgtgccgagaaagtttttctgatttcatcgaaagaagaaaggcacacagttctaccatatgacagatttttaacagatattctaaaaaaaattaactttccactgttttaaatgtactagttgtcattgtttcatataattcgtaaaggatttctgaagccc

SEQ ID NO: 246636 - DNA, 237 bp, Homo sapiens
cgaaggctacacaagaagtagaggactccatgtttctggctgaactgaaagccctcagtctttctactgtaccatgctactttctgagtggctattttttagatttattttctgtcctggcccgtatcttattgattagtttcttgcctgtttgttcctaatgtgagtgctttagcaatttaacagacactaaaaatatattcttccttatcctgcttccccaccaccaccaacaac

SEQ ID NO: 246637 - DNA, 430 bp, Homo sapiens
atcctcccacctcaggtaaataggtgggactgcgcccagctttaatatacatttaattagaattacaaaatgagtggagcaagaatggtgcagaagcaatatttgaagagataattgatgatcattttctagaactgcagaaagatgaatttgcagattcaaaagtgtatagccttaaagaaaagctaaaagctaaaaactgagcaagcatccatcttgtaagtcagatcacattttgtaagtcagagaaaacacagcaaaataattctgaagaagataaagagaagctaggcatggtggtgcatgcctgtagtccaagctgcttggaaggctgcaatgggaagattgcttgagttggaggccagcctgggcagcatagtgagaccccacctaccctgtctctaaaagaaagaaaataaagggaaagaaa

SEQ ID NO: 246638 - DNA, 613 bp, Homo sapiens
aaaacacattccacagaggaagctagctttataagaatagaaatgcagtctcaggtacctagatttccatgaggtattatataaatttagggatctttcgggagttctcttcttctcttcagttttttattggttttcagaaaaatatgaaattttaaaattatacttattaacatgaaatgttatcctatgcacttcattacttgctatataatagaaattatacataacacagaaaaattatgtttcagttctttacataaaatggttcatagcataatgagtcaaaacatgactgttttccattattccttatatctctagaactcaatatttaacatattgaggtatataacataaaaggtatacagccctttacagtctaagtactttcagttatttaatgcacaataaccctgtgtagcaggtaatacactgcacagaggagaaactgaagctcaaggaggttaagtgagttttcccaggtagcacagtaggaagacagactcctgattccaagtcactattttgttaactacatcagagcagcatctctgaattaacagtttctaaactacattaagatttatctatctataggcttggcacggtg

SEQ ID NO: 246639 - DNA, 522 bp, Homo sapiens
catactagttcatgtttcctatctcataaatagttttattggttttcagaaaaatatgaaattttaaaattatacttattaacatgaaatgttatcctatgcacttcattacttgctatataatagaaattatacataacacagaaaaattatgtttcagttctttacataaaatggttcatagcataatgagtcaaaacatgactgttttccattattccttatatctctagaactcaatatttaacatattgaggtatataacataaaaggtatacagccctttacagtctaagtactttcagttatttaatgcacaataaccctgtgtagcaggtaatacactgcacagaggagaaactgaagctcaaggaggttaagtgagttttcccaggtagcacagtaggaagacagactcctgattccaagtcactattttgttaactacatcagagcagcatctctgaattaacagtttctaaactacattaagatttatctatctataggcttggcacggtg

SEQ ID NO: 246640 - DNA, 561 bp, Homo sapiens
aaaacacattccacagaggaagctagctttataagaatagaaatgcagtctcaggtacctagatttccatgaggtattatataaatttagggatctttcgggagttctcttcttctcttcagttttttattggttttcagaaaaatatgaaattttaaaattatacttattaacatgaaatgttatcctatgcacttcattacttgctatataatagaaattatacataacacagaaaaattattgttttccattattccttatatctctagaactcaatatttaacatattgaggtatataacataaaaggtatacagccctttacagtctaagtactttcagttatttaatgcacaataaccctgtgtagcaggtaatacactgcacagaggagaaactgaagctcaaggaggttaagtgagttttcccaggtagcacagtaggaagacagactcctgattccaagtcactattttgttaactacatcagagcagcatctctgaattaacagtttctaaactacattaagatttatctatctataggcttggcacggtg

SEQ ID NO: 246641 - DNA, 790 bp, Homo sapiens
ctggagctgctgcctgagccctgtccagacagccgagatacactggatgttgggcagtgctttggctggacattgaaatgctgcatctgattggctaatttagtttccatttatatccctaacaaggcaagggaagagagaagccagcttctctcttgttctccttctataatgagagacaaaccatgcctctctcagacactcacaatggagaattcctcaatcctaagaaaggtggatcggttactgactgtgacagatgactgtcataactttcatgttcacggaaacttctttataaagtttctaaatgaaacgaaaacttggctaccaacctactctagtaacgcaacaacttgcccctctgttcttttgagttctggcttctgattgtttctcaccacattgtcaactccttgggaaagtactctgtatgttttaaagcaaattgccagggtttttgtttgtttgtttgtttgtttacttagacctcgggagataaaattaatcgacctctttaaatacatggaggtaacccctttctcgtttttgaagggagacacttgggaatttagaaattgggagtgtgagttctaagggctggtgtggtttagatagcccatgacagtttcaggaaggtcctggtttcctttcaagcaaaaggggccacctctgaaccaaagtggattatctcctgcagcagcaaatccagttggcagttgaattcctgcagttttatgggaatttcagtgaaacttttaaagctgtaatttttgtaactggagttaaa

SEQ ID NO: 246642 - DNA, 861 bp, Homo sapiens
ctatctgtagagataataatagtatccatatagtggggttattaggagaattaaattgaataaatgcatgtaaagtgtgcagtgcatggccaacaccatcctcaacacaccctagtgccagcacctgcccagtcccattctgcagctccacctccatctcaccggctcacagaagacgctaaacagaaacacaggaggcaatgcatttactgcaggacttggatatctccagtgagtgtagcattgtggctaagagggtaggcttcggggcagacagatgcagggcctaatcccagctctgctacttaccagctttgtatcctgaacaagttacctatcaccaccaagcctcagggtttctcatatattaaatcacacttaattttagaaatgttctggggattataaagtacttagcatggggttgtcacagagaaggtcctcagtaagaagtgggcattttcatcacaggacagagtgagacatactctagaacagcccagtctgaaagctttgtgtgatgatgtaaatgttctatatttgcactgtccaataaaggagtcactggctacatgtggcgcttgaaatgagcccagtgtcactgagaaagtgagttcttaaattttattttattgtgattaatttaaatttaaatctaaatagtcacctgtggctaatggctactgtattgcatgtcacagttctagaagcatggccagaggcttcctgggtattcagaaaggaaaaggagggctttcagttgggaaaggctcaggaagaaggcaacatgagctggggtcttctctgagcaggcttcttaaaggtgaaaacactccaacttgtggaagccctggctgtgct

SEQ ID NO: 246643 - DNA, 461 bp, Homo sapiens
gatgctgagttctctaaattgctttatgtgagatgtaacacaaaaccacatgttcaccactacaggaatagtgtggaaaaccaggtggtaataagggtctgccaaccaagacaaggaactccagaaaactattattgatgatcacagcaaaacctctgcagaaatttcacatctgctgaagcccatggcatttgcctagtactgccaaaggaaaaaataatgtcttctggtctccattccaccttcaaaatcatgctccagtgcaccttgttgttagaacataaattgtattctattccacagagtcaagagaatctagagaatttgatttctaaattcccagctccttcaaaacagaagaaaccttagaagggttttgctgcttgcaaaatgaaattaaacctgcacacttatttctgttctcttaataaagactttgaagagattaattcatgatacct

SEQ ID NO: 246644 - DNA, 311 bp, Homo sapiens
ccaaaaattgccacgacatttatttgaagtggaaatgtgtgtggattcaaacacatttggcttggaaacttggatgatagcccagagttgaagagcccacagctccctgcgttctggcctctggggtggtaccgctggtgtgtgttagagggtggattcctgggcggtggcccctggtgtgaaggggtaactcttctgtgtgggtggatagaggtcagtgccttcccagagaacctgcagccatcccctggggctgacatcaagagcctgggctatggctcaggcactgtgctagtcaaaggtatcatgga

SEQ ID NO: 246645 - DNA, 342 bp, Homo sapiens
taaggttccaatcgtaatcagcatccaactgtctgctagcaaaccatttctaataattaatttggccatcacagagaaaactgtcacgttccacaggagagatgtgaaggcaagctcttgcatgacagctgcaatgtcatcaattggggggacggttccgagcgtgtctccagagggaagaattcagggtgctgagatgatttaagccacaaataagcccagggcgcactggcactggggcctgttagcacggcagggacatggccacatctcagagagtgcgcttgtccagcggtggccaccatcagaactaccatgggggaaaaaataatcacacaattg

SEQ ID NO: 246646 - DNA, 264 bp, Homo sapiens
actaggctagcactatacactgtcttgaaagtggaagctccagggttctgtttaaaacttatcaccttcaaatgttagcattgaagtcaccttaaagatcagatccagtggttttcaatcaggggcatatatgagaatcacttgtggagctttgttctatcccagacatattgaatctgaattttcagaaagggggttcagaaataatattttatttaagttctgcacgtgattctgatacccactagtggttagtaaccacaa

SEQ ID NO: 246647 - DNA, 749 bp, Homo sapiens
atccagagctaaaaggacctggctctgactaccccctgctttgtttttaaccaggcaaaaagagctgctccggaggccaacagcgaagagccccagcctcagtgaatgtccatgctcactccggggcctcctcccctgtgcgtctgcagggcttgcacttcctgtgtgagtgtctggatctctgcccccttcccagaccccactctgtgacagcagggacatgcctgccacacgccctacttactgcatcctcaggctggcacgggggtgggcacaagaggcggaagagtgtggggcacccaggtcgggagtggggccgcctgggtccaaatcccagcacagccactgacaagctgtgggatgctgggcaaggtaatgagcctccttgaacctgaatttccccatctgtaaaatgggactaataactgcacatactccaaaccatgaggaggattcaatgagctacctagcagcactgagaatgctgcccggcactcacaggctactgcgctttcgccaccgttatcactatttgttgaatggattaatggcagcctagtttcaacttcctggaatagtgaaaattacaaaaaaggaaactgcaacctagagaggcaaagtgacttgaactcagatcctgagcctctcaggctggggctctccctccattaccctccaactcctccttgctggactagacacgagagcagggccttggcaggatgaggtccatctgctgcctgtgggcc

SEQ ID NO: 246648 - DNA, 580 bp, Homo sapiens
cctcttcctcctcctcttcttctccttcttctcttcttcctcttcctcctcctcctcttcttcctcctcctcctcctcttcctcttcctcttcttcttcttcttcctttcttctttcttcttcttactttttttttttttttttttttttgggagatggagtctggctctgttacctgggctggagagcagtggtgtgatctcggttcactgcagtctctgcctcctgggttcaagcgatttttctgcctcagcctcctgagtagctgagatttcaggtatgtgccaccatgcccagctaatttttgtattttttagtaagatggggtttcgctatgttgaccaggctggtctcgaactcctggtctcaaatgatccgcccacctcggcctcctaaagtattgggattacaggcgtgagccactgcacctggcctgtgttacttaacttctccttgccttagtttcctcatctgtaagtggggatagttgtacctatttcatgactgtcgagaggatttaaagactcaattcctgcaatgcagttaaaatagcacctggcacttagctcaataaaagctg

SEQ ID NO: 246649 - DNA, 332 bp, Homo sapiens
ttggcttttgtgaatagtgcttctatgaacacaggtttataaatatctattcaagtgtctgctttcaaatgtttgtgtatatccccagcaagagaattgccggatctcatgctaattctatttttaatttttggaggagctgttatgctgttttccattgtggctgcatcattttatattcctacaaacagtgcacaaaagttccaagtgctccacattcttctggttttttttaatagccatctggttttttttaataggtagttacattcatttttgcacttggaaaactgggggcaaaaaccaagggcatggcaaagtataaaatgtgt

SEQ ID NO: 246650 - DNA, 356 bp, Homo sapiens
gctgattttttgttttgtatttagtagagacagggttttgccatgttggtcaggctggtctcaaactcctgacctcaggtgatccacctgccttggcctcccaaagtgctgggattacaggcatgagccaccgtgcccagcctgttcctgatttaaaccagccactctttcactgaggagagactcaaagagagacccagcttacaagagggaaatgatcttggccaaagtttctgtgcagagctccctgacactactcataactttcttcacagtctggggaaacagacaaggctttcagttcccaaactaagaaagcactaaagctccaagagggaccagaaactcggcccagc

SEQ ID NO: 246651 - DNA, 461 bp, Homo sapiens
cattgaatcatctttgttccttcccttgccccacaaactctgcctatttccagcatttatttcttggaggatggaagagaggacagaaagtgacagaaaactaacaggagagttagtggcctggcatgtttccaaagggtagaaaaacaaagagaaggacattggcaattcctgctactagcaacagggttctactgagaagtcacaaatgtttagttttccttccctggacatgtgattaggctaacatttttctacctacttgaattcagataaaccctaagtgacttgctatggcataaacgtcatctgaaaagatcaggattaccccactgtgttgctttccaagttccctatcccttatcactgcaatgaaatgttccttgtcctggaggcatcagcctgggtccctcagaactcttgatggagagatatcatgggtattctaatcccacccacca

SEQ ID NO: 246652 - DNA, 453 bp, Homo sapiens
ctgtccttctccttccaggagaacagcatttctccttccctgtagtttccgccaactgaagtcccacggctcactcccattggcccagattgggtcacgtgctgggccctcaggcagtcactggctagagggaggagatgctatgattggccaggcctggtcacgtgttctttctcagcccggggcgaggtcagccttgtcagaagagcctggactaaggaggggaggctgttaccccagcaggtgcagggggtccagagggtcccaccttttacttagagggacctcctcaactgccttggggtggggaggaagggcggaggttgtctccaagcccccttacagcacaggtagggagactgaggcccagaggcagacagtgccaacccaaagcccttccagggtcatttcggctcatctccccaaaggctggatggggtctgtgtctggcag

SEQ ID NO: 246653 - DNA, 295 bp, Homo sapiens
agaaaactagcaaatagtaactattttgagtttttacaatgtgccagacactgagctaactattctgcaagtttttaattctagcagaatctgtgatataggtattattattattccagttttacagactggaaattatggttcagatttattcaatcaatttctgggagttacttaacttgaagagataaaggttgaacttgaacccaagtcagtttgcttataaatcaattttcttaaataaatcaattttcttaagcacgttcctaaataatagccccaggccaaaaaaaaa

SEQ ID NO: 246654 - DNA, 395 bp, Homo sapiens
  misc_feature (253)..(253): n is a, c, g, or t
  misc_feature (304)..(304): n is a, c, g, or t
cagcgctcagctctgtctcggccctggtgtccatctggtgtgactgggccgtttcaccccaggctcctcctctccaagctgccgtctgcacagccagcacgcagcttggatcatgggagcactccctgcctggaaccgccagcaggacccccaactcacacacagccccaagcccctgagtgtggcagccagacccccgagggcgcgcctctccctgatcctgtctcatctcctgctcccagctacacttctntgatccccacaaccgagaccacttcacacagtactcccagcttcacttctncaatcaccaccactgagaccacctcacacagtactcccagcttcacttcttcgatcaccaccaccgagaccacatcacacagtactcccag

SEQ ID NO: 246655 - DNA, 363 bp, Homo sapiens
cagcgctcagctctgtctcggccctggtgtccatctggtgtgactgggccgtttcaccccaggctcctcctctccaagctgccgtctgcacagccagcacgcagcttggatcatgggagcactccctgcctggaaccgccagcaggacccccaactcacacacagccccaagcccctgagtgtggcagccagacccccgagggcgcgcctctccctgatcctgtctcatctcctgctcccagcccaccccctgccagctttagtgcccatgagctggctcctcgttcagaacgtcctcctccctcttccgggtgcccactctgtgcttgtccatctggcaattcctgtctcccttgtaagacc

SEQ ID NO: 246656 - DNA, 561 bp, Homo sapiens
  misc_feature (517)..(517): n is a, c, g, or t
agctttggccatggggtttacctcaccctacttttacgcaagagtatgtggtggcctaacacaggtgggggaccctgcttcaataccagcctttatccacagatgaccccacgccttctgctccagagcatcagggttataacacatgggacacacggggcacacatacactcccacgcaacatccacacaccccacaaaactacctgagcccacatagtcagggcagggacaggcacagaacaaagtgggtgcacagggactcgcagggaggtcgaagagctgagtctcgtcgggaggctgagggggaagagcgggcactgggctgcgagtgtgcagagctggaggtgggggactgcggtaagtacccgtcctggggtgcgggccctgctgggaagcattgggagcaagaagggttagatcctcaaaggaggataattcttccagaaggttttctttgttttgttttgttttgttgaggcaccaagattggagtgcagtgagcagagatcaagccnctgtaccccagcctgggcaacagagcaagactctgtctcgaaaa

SEQ ID NO: 246657 - DNA, 457 bp, Homo sapiens
taaaaaaaaagaaaaagtttgtacctatatacccttttcatacatctcttatttgttactagatctccttgtcaatataaaaacttaattacttaggtatatcctaacaaaacatattccttaaacattcttaaaacagtataatgacttagttttttaattaccgtaatgaagttgtaaaagcccatgtttcttattttaagcagagagtgccttaaaaaggtttaaaatgcatcctgccagttttaaatagcagaatttattgataccatatatatagactgaaaacacatcaaagtctttcaaggttgattatttcttgtgccttccttcttcccacagtaagagagaagataaagataatactgagtaaaccattccatgctacaaattggacccattcgacaaaaatgcaatacttagtagaacatctgatgaccatggtcctattcgtgtt

SEQ ID NO: 246658 - DNA, 500 bp, Homo sapiens
agaaatggtcccagcatatgtccatcgtttgattgcaagactcataaaccataaatattacttataagaaagacacagcaacagttgggcttaccactaaaatggtggttctctttcaagatttttagttcctctgtaacatgaagacaatgggaaataaatttgtattaacaattaacagtaaatacatccttagcgtctacaatgggctcagacctaggccagttctccaggacacacaatggaagcgttaagcataatgccattcttaaagaaattgtaacccactgaggaacgagactactatcattcagtgagtactttctgtatcccaggcactttgccaggcacatgattattttaagagtcagaaattctaggtacaaatccaggctctttctataaataactgtgtcacctttgactaaatcacctggtctttctggaattaattcctccgtatgtcaaaagcattcaataaataatcagtaaatctctcg

SEQ ID NO: 246659 - DNA, 1863 bp, Homo sapiens
taaacaaatgagcatggctgtgtttcagtaaataaaatttacaaaaacaggtggtctgttggatttgacctgcaagccataatttgctggcccctagtttagcagttaaagatttacatacataatttgaattaatattaattataccaagttggaaacattgaaggacacatacagtgttttagggaatcttaaactttatttttattctctaaagttttagtttgtgttttctgttctcaagtcttgaggaatgctcacagattatctttctgctcatctctgaagggtttagcacttttgagcattacacatgaactgtcagaaaggacctgagtgccttagtgtgaattaatagctgtctccatgtctaagaagttaccatcattgggttttttcctccaggctaaactcccatcttccagcaggctttgagtgtctctgtagagtgagcaaaaacatatcagtatacataactatttactactaagtctttggatctttagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaaggtcagtgatttctttcagaaactaaggcatagcatgttcaagcatttaaaggtagaaggcaacaggaacagcgttaaaaaaaaaaagattaatattttatttggagaagatagttacaggtggactagacgttttaaaggaaaatgatgtatttgacccatttttgaaaactgaacgttgtacatgggtcattaaaaagaattgcattttaactgacaaaattaagtgggaaacaattttgtattttgagagaggttgatataaaaattatttctggaatttaaacttgttcactgaactcagttgccttttttctaccccctctagattacaaaaccattttttgcagccatatcagatgaaaaagttcagcagaagcttttaagaatgttgtttgatttattggtgaactgtaaaaactcacattgtgctcagactgtcagcagtgtttttaaaggggtaagctgcaaacttcttgtaattttttttattaatgtttatagtctcttccaagggacaccatgtttaagagtcctgtattttatagtgcttgtaagaggtcagatgttaccattaacaaaaatcatggaaaagtaagtcagagagaggcataaaataaaaattttaaatctttaccattattttattttatgaagtatttgttgataattttaaccagataggatgtgtaggaatatgtgtgtgtgtgatctttctcatattagacggaatctacctattcctttatgcaaggaataggaatgagtcaatggctcagtattgaactgggtaacattattctacttaatttaaatagttgtttaatgacatataatggaattgaaattctgcttgttggttttatacgtatattgaaaccttgttattatcagaatagccacctggttattctcttttttgaatatagaataatacaaagttctagtatctagattcagcagttctcagaattttaacatattaatcttttttccttctttttctttgctgaaatattttaaagtaaatctcataatgtcatgcactttcatccctctgtacttcagtgtgcatcttttgaaaagtggatatgactacaatgccattagaagta

SEQ ID NO: 246660 - DNA, 544 bp, Homo sapiens
aaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagca

SEQ ID NO: 246661 - DNA, 395 bp, Homo sapiens
aagcaaacaatttgggattagaagaaatgagaaatactttaacaagacaggaaacagaaatccagaggggtaaagtaaccttcggcaaggtcacttcagggtaaaatttcttgactcttactccagtgtccttcaccatcttgatccatctcaaattaacatttgtgtataatattagacaggaattaagcctcatttgtttccatatggatattcagttgtccagcatcctttgctgaaaagactttccttcactcattgaatttttttgtcaaaaatcaactgactgtatatatgtggatctatttctataaccactattctgtctcattgtgtttattcttataccagatacgattctgtcttgatccctgctgctttagaataagtcctta

SEQ ID NO: 246662 - DNA, 475 bp, Homo sapiens
tcaggtgttttagctccagggaggaaatagtcacagtgaaaatctatttaataaaaccgttatgaaaatgtactcaacctgagcatgcactggaacagcagaagatgaggacttggtctactgccttcccaccaaaccttgccggctctgtaaattttcagagctgtcacttgtgagctatttccaccaagggagagcttctgtaaagttggggacttggcaggccatttcgctaattctttgggtgttcttttagcattgtctgcagtgagtgtgggagtcaaaggcccttcagtgcagagataatgccatcttgttccctggaaccccgaaagagccagagtcaaaggagctttttgtttcactcatagaaaaacccacaggaaatcccagcttcagatattcctattcagtttccttgtcccttcagatctcactgtgtttaggcctcctttgagtgaggcaataactagta

SEQ ID NO: 246663 - DNA, 881 bp, Homo sapiens
aaggccagatactttagactttgcaagccatacagtctgttgcagctactcaaatctactgatgtaacccaagcaatagacatataaaagaatgggcgtggctgtgttctaataaaactttatttacaaacacaagtggcaggccagatttggcctgaagcccatagtttgccaacccctgatctcactatctcctcactccttagctctccagtcacacctctctttcctcccatacttttttccacctcgagacctttgtctattctgttctctacctagactgtctcagtttaaatgtcctttccacagagggcattcctgaagtcctaatttaattaaaatggtttctctattttatttttatgatttattttatacttatattttaattttctgtaactatacattgatttatgtgattatgtgtttaatgcctgttttaccttcaagttgtaaggtccatgaattaagaaattggatatcattgtatctctagcacctggcacatagcttaatacacagtaaattctcaatgaaatgtttgttaagtaaatagtgaattaatgagatctgatcaaaacaagggagcagaaaacaaaagataacaatttgggaatctgagatctgaaatatgagatgcttttcttgagttcatttattcctaaggtaggtcattttaaaagttctatacttgaaatagggaatatgtattaaccagggtgatgaataggcatgtcccaaatcttactgctacaaaggcgcttgtggctgacacactgtggcttacacaaagtcagatgcaggttgagcagctctacttcatctggtagctctgccacttggaagataagccccaaaagtcagcctggaaataggaa

SEQ ID NO: 246664 - DNA, 571 bp, Homo sapiens
ttagcaacatgaggtaactttctcaagaccacatggctaaaaagtggaggcatgacttccagctacagcactgatatagaatatacagtttcagatgataagttttagatgatgcttttaatggaaatttggtgacatccatacaagttctcgtcttcatctttttgccttttctttttccatgggattttgagtgaggattttcatcttcaaagatgttagagacagaatgttcaaacactttaaaaatttaacattaatttaaatttataagaaacctaaaatagctatttcctcaagttgttatttccaactctccaggtggactccaaatcactacgtaatcatcgagaaaagacttttattagatatgttcctgctgggtttagaaaatcctatatcttctgttgatacagcaaggtcagcaggaatctttaatatttacaaaatgaaaggagaacagctagttgcaaaaacttcctagtgattccattcccctaaccctaatctcaagggaaagacagcacaactgtgttacctgctgtgaactttgcagctacctgccatacct

SEQ ID NO: 246665 - DNA, 937 bp, Homo sapiens
caagggaaaaggacactgtaagcacagagcatgttcatgtggcagcaagcggccagcctgggtgtagttccacaccacgtgttgtaggagataagcccagctggggctggatgtggatgggcttgaagaccaaccagaggatgctcctctgtaggcagtggagagccactgatgacaacgtggagaatttaaagaagaatggagacagggagagcaaggagaggagcaggtgtggaggtgtgcacaacagtcatgtaaagaaccagctacaactgtagtcactcactcatgcctttgtttgtccacagacatagttattatgcacaaaacctcatgccgattgaaggtgggataagacagatggggagaaaacaaagaaaaataaaacccagtttatgtggaggattttaaatcaagggagagacagacaccagtaaaacccgagcacattcttccttgaggggctgctccagtgcctggactctcctctcatgccacaggacatcccaacatgacttcagattgccctattgcctcaaacatcagctgtatgatgaagattcccaaatccatccccaattccaatctctcctctgagtcatagagctgtatatgcaaacgctcaactgcacatcccaactggctgcccactggcacctccaactcaatcaatgcaaatgaaactcatcacctttccttctcatccccaaccctgcagctccacttgtgcctctggtctcaatgcatatctgccagcctcatccactgccaaagcctgaactgggcatcataggtgcctgagctcctgcacccattcatgcaatctctcaccaagccctgtcatcgtctacatcttttgtgtcttcccctcagtgactaccctaaattgggccaccaactaatctccctggcttctgttttactctttcaatctatg

SEQ ID NO: 246666 - DNA, 406 bp, Homo sapiens
tgggctgcagctgcacccaacaagtcaacatgtggattgcttctagaatttggatattatgaacactgctgtgctgaacattcttgtacacttatatggtttggctgtgtccccacccaaatctcatcttgaattgtagctcccataattcctatgtgtcgtgggagggacccaatgggaggtaattgaatcataggggcaggtctttcccctgctgtccttatgatagtgaataagtctcatgagatctgatggttttatacatgggagttcccctgcacaagccctcttgtctgccgccatgtaagatgtgcctttgcttctcctctgccttccaccatgattgtgaggactccccaaccatgtggaactgtgagtccattaaacctctttcctttgtaaatta

SEQ ID NO: 246667 - DNA, 553 bp, Homo sapiens
aaaatatggtacaaccatacaatgaaatattattcagccataaagaagaatgaagtattgatacataagagaacatggatgaaccttgaaaacattatgctaagtgaaagaagccagacacaaaagaccacatattagttgattccattaataagtcaatctacagagatagaaaatagatgataatttccaagggttgggatgatggggaatatgaggtgatagctaaacggcacaaggtttctttttgaagtgatagaatatcctaaaattgtaatggtaatggctatacatctgtgaatatactaaaaaccactgagttgtacaccttaaatgggtgaattgtatggtaggtgaatgatatctcaataataaagcattaagaagaatgaaaccattccacaatcaccctcctgaggaactcttagcactgcataaagtgttctgagtttgtaatcagatattgtcacactggttccttcaaacagacatgacaaggagctggctttgggctaggctgctccttgcctatgattggggaaggttaaacccc

SEQ ID NO: 246668 - DNA, 471 bp, Homo sapiens
gtctgcaggtaataaaatgggaaattgctaaacacacatccatcttctgagcggtgctatcttaagtctaggtggaagccttcaaaacaggaacctggtcaattgcaaaccttcctcctaacccaggctcctcatccccagagccggctatgaagaaagatggtttgggaacagggaaagaagatctggttaggagccatcccggctgcttgtctcttaatgtcagtaaagacagggtttcgccatgttgcccaggctggtcttgaactcctgacctcaagggatccacctgcctcggcctcccaaaatgctgggattacaggtgtgaaccactgcacccagctgttttgaaaggggacacagaacagctggatgccaaagagatgtcctaaaacaaaatgggatagcccatatactcctaataggctggaggtggactgaaggaagaatctaacaacatttctggctcta

SEQ ID NO: 246669 - DNA, 393 bp, Homo sapiens
gtctgcaggtaataaaatgggaaattgctaaacacacatccatcttctgagcggtgctatcttaagtctaggtggaagccttcaaaacaggaacctggtcaattgcaaaccttcctcctaacccaggctcctcatccccagagccggctatgaagaaagatggtttgggaacagggaaagaagatctggttaggagccatcccggctgcttgtctcttaatgtcaggtgtgtgaaatcccactcagtcattgggggactcaacctccggttggggcaagtgctacttcagaaaccccctcacacatcctggcctctactcgtacacaatattttcttttttttaacttggctgcagtgaaaaagaatatttttagtaagctacttgttgttta

SEQ ID NO: 246670 - DNA, 406 bp, Homo sapiens
ctaacatgggggtcccacgtgatacagatgctgctggtccagatgtcaggttggccttagggatttaccaggagcatcattctgtggtcagaacatagttaaatacatagataagaccctgagggtttctacaagaggcacattttaactaatcagtgggatcttttctaatggtgcagaaaccctgggtataaaccttatcccagtacactatttctaattagcagtcaactcacccaccacagtccgtgactgctcatgtcggtgctctgtgtttgtcccaaggacatgctaaatccaggcgtggtggtgtttatgtagcagacagatgtactgggcattttccatctctcttggactctctgaaattcccttacttgaactggagggacaatagaagtaccta

SEQ ID NO: 246671 - DNA, 699 bp, Homo sapiens
gttgccgataaagacatatccaagactgggcaatttacaaaagaaagaggtttaatggacttacagttccacatggctaatgaggccttgcaatcatggcggaaggcaaggaggagcaagtcacgtcttacatttttaaaaccatcatatctggtgagactcattcactatcacaagaacagtacaggaaagacccacccccataattcaattacctcccactgggttcctgccacgacacatgggaattgtgggagttacaattcaggatgagatttgggtgggtacacagccaaaccatatcagagagagagagagaaattagatatgctctaaaaattataaagagaaaataagctaaatccagttcttccctattgggcttagaaatattagctcatgtctttccttcccattacagaagttggctgaataatcatgggtgcctgttgctggaattctttcctctctgtgaggtctgtctatagccttttttaccaaagaccaacaaagaggaaactgttgtcgttgagtgcagtgcgacatcagaacatcactggatacatgagatcctgtccacgcaaagaacctacgtagggccttggcttcgagtcaatattttgttatgtctgttcacttcaggaaagttttgaggccaagaatcaaagacatatttcaaggttgttgtaaatatatttc

SEQ ID NO: 246672 - DNA, 447 bp, Homo sapiens
ggcagcagaatcgcctgagcccgggagtcggaggctgcagtgagccgagactgcgccattgcactccagcctcagtaatggaatgagactgtgtctcaaaaaaaaagaacataaatggtatttgagatgagtcttaaaggatggttaaaaatagaaattaggctgagtgcggtggctcatgcctgtaatcccaactctttgggaggccaaggcgggaggattacttgagcccaggagttcaagaccagcctaggcaacaaagtaagactctgtctgtaccaaaaaataaaaataaaaaactagccaggtatggtggcacaggcctgtagtcccagctactccagaggctgagctgagctgggaggatcacttgttgaggctgcagtgagctgtgatcgcaccattgtattccagcctaggtgacagagcgagaccctgtctcaaaaa

SEQ ID NO: 246673 - DNA, 537 bp, Homo sapiens
tgctcaaacagtaagtttgaataagctcattcagatatgaggtgtggttgatttgggtaacatgaaacttttaagggagatacagaatttaaaatggctttttatgtaatataaacatttatttctcatactaatgtctccatgttttaggatttctagttattatccttaaaagttggttttgagtttccctatttttctctaaccttcttttcctacttttgtgtataactttgtagaaaattagcttatcataaataatttacttttaaactgccttttgtgttttgtggaagtgcccaaatttgttaacttttgaatcaaaaaaggaaatacagttggccttgaacaactttggggttagggctgccgattcctagtgtagtcaaaaatccacatgtaacttttgacatccccaaaatttaaatagcctactgttgaccaggagccttaccaatagcatacacaattgattcacacatatttcatatgatatatgtattgtatactgtattcttataataaaccaagtgagag

SEQ ID NO: 246674 - DNA, 4562 bp, Homo sapiens
  misc_feature (1198)..(1198): n is a, c, g, or t
  misc_feature (1511)..(1511): n is a, c, g, or t
gccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgaatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctgctgatagcacagctgacccaggagcacgccgagatccgtctctcagccttccagattgtggaggaactcttcgtcaggtctcaccagttccggatgctggttgtttccaacttccaggagttcctggagctcacgctgggcacagaccccgcacagcctctgccgccccccagggaggcggcacagaggctgaggcaggcgaccacccgggccgtggaagggtggaatgagaagtttggggaggcctacaagaagcttgccttgggctaccacttcttaagacacaacaaaaaggtggattttcaagacacgaatgctcggagtctggcagaaaggaagagagaagaggagaagcagaagcacttggataaaatttatcaagaaagagccagccaggcggagagggagatgcaagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgagccccgggacggggagcagncctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcagagggcctgaaggtgcaggagaacgaggacaaccttgctctcatccacgccgcccgcgacacactcaagctcatccggaacaagttcctgccggctgtgtgctcgtggatccagcgcttcacccgcgtcgngacccacggtggatgtttaaagcgtgccattgacctgaaggctgaattggagctcgtactgagaaaatacaaggagctggacatcgagcctgagggaggggaaaggcgcaggacagaagccctgggggatgcggaggaagatgaggacgatgaggactttgtggaggtccctgagaaggaggggtatgagccacacatccccgaccacttgcggcctgagtatgggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagtgccctttccatgggaagattgttccaagggacgacgaaggacggccgctcgacccggaagacagggctcgtgagcagcggcggcagctgcagaagcaggagcgcctggaatggcaggaccctgagttgatgagagacgtggaagcagccacagggcaggatctcggctcgtccaggtacagcgggaaaggcagggggaagaagaggaggtaccccagcctcaccaacctgaaggctcaggctgataccgcccgcgctcgcattgggagaaaagtcttcgccaaggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgaggccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttttgtttttccttttagagatgggcttttgctcttacccaggctgagtgcagtggcagaatcatggctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtggtttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttc

SEQ ID NO: 246675 - DNA, 188 bp, Homo sapiens
ctcagcagccagagattcatgggggtgacggcagagatccccatgaatctctggctgcctgagggtgacgccagagattcatgggggaagcaaaacttcccctcggagggtggagcataagtcgaggacactgattattctgtatcctgtgtttgtaaaatggcaatttatagattgtttatacagtg

SEQ ID NO: 246676 - DNA, 1111 bp, Homo sapiens
gccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgaatatggatcagaaactttcgaagttggtagaagagctcacaacttcaggagaaccccgactaaatcctgagaaaatgaaggaactgaagaaaatttgcaagtatgtcttagggttcagtaacagtaactgactggcccactgagcccaggacacacacagggccctgccctcctgcccccacctgggagagaaccacccgagggacacacccaggacattttctcggggccctgcagtacccggctctgacgggtggtcatgttctggggtcggggcgtgtggcgttggggaccccactgctctgtggttggtgcttctcttcattcccatttgtgtggtctggagcacatcctgtaggagttcttgagtgcacaaatgtgattcagagagaaacgtgcatctttttctttgctgctggacttttcgaagggaaagaatagagcttgctgatgggcgagttggtccatcgcctttagggtatgtccacctctgttcacttcctccaaggaaaacgccggaggggatctctgccgtcaccctcaggcagccagagattcatgggggaagcaaaacttcccctcggagggtggagcataagtcgaggacactgattattctgtatcctgtgtttgtaaaatggcaatttatagattgtttatacagtg

SEQ ID NO: 246677 - DNA, 1029 bp, Homo sapiens
  misc_feature (900)..(900): n is a, c, g, or t
  misc_feature (941)..(941): n is a, c, g, or t
gccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgaatatggatcagaaactttcgaagttggtagaagagctcacaacttcaggagaaccccgactaaatcctgagaaaatgaaggaactgaagaaaatttgcaagtcttcagaggagcagctgagccgcgcctaccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcagganaagagagtggagtatgcagtgctcgatgagttagaagattntactgacaatttggagctagatgaagaaggagcaggcgggttcacggctaaagcaatcgttcagagagacagagtggatgaagacgcc

SEQ ID NO: 246678 - DNA, 642 bp, Homo sapiens
cgcgccggttcggtccccggggctctgcgggcgccgggcagagacctgcggccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttcccagcctccgccccggcctcgcctggcgcttccttccgggtccttcggcctttccctggcggtgcggcaggccctcgcctcatcccaccaggcacgccgcggtgctcggccctgggtatccgggcaggctgcctccgttagggccgcccctgctctccggacgcgacttttcattggtctcagaatttcttggctcctcttggcctctgcagccttgctggaggctgccctgcggaatctgagtgaataagggaaacagcaacagtcacgttggggaaaagctgattcggacagcgccactggttcctttaacgcacgaccctcaatgcagcgtcccacacacgggattgtagaggtcccgagtttaaggttcacttttaaaactgcaa

SEQ ID NO: 246679 - DNA, 472 bp, Homo sapiens
gttacagtcataactttctacaattttagagtaggaaaatttaaaggttatatggtctggtaagcctcatgtgggtactggctatattctagcctcataagaggctttaaaaaactgtatggattcttcttctcagaatgtgatatattcatgcccaggattataaactttccctagttgaacatcacgaattatcataagagttgtgggtgggagataatcctgagggaaaagagttgttcagataaatgggacagagacaggaaaatattattgaggagcattaaattcagtcacttctatttgtaccttatatgactgctagtttggtccagtggaatcaggaggcttgaggaccacaagacagttcttggagctgggtatttttttctgaaattgctggaagtatatttatttgggggaaggttcaaaaaaaccttgttggaaaagaaagactaaggtcaaagctaaa

SEQ ID NO: 246680 - DNA, 446 bp, Homo sapiens
tcaggaagctcaggggctggggaaacagagaggaggagaccccatccagcctgggaggagggagtttgggaaaccggatgtcagattccagccactggggagttggatttcaccctctgtagtcactttcaagtctaaaatcccacgaagaactgaagttgggcagggaaattgaaagtaaaagtgaggaatggagaagtttctgtgccacatttgacgtgaaactgaaagtgatcatgtatgtgtccctcctgctcccatatgatctggcacagcgccattcagttttacagaagctgaagctcagtgcagtagcctggcttgccagaatgcactcttccttaacggctcacatttccatccacagcccaggtctctgccctcccagttcaatccctcaccccagtccgttatttttaaggcatataaaggaaaccagagacaaa

SEQ ID NO: 246681 - DNA, 409 bp, Homo sapiens
tctgcttcattcactgattatgccaagcacttagaaaaatgccagcagagattacgttgaataaattaagatttcagccgggcacggtggctcacgcctgtaatctgagcactttggaaggcagaggcggacggatcagttgaggtcgggagttcgggaccagcctggccacaatggagaaaccctgtctctactaaaaatacaaaaattagtcaagtgtggtggcacacacctgtaatcccagctactcggaaggttgaggcatgagaatcacttgaacccaggagatggaggttgctgtgagccgagatcacgccactgcactccagcctgggaggcagaatgaaactgtgtctcaaaaaacaaaaaaagaattaacaagattttttttttaacttttgtttgcatg

SEQ ID NO: 246682 - DNA, 332 bp, Homo sapiens
ctcagccagtgactcacgttttctttagcaaagtacttatgtgttcatttccctatattttaaaaaaaacctgagttaacagctgctttcagcagtcctgcagcctcctggatgatggctgttttcagctcctggattctgcagacccgaggagtctggggatggatggggaggggagcaaagaaaactttcaacccctacccgtctttagccagagaagctctgataccatctattttgtatactggagtcctcctttgaaaatatgttgcttgaaaagatgagttctgtggctcaaaataaaatttttttatttatttaaaaataattga

SEQ ID NO: 246683 - DNA, 260 bp, Homo sapiens
ttctttaccagtctttcagtatttgatatctactgtcaaattcagtattcagctttaggtctaggtcagcacttttcaatagagatataacgtgagccacatatgtaattttaacattcctagtagctgattttttaaaaataacataaatatatggaattaattttaatgtattttatttaacccaccatatttaaaatagaatcattttgacatgtcagtattcaaaaattattaataaggtactttacttctttata

SEQ ID NO: 246684 - DNA, 451 bp, Homo sapiens
acatgaagcaagttggaagagaaatatagcgtctccctgagaaggtactggaagttgaccaagaagctaatcaaaattttgtcttgattctggaaagctcaaagcactgaagcttactggttagacattaagaacatccgcctctccccacttcctatttcattagagtattagcattttctacactttttttaagtgcaagtctgcttaattgtgcaatatgctgtttagtttaacagcatctttaatgaaccatataatactactcaacagagcatagagaaattactttctggccagtttaaaatacagtataaaattctataaattggactgcgtgcagtgtctcatgcctgtaatctcatcactttggaaagccaaggcaggagggtcacttcatgtcagatcaagaccagcctgggcaacatagagagaccctgtctgtataaaa

SEQ ID NO: 246685 - DNA, 317 bp, Homo sapiens
tgggggaggatagcttgagccctggagttcgaggctgcagtaagctacgactgccacattgcactccagtctgggtgacagatcaagaacctgtttcaaaaaacaaacaaacccatagtaggaaggtgacatgtatatgttattgcaggcagctgtccctgcaatgtgagcccagggaagtgggacctttgttttgttccgtgctatgtctccggaacctgcccagcacagtgccaagcacacagtatctgctcaatgatgacctgtcgaatgcatgaaatttagaaaagaaaaacaacaaacaaaaacccttccca

SEQ ID NO: 246686 - DNA, 255 bp, Homo sapiens
taatcgcaggaatctgtgcacatacatgcaaacaagtacatgtaaaactggtgaaatctgaataagcttcatggattatatcaacgtcagtttcctgattctaacaatgtatgatacttatgtaagttgtcatcattgagacaaagcgagtaaaggatatgtgagatcttcgtattatttcttatgactgcaaaataaaaggtttttaaaactaagttataataacaaagaactctgtgtcaaaactaaaatata

SEQ ID NO: 246687 - DNA, 318 bp, Homo sapiens
atgaaaaaaaaaaaaaacaaggaaaatttgagaacctggcacagtggagaagagcacaaggagacatgatatctaaatatgttgtggtatcctggatggaatcctggaacagaaaattgacattaaggcaaaaaatatacaattaatgcgtgcacttgttaaatgaatgaaaatgtataataatggtgtgataattgtgaaaaaatatcccacatagtaatgtagaaagttaataaagaaaaccctgtgttggataaatatacatacactctctgtagtgacttccaatggttctgtaaacttaaaactattctaaaa

SEQ ID NO: 246688 - DNA, 515 bp, Homo sapiens
gcaaggcgaaaagggccacagcactggtctgccccaatctctgggagtgggatgcccccagcaccaggatggcctgcattttcaccatgaccttttctagtggggacaggcaaccccaccacttgaacagattgccactgagtccgaagaacccccaggccctgggtaagaccattcccccaaaacacccgagtgttccaaggcgatttattcctgctctccaggcccctcccaaccacctggatcagccaccccaccaaagagccaccagtagcaagtaaaagccactactcacaaagtattgtttaaaaatacacagccaaattagctgggcatggtggtgtgagcctgtggtccaggctactcgcgaggctaatgaggatcgcttgagcccgggaggtcaaggctgcagtgagttatgatcgcacctctgcactccagcctgggagacagagcgagatgctgtcttaaaaacaaaaacacaaaaaaagcactttgggaggccgaggcgggca

SEQ ID NO: 246689 - DNA, 541 bp, Homo sapiens
tgtcatttgtcctggaatatttcagtgattctcagacattgtgtcatttcgactgtaaataattcagtgtgcatctctgagcgattgagatatcatctgtagatctagttatgtatctatctatgaatgctacgttcccttccatccacctctctggccttgtcctctgtgttgaccctggggaagaactacctggactacctgggtctttcttcctgggattacacacctgccagctcaccccagctcactctgtgttgctaccacaggaatttgctggaacacagatcattcaacttccttggttgaaatcgttcagtaattttctgttacctccagaaacaccccaaatgcttccctgtgccatgcaaatcatttcgtgatttgacgcccacaagtcatccgctggcactcgatgccaaacgaggtgcgttcacggtgctgcgctcctgcgcgccgcttttcctgccttctcagaggctccggttgaggggagcggcccgggagccttggccgactctgactcctcctcctgcctctc

SEQ ID NO: 246690 - DNA, 564 bp, Homo sapiens
ggaagagttgagtgcataataaacatttgtttttttctatgggtgtaagagtcctagaagtcttttaaaatggaagttgcattgagtttaatgggaatcttaagcattataaggtgccactcaacttttgaaattaaatcatgagttctttgtgtcatcaacactaagattctaggtttttgttttttttaatttctgggtttctttaaagatgataggggcttaatattagaaaggaagctatacgttccaggttgttagaaagttagttgctaatatgagaaattagactgctaaatccacctacctagtgttaaccacccatgcccccctgttaaccagcctcattgtctgttacttgagactctctgcagtaagaaggttggatctagaaaagtcagtctcctcttttgtgcacatgttttctctccttctgtctctaaaaagacatatgctgaattctggaagccgcagtcccgtaagattagtattggttcttagcaataggttatttagctattgattatacttttcctaggttaagatggccctcgtgccgaattc

SEQ ID NO: 246691 - DNA, 450 bp, Homo sapiens
ttatttcctgtagcttgactacaacacaaatgaatccactcaaatgttggcaagtggagcagagtcccagaacagtctgcaatctctacaggtacagaaacacccccagttcaaggatcttcacacctggatttaggcctactcctgcaactacccgcgtttcatttcaacttatgtttaaggggttcttgataatctgacatgataagtggtgttggaattggcattaaaatccaccatgttctacaacacttcatccttcttcggcaggcaccaatttgatcttctactactttgcagacatctcttctgcaaacaccagacaaattgagacaatgaccttccacaggacccaaatcacctcttactgcaggaaagaagatccagtgagaaaattagtccacaaatggaatgtaaatccataaacactcttaagtaacagaataaaaa

SEQ ID NO: 246692 - DNA, 227 bp, Homo sapiens
gcttaggcaaaatctcctccttaagagcaagttcccccttcctcctctttcttcttctttttttaatggtttgctggtttgaggaagattctgtggacctgcagacgtgccagggaagaagccagaaagtctacctttgactctaaaacaagaatggtcgataatcactcggacctcacttcattttagtttccaaattaaaaataataaaaaggtgcaactttaga

SEQ ID NO: 246693 - DNA, 2482 bp, Homo sapiens
  misc_feature (1074)..(1074): n is a, c, g, or t
  misc_feature (1209)..(1209): n is a, c, g, or t
  misc_feature (1698)..(1698): n is a, c, g, or t
ctttatttacaaacacaggcagtagcttgccaaccccctaactagagcgtagctgtcactttgagacctgagtaacttctctgtaggattacacccttgcaagaattctgcccgcagcatttccgagtttgcattataaccttgtgggcagggcagtgaaagtactgttatataggaaagttaccgtctcctaggaattttgttttaagaaaaagattctaatactaaagtatgacatttgttgaatattttttattggcagtaggaaaggaaaattgaaattacatacaggaactccaaaagcttgctcgtgctcatttttcttctattacagattgaacatttaatgataaatgtgggtggggggatttaatatttcagaacagaaggcagagattaattttattttgccccctaaaatgtaatacattttctctctcttcttgccccctgccctgccctttcccactcctcctctctgtccctttgctgggatagggaaattgactgtaaggggattatgggtctatgtgggagggagagataagagggtctcagcaaaatgccaccttccaaccctgctatcgctgtaagcagtagggaaaggaaggggtaggtttatagctcccaacccatgatcaactagttctacttccttgattgtttgatcatggtcaatctgtagaggatccatttctgaagagctttgtttaaaacggccccttctctaaacaccttagagttttgcacccagtgccccggatcacccgctggaggccacagaggacaaacgctagttgcagtgtttgtgagctgcctttgctgaacagtagtgcgcgtgggaagcatcagcaattatccacctgtttctcaccatccctttccaaactgacttttactcattcatggccatggagatatatttgccagtctttgtcaattcatcagtttttttccaggaagtccttttcttttaaatgctatcatatgaaggctgcccttgctttaagcatttttgattgttcttattaaaatgaagaataaccccttccttctctcctaccccacactccntggaggtttaagtgagcagaaaatggtagtacgataaaagatccatgtaggtgggtttgcagaaaagttaatccaagataagtaacagattgaaaatgtaggcttctgactatgctagtgcaaaccgagttaaanggatcgattagagtttactttccaatatgattttgatgaatggtgtaacattgtgaaaggctttttgaagacaaaaccactaacccgttgtattgttttgttttgttttgttttgttttgttttaagagacagggtctcgctctgttgcccaggctggagggcaatggtatgatcatggctgactgcagcctggaactcctgggctcaagtgattctcccacctcagcctcctgagtagctgggattacaggcacacaccaccacacccagctaatttttgtattttttttgtagagatgaggtttcaccatgtttcccaggctgatctcgaactcctgggcccaagcgatcctcctgcctcggcctcccaaagtgctgggattacaggtgtgagccactgtattttaaaatacagtttttaaaataaaaaaactgtattttaaggattcaatttgaatttgtgtttagatccatgctaaggcatgcangcaattgacacacggaccctgggatatgcggtgtcctgtctgactgattgattgatttctttcttttttttttttttgacagagtctcactaggtcaccaggctggagtgcagtggcacgatcttggctcactgcaacctccgcctcccaggttcaagcgattctcctgcctcagcctcctgagtagctgggattacaggcgcacgccaccacgcctagctaatttttgtatttttggtagaaatggggtttcaccatgtttgccaggatggtctcaatctcttgaccttgtgatctgcccgcctcagcctcccatagtgctaggattacaggcgtgagccagcgcacccagcctttttttgtgtgtgtgtttttagtagagatagggtttcaccatgttggccaggctgatctcaaactcctgacctcaggtgatccacccacctcagcctcccaaagtgctgggattacaggcatgagcctgatttacaggcactgatttctgacaatacatccttactatatatccaaaacttacctgccctttgaaacccagcctgtctcacctctacaaaaacaaacaaactaccttcctaaccattcctacgatactattctatttctgtgaattcttaaaatctgcttgaacagcccattttgacatttgattctctgtgtcagtgtttattgtcttagatttaccccctgcatgcagaagtgactgcatagtcactacttttagtgagtttgaaatctgtttggagagctatgtaagtaccaatgg

SEQ ID NO: 246694 - DNA, 320 bp, Homo sapiens
agatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaa

SEQ ID NO: 246695 - DNA, 597 bp, Homo sapiens
tagcatacatcaccctgaattatagctgcctgtttatgtatgtgtcttctgcaccaggtagtactctctgatggggcagggattgggtctgtcttgttcacagttgcatctccagcacctgcaactctgcctggctcagagtaagtgctcaatactttttgtttttgattgaatgatagaatgacgagtgaactctatttcccactagactgtgagcaccatgttgacagggaccatgccctgatcatctctggatccttagggcctatatagtgcttgccacataggaggtgctcagtagacacttatggatttgagtgaatggacttcagtttctccacttacaatctgagtaagaggaagatattctttgccctctctccctccttctccagccacattgggggttgtggttgatgctgtgaggtcgttcctgccttattcaacttcatgtccaaatcttctatggctagccaagtatgggagaagggtgcttcagggtctctctccattcactttagtctccagcattagccaagatcccactgtctaccctgaattcttcctgctattgcacaaggtttctttcatcttact

SEQ ID NO: 246696 - DNA, 399 bp, Homo sapiens
attattgcaccatagatattaacacgaatatatttttaaaaactgcccagagatcatttgatctcaagtgtatatacacttcacttttctggagttacagaaggatggtgaaataatcattttctggattttgcttttcagagggagattgaagaaagttcaatagaacactgatgagctcataagaaccgtgttgttcatgtttctttgtaattcagtttgctgtttttattcttattcctttctaggaagtacattccacaggcttctatggaaattaagttgaaataaattttgataattggcctttgatgcaaaatttatgcatagcatttaattttataacattttgttttattctgtgattaaatatatatatgtatatgttttaaagtctta

SEQ ID NO: 246697 - DNA, 441 bp, Homo sapiens
ataactatgtcctctgggccctgtcttctctctcgccacttccgtccccaactgaggaagaaagggaagggtgagtgaggagcatcctcatccctgccctaggggacctagggacttccttctgtgcctgacctctagaggtggcatggaagaagagtcccacagcagaccctggggctctgagcggagctcctccagggccatccttgtcatccctggtgagacctattgaaaacacatgtggccatagaaatataaattcagcttaaattaattaagattcagtacatttagccgggcatggttgtgtgtgcctggaatcgcagctacttgggaggttgaggtgggaggatagcttgagcccaggagattgaggctgcattgagctaggattgtgaccctgcactccagcctaagctacagagtaaaaccttgtctcta

SEQ ID NO: 246698 - DNA, 973 bp, Homo sapiens
agatggagtgtattgaatgctcctgaaacaaataaattataatttttttttgagacagggtcttgctctgtttcccaggctggggtgcagtgacacagtcatggttcactgcagcctcgatctactgggctcaaacaatcctgccacctcagccttccagtgtgctaggattacaggtgtgggccactgcctctagacaataaatatttttttatgatggatatgttggatatgctaattactctgatctgataactatacattatgtgtattgaaatatcactgtgcatcccgtaaatatgtacaattattaaatgtcaattccaaatgtccataaataaagtttaaaaaaagagatatgagctggggttttcattggtaaacaccaaatatgggtaatgcagggtttttcacccttagcaccttgaatcctgagcctttcttaaacttctatgaggcaatctggcttcttatcagcaccaactttgaatttcctcctctctgctaaataatttacgattcttccatctgctttctctatctatatactagcgatataaaaggttttttctagtttaataaaaaaattgagtttgtgttttggtttattcttcttgtggtttaggagcatttttagagataagagggaagaaatatttttattccaccacctagggctggattttagagacatttttgtgggaagtttaagacaggaaagagaaagatgtgggaagtatggtaggcagaattctaatggtgtcctcccatgattcttctcccttctttattcacgcaaccactaatctatgtattaccacaagggaactttgcaaatggaattaaggttactaatagggagattatcctggattatctgggtaggcccaagtaatcatctgagcccttaaacatagaaaagaaaggcagagagatgtgtcagaggacaaggcaggagagatgaggtagaagg

SEQ ID NO: 246699 - DNA, 800 bp, Homo sapiens
ttaacggagtctcgctctgtcgcccaggctggagtgcagtggcgtgatcttggctcactgtaagctccacctcctgggttcacgccattctcctgcctcagcctcccgagtagctgggactacaggcatccgccaccacgcctggctaatttttttatttttagtagagacggggtttcactgtgttagccaggatggtctcgatctgctgacctcatcatccgcctgccttggcctcccaaagtgctaggattacaggcgtgagccaccgtgcccggccaacagttgttttttaatgtctggttttgaagtctgccatttctgagagaagccctttcatttttaagggacatggtcttgctatgatgcccagcctagaggtcagtggcttttcataggcacagtcaggacactgctgtctcagtctcctggcctcaaggggtcctctcgagtagctgggactgtagatatgcgccactatgcccagctcattttggtcaaatattaaattccaaaggcggattaactctgagtccctttgttctaaatttggggatagttgaaatatatttctgcaaggagagtggaaaatttgagatggcggctttacgatctgagtgcgatgcctccagtgttgtgcctttgcttcctgagtctgagcgtctgccagtgtggggcattaccttaatatttgccctggacatttaaagttttgacccacagggtacatggctgcttgaggaaattagaacataatggttattttatgaagtttgggaaaacatgagtgggcactgcgt

SEQ ID NO: 246700 - DNA, 439 bp, Homo sapiens
ttagaaaatacctgagcccagagtagagttttaaagagtggaaaggattgttttgttttgttttctgtttgttttttgagacagggtctggctctgttgctcaggctggagtgcagtggtgcccttccggctcacatcagcctccagagtagctggcactacaggcataaatggaaagggttttgaagaagaaggactaaaacagtgtcaattcaaacagcctttggatttggtggagaccaccagtgatcttagaacaatgcctacagtctggaggagtaagaatcagatggtgtgttggtgatgaacaaatatatgccaatgatatagaagcagcaaatgtatatatttttctttctctctttttttttttttaaagaaattagtaaatagaaggcggcagtttaaggaataactggattaagggcggttaaaaagt

SEQ ID NO: 246701 - DNA, 464 bp, Homo sapiens
ggaaaatccaatgttttggcttgggaatggtacagcatgcttcggaaaggcagtacttactcagaattttccctttcctgggctcaattatgttacacttctctctagcctcaaatattttattgggacttcgagtttctttcatttacatgcggttccttgattataccactcagattcttctaaagacccttcaccatccctcctgggaggctgggtaaaatggcatcctcctagtgatggtcaaagcaaggtcccattggcttttggttgccctgagagcgtagaaggacagtgtcacatttgccctgttctgatcaggtactatacctatcttgtctttagtatatttaattgcttcctctccactaaactgatattattgtttttttaatgtaaactttttattaaattgtatatatagaaatcttacatgtttagctcagtgatatttcataaagtgt

SEQ ID NO: 246702 - DNA, 564 bp, Homo sapiens
ggagattgtcagttagtaacattcaagcactcactgtgtgccgtctaccattctgagggcctttacctactgcagtcttcacgataccccatgaggaggcgctgctgctctccctaccctcagatgaggaagtggaggctctgagagctcaatgctgcggtgctctgggtcacaccgtcttgcaggtgatatggtcagagtaagagcccaggactctctggccctggaaccacagctcttaatcactcccctgtactcctccctctaaatgcaattttgggccctcctgccatcttggagctaaaaatatgataaggcaggaagctctgtttcataagaactgccatcacttctccctccttgccccaggtggggttggcatggagtttgggtatccagtagaggcattgctttgcaacagcccactcagctctcctacagggcctcaggtgagagccaggcttgggcgcccatgctgcccatgctgcacggacggtgtctgcttcaccatgctggtctagggcgaaaattgggtccagaagttctctctggaaccccgcaggg

SEQ ID NO: 246703 - DNA, 510 bp, Homo sapiens
ggagattgtcagttagtaacattcaagcactcactgtgtgccgtctaccattctgagggcctttacctactgcagtcttcacgataccccatgaggaggcgctgctgctctccctaccctcagatgaggaagtggaggctctgagagctcaatgctgcggtgctctgggtcacaccgtcttgcaggtgatatggtcagagtaagagcccaggactctctggccctggaaccacagctcttaatcactcccctgtactcctccctctaaatgcaattttgggccctcctgccatcttggagctatccttgccccaggtggggttggcatggagtttgggtatccagtagaggcattgctttgcaacagcccactcagctctcctacagggcctcaggtgagagccaggcttgggcgcccatgctgcccatgctgcacggacggtgtctgcttcaccatgctggtctagggcgaaaattgggtccagaagttctctctggaaccccgcaggg

SEQ ID NO: 246704 - DNA, 1178 bp, Homo sapiens
gggaaatgggagcaaggtctcagccccgcactgcaggggccgtggcaggtgggggcagcggtggaaatagctgcgtttctgaactctcaggtcactgccaccctgtgatgccttctgatggttttaagcaacaaagaagcaccaaggaagcaggaggccgaggagggctcccagtgagggcccctccgtgggagagagcgggttgtgagagcctgggaagttcacattcccctcaccccatgaggaaactgagacctgccctgagccccagccctgtgcccttcccaggggcttgtgtgagagcggccactgggcacctgtagagtgaaaaggatgcccaggggctgggtgggccgcttgctcaggaggaaatgtacccccaccccagtctcagcacaactgcctggcacccccatcctggtgacccagggtggtctctggtgggccctggtcctggagggctctgggattcccccaccagaccctgcagcccagggtggggaggggcaggtccgagacctcctatcccccgtcattccccacctctgacctggccctcacctttgactgaccctccgaggaagaacaacttgtgtttatttctgggggtcttcgtggtggtcagcacctcaccacacaggaggaatccttctgtctctggggggtcaccagcaacgctgggacaagcagcagagggtggggggcaccggcctcggcgtgtggccctcgggctgtcctgcacgggcctctcagaccggtagcaagctctgctcattcctgagcgacacccaaggctgtcactgttagagggaagccctcagtgcacagccagttcccagaccctcccccgcgctgtgtgcctggcgtccccggacccagccatgtcgtgggcacctggggcaccagctgacctgcctgtcgggggaggcaggtctgagccccaggtggtcccggtgggctgttgcctgccatggagaaggggctggggcttgcactcagccactcaccggggccatgcacgtctcctgccctttctccacacctgcgtcccctacagactcctgctgccgtgtaatggacagtgggaccctctggtgaggtgtccccctcctgcttcgggctgcggccaccatgtctcaggtttcctggatgaactcattaaaatgaagcatagagca

SEQ ID NO: 246705 - DNA, 445 bp, Homo sapiens
ctttacaaatactatctcaagccaggtgatcaaggttaacatcaacagtgataagtcataatgatagtatgtacccttcaaattatatgatgagaatgccatcttacctctctgtcttcctcccaaaaacatattaaccatgaggaaaacatcaaattccagttaaaggagattctacaaaataggcctgaccagtaatcttcaaaattgtgaagatcaccaaaattgtcaagatcaccaaaaatctgaaaaacagtcacagtccaggggagcctaaggaggataagaactaaatgtggtcccagacaagatcctggaacagaaaatgaacactaagggaaaactaaggaaatatgaacaagtatggattttagttaataagaatatatcaatatcagttcattaattctaacaactgtaccatactaacattagatgctgataa

SEQ ID NO: 246706 - DNA, 384 bp, Homo sapiens
agccccacttcctatctaggtgagaaaaaatgttctcagtagcacacactgagagctcatctgttttctttacgtgtgggtttcttaatgccagacatttggtcttaaatccttcttggaacaaggaaagataccaatcaatatataaatgagtataaataccagcaaaaatgcctggttcatgatcactgttcaccaagcaccctaacaaagtaggtggaggatcatctccctaaagcaagttctttcatctgtaaaatgagcaggttgaactagatagatcagtggtttccaatcttttggttccctgggccacaatggaaggagaattgtcttgggccacacataaaatacattaacactaaggacagctgatcagctaaa

SEQ ID NO: 246707 - DNA, 358 bp, Homo sapiens
tctgggttccagtgattctcctgcttcagcctcccaagtagctggaattgcaggcacacgccaccacacctggctgatttttgtattttttaatagagacagggtttcaccacgttggccaggctggtctcaaaaactcatgacctcaggtgatccacccgcctcggcttcccaaagtgctgggattacaggcgtgagccaccatgcccagcctaacctagtattttaacatgagctctgggagcataagaaaattgtagaagcaaggaaagaacgatataactcataaaaggaaaaactcagaaatgatcaggtaaaataattagcaaaaataaaaggtcaggtgaaagaattcagg

SEQ ID NO: 246708 - DNA, 499 bp, Homo sapiens
cgtgaaggggatcaagggacggctgaacagacttcccgctgctggtgtgggtgacatggggatggctacagtcaagaaagggaaactagagctcagaaaaaagtgctcaggaactctggtcaaaggaacaccactagaaaacactgaaggaggcatgtcaggtggttctgcttctccatggctccctacgatgaatgcctagagagggtattgacatggcaacctgatgccagcacatctgtccacagctgccattgcaaggatctaccttggtgccctctaaagaaattctgaattttctgagaacaagaggtctagtcccatatgtggaagtcttttctgtatgtctctgagtagaaagtgagaattgatatgccaagggatgagtaatgagcctcatcttgatgcagagtccccaagaaccaacttttactgaggagcatgcaggcaactttataccccatttgacaacattaaacccaaaagaagaaaatcaaaa

SEQ ID NO: 246709 - DNA, 293 bp, Homo sapiens
ccagtagccccaggtcatctgcttgccaaaaggagggggaccagcccccggggggagcccagagctcggcagggctggggttagtaagaagagaaaacagggttagtaggggctgggttagtaagtcagagcacagcaccagcggacagggcacctcagcagacacacacaggagtcgctaagagaaaaggaagaacgcacgcaggtccgttagtttgttaagggatgatcggggtgcagttgaggcaccccaggggttagacgggttagtaatcgaacaaaagagctgccta

SEQ ID NO: 246710 - DNA, 748 bp, Homo sapiens
gggatccaatcgctagtcctagggctttccaactgtcttcctaggaccccttcgagggcagggtaaagcagaggctgagggtctcagcaaatggctccccagggcagctgactttgccctgagccactctgcatggttttacctatggaaaaagacccttcggagactggcttcttccagaaagctttaaactacagggcccagtccacccagtttatatatgtggagaagtaacacaaggctccagcagattaagtgatggcagaccagaagacgccactggctcctgagccacctgctctcacactttgctaatcagcagctcccacgtgccaaaggcagtggggtaggggactggccttgccaccgcgactctattatgtttcaaagccattggttttatttgcttctctattgttccagtgatttgtttcaagtaatcatcaaaataccaacgaaattgcaggttagcaaattttaacgttatgatgggccaagagttgattgatgggaaaccaaacaatagtgtcacacacttgctatgaagccaacatatagcacacttaaatccccttgttctgcactgtgaaaaagtttctggaaaaagcaatgaagaaggggaaaaaaactgaaactttgaatgccttggattaaccacgtggaagagctaggaacagaattagatgagccactgaagaacaggtaggtaaccgttaaaagatcccgtttaggaaattatttcatcatt

SEQ ID NO: 246711 - DNA, 500 bp, Homo sapiens
cgatttgactacgcggctcgatctgactacgcggcccgatctgactacgcggctcgatctgactacgcggctcgatctgactacgcggctcgatctgactacgcggctcgatctgactacgcgactctattatgtttcaaagccattggttttatttgcttctctattgttccagtgatttgtttcaagtaatcatcaaaataccaacgaaattgcaggttagcaaattttaacgttatgatgggccaagagttgattgatgggaaaccaaacaatagtgtcacacacttgctatgaagccaacatatagcacacttaaatccccttgttctgcactgtgaaaaagtttctggaaaaagcaatgaagaaggggaaaaaaactgaaactttgaatgccttggattaaccacgtggaagagctaggaacagaattagatgagccactgaagaacaggtaggtaaccgttaaaagatcccgtttaggaaattatttcatcatt

SEQ ID NO: 246712 - DNA, 588 bp, Homo sapiens
ttattattacatattttaagatccattgtatttctttgactacaatctgtttgtcataccctttacccaattttccagagttttaaaggttttttttttatggatttgtgggagtactctgatttcttcttaaatagtttaatttccatgttctatcagatatcctactatcttttcaaagtaatgatttagtcaatttttttattctaataataagtaatcatcaagggctaactccattacaagggagtgcatatgtagaatgtgtgaattgatttgcagaagtcttgaattcctgaaaataatttcacaagactgccttatgcctatacctattccatttcgtttcattttcctaacagccttgtgaggcatatagtattgttaactacaaagtgaggctcagagaatataaacgtccaggatcacacagctggtaactcttccacttccaaaatcttaaaatcctagtaatcatcaccactagccattccaattacactaagactgattcttgatgtctctaatttctaataaatggttgctcttctccttttcctactacaaacacccaatgaatatatatat

SEQ ID NO: 246713 - DNA, 145 bp, Homo sapiens
catatgttcattgagtaaatatttattgagtatttgctatggtccaggcactgtgctaagtattgaggataaaatggtgattgaaacattttcccttcttgattttaacatctacaaaataaaaagtatgttaatatcattgatt

SEQ ID NO: 246714 - DNA, 489 bp, Homo sapiens
gctcaatgaatcctgaataagtgaaccggcagggagggtaacagtaggcccttgcagaacagttgtaaggaatcagattatcagagccagcatgactgtcaccaagtaggtgttcgataaaggaggtggttattatagctggatcatttttccttgggggcaagaagaatgtattaattattttaaaggtgatactgttaagattatgaactataggccgggcaagggggctcacgcctataatcctagcactttgggaggccgaggtgggcggatcacctgaggtcaggaggtccagaccagcctgggcaacatggcgaaaccccatctctactaaaaatagaaaaactagccaggtgtggtggcgcctgtaatcccagctgctgggaggctgaggcaggagaatcgcttgaacccaggaggcagaggttgcagtgagccgagatcgcaccactgcactccagggtgacagagcaagactccgtctca

SEQ ID NO: 246715 - DNA, 508 bp, Homo sapiens
ccataaatttatcctctcacagtcctggaaaccagaagtctgagagtgacatgttagctagggtttttcttttcttttattttatttttctggatactataagggagaatccattccatgcctttctgctagtttcttgcaactattggcaatccctggtgccactgggcttgtagacacagtccctgcctcagctgtcacatcaactgacacagtgtatgttttctttcctgcccttctcctataaagacacttgtcactggagcaaaggcccatacaaatcaagtatgatctcatctagatattcttaacctaataatatatgcaaaggctctttacccaaataaggccacattcacaggttacaggtagacataccattttgatggtctaccatctgactcaatacagtgagtcatctggaatttcctaggatgcagggcttaggaggacatgtgacatcaatgcagggggtcgggggaggcggtaaaagaactgatggaaaaaa

SEQ ID NO: 246716 - DNA, 309 bp, Homo sapiens
ctgggtacttgtgggtaaatcgtccacactgtctgcttccaatctacttaagcaagtggttgtaaaagtcagatgactgcataaagcacgagttctctctaaaaggagtagactcagaagagaaagcagttggcctccgagtcctgcgtgagggaggtaatcatctctcagaaggccctgcatgcaagccagaaaaatctctgacttcaaggatgaaaagtaaaataacactgaaacttctgacttcgtttcactgcaggccaggatgcatgtaaatacactttggagactttaggattttctatgtgg

SEQ ID NO: 246717 - DNA, 349 bp, Homo sapiens
caaaagattattaaagtctactatgaacacctttatgtgcataaactagaaaacctagaagagatggataaactcctagaaatatacaaccctcctagattaaaccaggaagatatagaaactctgaacagactgataacaagcaacaagattaaaattgtataaaaaatattgccaaccaaagaaaatccaggaccagacgaattcacagctgaattctatcacacattcaaagcagaattgataccaatcctattggcactattccacaggataaagaggaaatcctccctaaatcattatatgaagccagtataaccctaataccaaaatcagggaagaacataac

SEQ ID NO: 246718 - DNA, 520 bp, Homo sapiens
gatgaagtctcactttgctgtccagggcggtcttgatatcctgggctcaagtgttcctcctgccttgatttcccaagtgccaggattataggcatgtgccaccacagctggcctaaagtttactttctaaataagtatttagatattttaaaaattataattcaaccccacactgacttgatttatatggtaggatctagttatctgggaatcactggaattcgtaagaggccacttataatgaatacacttaacgaatggaaaaatgtttgattagaactttatcttggaaaaggaaaccctgccaaaaagtttattttatatcatatttagggaaattcaggttatatttgcaactatgctctagttgtgagaatgaacactgaattttcatacgtacacaaaaacatgtaagcacacatttcgttctatcagcttcatcgatagcaaaacacatgctgtttttagagatgtcaaaagaggagcattttatgcatcttagaatcaatgaaacacacag

SEQ ID NO: 246719 - DNA, 308 bp, Homo sapiens
aggccctttggagttgtgtggctccccctccagctgctctgtccacagatcttcctgctctccccaactcccctctgcccttcagccccacagccagccattagctgacttgttgaccatgacttcaaagcatccagaatccagtcggctctcaccaccctctttgccattgtttccaaaagggtgttgcccctgggtttgtcttttggagccccccaggagaagggaggacttcaaagacagaaagagagctaggcaccaaacctcaagcaggccttgctttcccagactctcaaacttaaaaaaaa

SEQ ID NO: 246720 - DNA, 215 bp, Homo sapiens
tcattggtggggggaggactgcatttttttggtaaaaatggaagtaacagaaatcctaaatatcttttgatgggttataagatatattactaaaagataatttatatttagaattctaccctattttatggttaggatataatgagatgtatttgaactggtttacgtttagtatattaagtgttcagtaaatgttagctgctgtttagtgttgt

SEQ ID NO: 246721 - DNA, 341 bp, Homo sapiens
ccctctatgggcagctggccatagggagggaaacagagagagggaagaacaccttcttccaaaagcaccgatagggctgggtgtggtgacttatgcctgtaatacgctttgggagagcaaggcaagaggattgcttaaggccagaagtttgagaccaacctgaacaacacagcaaaactctgtggggctagtcaacaaaagcaaaaaatgaaaagtagctgggcatggtggcccatgcctgtggtccaaactacttgggaggctgaggcaggaggatcgcttgagcctgggagttcaaggcttcagtcagccatgatagcaccactgcactccagcccagg

SEQ ID NO: 246722 - DNA, 666 bp, Homo sapiens
catgagtcggcatctaatgattgcaggctgattctatcgaaccatagtgtcatcctcgagaccattacggtactcctgattagttctgtcttttaaaaatagttcgtgattgtatataccctgtccgagactgcagaatcactgtcttttttggtacagaaagaaatgtttccttttgcaaagccagcctcagcaatgatatggcagttctgaatgtccttctctaaaagtgtttctcattttccaaaagtagagggttgtaggcaggggcaagctagagatggtctgtgacctagtcatgagcaagatcagcctgcacagttcatacttaaatgtgccctttgctaagtgcattcacctccactaactcacctgaatggtaccaattgtcccatgactgaacaaggaagggcttatcatctccaccatacagatgagaaagctgagattcagtaatggcaagagcagatctaggcctcaaatacagatcttctgagcaaaccttatattgctgccaaatacttccaaattccagagttccagcagggcaggttgcttagtgtgatctcacagtcaagcaaagaatgggcaaccctttgctaataccaggccctctgttcaaatgaatgccaggcatcctgccaggcctgggctagaggtgtatta

SEQ ID NO: 246723 - DNA, 636 bp, Homo sapiens
ttgcagctgattctaggaacatggtgtctcccagccatgaggggtagcctgttacttctggttttaaaatagcgcgtgaagatattttagtgtttcaagactgcagaatcactgtcttttttggtacagaaagaaatgtttccttttgcaaagccagcctcagcaatgatatggcagttctgaatgtccttctctaaaagtgtttctcattttccaaaagtagagggttgtaggcaggggcaagctagagatggtctgtgacctagtcatgagcaagatcagcctgcacagttcatacttaaatgtgccctttgctaagtgcattcacctccactaactcacctgaatggtaccaattgtcccatgactgaacaaggaagggcttatcatctccaccatacagatgagaaagctgagattcagtaatggcaagagcagatctaggcctcaaatacagatcttctgagcaaaccttatattgctgccaaatacttccaaattccagagttccagcagggcaggttgcttagtgtgatctcacagtcaagcaaagaatgggcaaccctttgctaataccaggccctctgttcaaatgaatgccaggcatcctgccaggcctgggctagaggtgtatta

SEQ ID NO: 246724 - DNA, 529 bp, Homo sapiens
caatttttttcatcttgagcttttcctaaacatgtcactcttgttacttgctgtctccctttaatccactcagccttttgcagataaaaaattttaatttcagttaaagtgctctttatttttctcaccaacaagatccttttatactttaaggaccattttcaccttcataaggaatctgaaacctattcagatccagtagtttgctctttttcacagatcaagctaagcaaactcccctggcaggaagccaccagaaatttcagttacaggatactgccatattctttcacaaaaaagggcctggtaagtgcaagtgatgccctatttctcttagctgtctctaacccttgctcaaagaaagggtaagtaaaaatgggtgacatgttagacgtttaaaaatgaaataaaaatgcatacacacatggataaagtacttcctaaagtatgagctgccttattttctcaggtataaaattattttagggaagtttcaataaatcaaatgttaagaaactgctaaaacatt

SEQ ID NO: 246725 - DNA, 310 bp, Homo sapiens
agacttgtgactatgccgttgtggtagagtgtgagggatgtgatatgtgctgcttctgagcttgggccttgcaatgctggctgggtgctcttttcacaagctggaacttaaatctgcctccaaccctgctcagcatggtcatattttagagcatgggtggccaaactttttcttcatgtaaagggccaaatagtaaatattttcagttttgtaaccattcagtctctaccctgtggtgtgtaagcagccaaagatgatatgtaaacaaatgggcatggctgtattccaataaaatgttatgtgcaaatcc

SEQ ID NO: 246726 - DNA, 420 bp, Homo sapiens
aaattgcacccttatctcacaccatatataaaaatcaactcaaaatggattaaaacttggccaggcatggtggctcatgcctgtaatcccagcactttgcagggccagggcagctggatcacctgaggtcaggcgttcgggcccagcctggccaacatggtgaaaccccatctctactaaaaatacaaaaattatctgggtgcagtggcacatgcccatagtcccagctactcaggaggctgaggcaggagaatcgcttgaacctgggaggtggaggttgcagtgaacccagatcacaccactgcactccagcccgggtgacagagcaagactccatctcaaagaaaaaaagcgattaaaaacttaaacataagacttcaaactgtaaaactaccagaagaaagcataggaaaaaaatga

SEQ ID NO: 246727 - DNA, 180 bp, Homo sapiens
agacatggttgtgcatcctgtgagtatactaaaaaagggtggaattgtacattttcaatggttaaaatgtatgacaggtgcattatatcagaagaaaagctgttaaaaaaaaaaaaagacagcaaagagaaatagacaagtgtgactatgaagaaatcaaattgtaaaagtcacacagga

SEQ ID NO: 246728 - DNA, 709 bp, Homo sapiens
ggtaaacagagcttggatatttagaaacccattgtggccagaaagaaagttatgtcattcagttgaatttagcaaattgcaatttgccgaagtatgggggttatttttccaaatatactaaattttcagtattgcttaaaataaggttttcagtattaaaactagaatcttatagttttgagtaccaaaggaatttgagagaccatagctaatctctttaacaaatgtggaaaccacttagacttttttcttccagattttctcttctttttaattgtaatttttttcatttttagagacaatcttgctgtgtcacccaggcttgagtggactggtgcaatcatagctcactgcagccctgaacttctgctgaggctgtcctcctgcctcagcctcttaagtagcttgaactaccggtacacgccaccatgcctggctactttttagttgttttgttagagacagtctcactatgttgcccaggttgtctccagagagtttcaatctaggatagctatcctttcatgaaaaacgtccttttgttatcactgttcagtgtcattctttgattttaaaaggttaatgtatatattaaactgctgccttccaaatttcttttagaccttttggaaacaatctgctttaaaatccctggcttcctttttttcctcctaaacttcttctttcatttctttttttcctcaccccc

SEQ ID NO: 246729 - DNA, 323 bp, Homo sapiens
ataatcatagctcactgcagccgcacaccacagggttcaagaaattttctcaactcatcaccctcccgaatagctggaaaaacaggcatgtaccaccacaccagtttttcaattctaattatctaacttctccaagaaaacagacttcacccaacatgtacatctgctactcacatcccctcctatgcaagcttcaccttccatgccatgattctgccccaccagttcgtcattactcatcttattcactccacaattacttactaagcatctatttggtgccaggtaaccctctgggtactgaagctataacagacaacaaa

SEQ ID NO: 246730 - DNA, 301 bp, Homo sapiens
aatgatggctgcagttattcccggccgtttttgagcagtcaccacactgctgtgctggagggtttgaggctcacagcatgatgcagcaggagcccaaggagagaggcttctggaagaggagaacccctgcttctggaagttctcctgtgactggggatgcacagcctgttaaatcagtaagatgtaaaacccttgccttagtgtgttccccaaaacagcccctgagccagggatgagagagcaggtagtttacttggcagatgatcccaagaagcagaagtgaagtgaagaactcagaaaa

SEQ ID NO: 246731 - DNA, 249 bp, Homo sapiens
gccgtctttaagaactgtaacactcaccttgaaggttggcagcttcattcttgaagctggagtgcagtggcccaatctcagctcactacaatctctgcttcccaggttcaagtgattctcgtgcctcagcctcccgaatagctgggattacaggaggctcccagccctttcggattggttgagaaaagtggcctggctggtctggggccagcggcacccaccctcccctcaattgcccaactccccccc

SEQ ID NO: 246732 - DNA, 384 bp, Homo sapiens
ctcctgctgccccttgaaaatgccaggctcacttctgacatatttgcgtttgtggttttctctcccccaaatgctctctctgcagacacccccatgactaattcctttgcttctttcacattttcactccaaagtcacgaggtcttcccttgctgccctatctaaaatacctgtcttgccccactgctggccacagacaatcccatgaacgctttatattacccatccttattttttttctttattttcttgcacaatattttcttagaagttccttcttattttgtattcttagcacagtctttctaaaatagtctcttatattttactaatatgtcttattattatctgtcttcaacactagattataagttctgtgaggcc

SEQ ID NO: 246733 - DNA, 369 bp, Homo sapiens
ctcctgctgccccttgaaaatgccaggctcacttctgacatatttgcgtttgtggttttctctcccccaaatgctctctctgcagacacccccatgactaattcctttgcttctttcacattttcactccaaagtcacgaggtcttcccttgctgccctatctaaaatacctgtcttgccccactgctggccaacattgtgaaaccacatctctactaaaaatacaaaaaaattagccaggcatgggtggcaggctcctgtaatcccagctactcgggaggctgagacaggaaaattccttgaaaccaggaggcagaggttgcagtgagccgagatcacactattgtactccagcctgcatgacaaagt

SEQ ID NO: 246734 - DNA, 808 bp, Homo sapiens
caggttttgcacttaaacaatttctttaaaagcattttattcactttgctgctactgtaaatggaatgttttcttaatttcactttcaattttttcattgctggtgtatgtccatccttaggggacacattttgagccctgttaatttccttttctgtgtggcttttgagcatttgaaagacttttaagtgttatttctcaatggcacatctgcctgattgtgagctttttaaaaagcccaattctatggcatttttgtcataatcccacctttggcagagcttgaccttggacagtctcatgccctctgcagagtcctgctgcctagaccttaagatcataaagccattctaatttatagtgcatacactcagtggaacattatacagtcattaaagctgtttatggagactacactaacacagggaaataattatgatataatgttacacagaaaatggactacaaatgtatgatttccattatttttggcagatgcatcattaggaaaattaaaatccgggcggggcgcagtggctcacgcctgtaatcccagcactttgggaggccgaggcaggtggatcaccaggtcaggagatcgagaccatcctggctaacacggtgaaaccccgtctctactaaaaaatacaaaaaattagccgggcgtggtggtgggcgcctgtagtcccagctacttgggaggttgaggcaggagaatggcgtgatcccgggagcggaggttgcagtgagccaagattgcgccactgcactccagcctgggtgacagagctagactccgtctcaggga

SEQ ID NO: 246735 - DNA, 428 bp, Homo sapiens
taaaaatagattttaatttagcaaagactttaaaaatttccttcaaaatcagagttcaacaaaaagtcccaaaatttggaaaggcgagatgttggctagatttgcaattaatgtttgttggctcattataatagctgatattggctgggcccagtggctcatgcctgtaatcacagcactttgggaggccgaggcgggcggatcacgaggtcaggagatggagaccatcctggctaacacggtgaaacccagtctccactaaaaaatacaaaaaattagccgggtgtggtgccacgcgcctgtagtcctagcaactcgggagactgaggcaggagaattgcttgaacccaggacggggaggttgcggtgagtagagattgcactactgcactccagcctgggcgacagagcaagactcagtctcagga

SEQ ID NO: 246736 - DNA, 493 bp, Homo sapiens
catctagcaagaaaaatgatgatgggcacactgggagcatttccttttgcacttgccttgtcctgttgctgttttagagctatgtgctgcgtgccatttgcagattcagttatgacatttgtttggtgggtgacccccaccaaggtcacattgcagaaagagtaatgaggccccagaaagataattctccacgagggtaaaggaacgtggaccaaccaactgtcttttgcaccaaaagtgaaaagtgaaatgagtgttgctctgggtctatgaaagtagctgacccagcaccagtcatagcctttcaagcaggtggaccagtacaaccttcctcccactcttgtttcagccttgtgtcaactccaagtctctggcttcagaaaggacaaagggacaggcaaataccatctgaagtgggtcatctcattgcctattcttcccccatcacaccagtcttcataaagcaaaatatcaataaatgtgactacataaa

SEQ ID NO: 246737 - DNA, 363 bp, Homo sapiens
catagccacagaagcctttgagaatccaagcaaaatgaaatcaattaaattctgcctatcgctcttcaaggaaaatgtcacgctgtagccaccttgagacgcaagctcagggcacaagcagtgctataacgtggcaaacaacaaaagtggatgcagagtgctgtgcaaagctgctcagaataagaatttgtggtaattttaagcatgggatccatctgtcaatgcaggaaaatgacacatttgagggtacatttatttatgtaaggagtgtaaattttataccatcattagcatactggatgaaaagctgaggtcaaatttcaagtcaattaccggatgctctgttataaatgcaggaatact

SEQ ID NO: 246738 - DNA, 380 bp, Homo sapiens
ctcacacctgtaataccagtactttgggaggccgaggcaagaggattgcttgagctcaggagttagaaatcggcctggcagctgggcacggtggctcacccaggcacggtggtaatcccagcattttgggaggctgaggtgggcaggatcacctgaggtgaggacttcgaggccagcctggccaacatggtgaaaccctgtctctagtaaaaatacaaaaagtagatgggcatggtggcagacgcctgtaatcctggctattcgggaggctgaggcaggagaatctcttgaacccaagaggcggaggttgcagtgagcctaaggttgcagtgagctgaaggttgcaatgaggtcgacgcggcccgcgaatttagtagtag

SEQ ID NO: 246739 - DNA, 602 bp, Homo sapiens
cagatggcaggaatcctcaggatgacttggagagcaaccagtccagactgtagcaagtcaggttctggggaaggctacttcataaggatgagcaatttgagagagacttagacaatcagcaacaaggttggggttgaattggtaataaatacatgaaaactaagccagtgggacaattaatattagatgagaaaggaaaagtgttgaaatgttactacatggctcaattgtgcagtttccacatcatcccaataatgtgaattgaatattgagctagacaaaattatggcataactatactggaaagatgggggaatgaaaagaatatttatgtgcatagaaaagagctaagccctcatcctccatggtggggagtcagtgggtaatgctgaaacaaaattcaccaagcagcgtatcatttatctggagacaagggggtaaatttaaaaaaaaaaaaggctaaaagaggtgcctgcaagcactctgagagtagtatctgcttttcttatcttttttaaaaataacaattgtagaattgtttgattcttagtatgtgcttatatgtataactttaataaaaatgaaaacaaacaataacaaaa

SEQ ID NO: 246740 - DNA, 403 bp, Homo sapiens
gtcgactgaaattgatgtgattatttttatatcaatttcaaaattaaaaagggctcatctttatgccacataattttgatcccaccatatgtaacatggctggaacgaacgcgcaattggtactgaatttcagcctcactgtgacctttcccacatctgtctcatcagcctttcctatctgtctcctgctatcctgcccctgaccccatgcttgggtctgctttgtgactgacatccctaatcctttcaatccatgatgcttttattggacccattagccctacctggaataccttccacacatacatttgtgcttgttgagatgtgagctccatccttccaatcccatgcatattaaagcccaccccaatttgtccatcagaattgatctctagctcccagg

SEQ ID NO: 246741 - DNA, 320 bp, Homo sapiens
gaaacttttaagaagaaagtaagaatagagggatgaatgcatcttaaataatgttggtgcaattgaacatccataggcaaaaagaaagcctataaaagggcaacttgagggatccttatggcaatgaaatattttctatctcaactggatcagtgtcagtaccctggttatgatattgcagtatacttttgcaagatgttacaattggggaatactggtaaaaggcatataagatccctttgtattatttattgtaactgcatgtaagtctaattattgcaaaaaaaattgctttaaaaattaaacaatattacctaatg

SEQ ID NO: 246742 - DNA, 256 bp, Homo sapiens
aacgacttttttttttgaggcaatctcggttgtaaaaacagttgcaaagtccagaccatgaattaaaattttctgacttcagatactgaatttccaattccagatacataagagttaaaggtttctcttttttctctctctcctctctctctctgttacccaggctggagtgcactggtgtgatcacggctcactgcagcctcgacctcctgggctcaaactatcctcctacctcagcctcgtgaatagctgggac

SEQ ID NO: 246743 - DNA, 494 bp, Homo sapiens
aacagtaatggtaattttgttttcataaataaaattttaaattgaatatctacaagccggtcatagcatatgcttctccaagcagaagagagtgtaacacttgtcaggcactagctctgtctctaaaatgaggcatgggtgcctcctcaccagttagcaatttcctaaagcaaagtcttgttaataccttgcagtaggagcatcttcaagaataacaatcttttggccgggtgcggtggctcacgcctgtaatcccagcactttgggaggccgaggcaggtggatcacgaggtcaggagatcgagaccacggtgaaaccccgtctctactaaaaatacaaaaaattagctgggcgtggtggcgggcgcctgtagtcccagctactcgggaggctgaggcaggagaatggcatgaacccaggaggcagaacttgcagtgagccgagatcgcgccactgcactccagcctgggcgacagagcgagactctgtctca

SEQ ID NO: 246744 - DNA, 412 bp, Homo sapiens
agtatctgataatagtaatagacatctaaagccagaagttggttacttagtagaaaaaaaaggaatttggactataaggagtatgaatatttgtgcttttggtttaagaactgatctctgttgatggacagtatctgttgttctccaaaattacattgtaaaattacagattaatccaggagaatactttttcaattctaatattttcaattgttttgttataaggatagtgagcaatggggaagactagttttacttttttttaatgaaatataatagctttgaattttctataaacattctcaaggatttaaaggattatcgccacagatatttaatatttatcaacattcaaatttggaagacatgttgttatcaattctataagactaaaaataaaactctgaacttt

SEQ ID NO: 246745 - DNA, 556 bp, Homo sapiens
aagaattcaaggaactgaaaggccagaatattggtaggatcatgaccttttcgtataaaaattcctaagaattaagtcagaggtagtattggagtatagaagagtggatatgagtcaagagctaaattgtttgagaaatgaggagtaacacgggtgtcagtagatgacaacatgaagagaaaatgggtgacataacgatgtcataagatttgaaattgttggtttttaggaattgtttccttttagtaaagaggcaaaatgatctgagagtggcaatgaataacaaagattacatctaccccatctccaagcccactggggtgaggtctatgagaacaaagaaaaacaatcacatgggctgggcctagtggctcatgcctgtaatcccagcactttgggaggccaagatgggtggatcacctgaggtgaggagttcgagagcagcctggccaacatggtgaaaccctgtctctactaaaaataccagagaaaaaaccaaaaaaaaaaacaaattacccaaaaagacagggccagacttctcattcttgattccact

SEQ ID NO: 246746 - DNA, 1001 bp, Homo sapiens
cgtggaggcacccagctgtcccgtatgcaagtgagggctgctcctgacacagactgacacctcgggcctgaagagggaatgcggggcgggggggcgggtccagcagctggcagcagccacagtgaggtcccacaccagcactcacactggttcagagccaggggagaaaagccccggcaccaggacagtgccaacccacagcaggaagccccaagaccaagatgcaatgatgcaaggactactcctgcccacgaagggcccacagtctgcggaatgagctagagatgtggacagagactgcagtgccttgagatgagggcccacagagtgtacaaggccaaaagaggccagggaggcttcctggaggaggtgactcttaggctgagaagaaattcagcgagcagagaagtgggggaagggaacttgaggaagaggcaactacagggaacaaaggcacagaaaccagaagggcgaggagcagtggaagccgacgaggccagcctgatgccgggagtggcggggcctcccatgtactgagcggccgctgtctctctcacccacactccagcccaccagcagcctgacagccagtgccctctgcctccgtggaggctgtcttctgcctgccagagcaggtcccagagccggctgtgcagagggcctcttccctcaccaaaagcccctcagcccagcctgggtccaccaagcagggacgctccaactcaccctggctcacagccaagcatctccctgtggggcaagttcaagccaacaagggacaagaaaacacgcagaccccactggggaccctgagctcagacacccggtgtgctcctcactcacccccaccctgccccgagtgcaaagtgtcctctcccagcagcacctcatcagtcctggcccacacaggagtgccagcggccatgcaggggcactgaccctgccataactctgcctggacacaggaggacagactgtaagcacatgcagcgtgtgcactg

SEQ ID NO: 246747 - DNA, 860 bp, Homo sapiens
ttattgcagcattcagaacacttttaatcaaagttaagcattctgtaatgtttttcttttccttttaaatgtaattttcttttgttgcaaaaaatgtttaatggtgaaagtcagatttagggtagttaagttgctcagggatcctgtaagcaaatttctgacctcctacctgcttagactgttgagccctacaggattgtaagagacacacatgacaaattatggaggaaatgagagaaaacagaaagaatcttaggaatgaaaataggagagcaggaatgagaaatatatgtttctatgggtaagccacagaaaagatatgatgatttatggagatatatttgtgctatatccctgagccccattttcttttcctttcttttcttttttctttcttagacagggtctcactctgtcacccaggctggagtgcaatggcacaatctcagctcactgcaacctccatctccaggactcaagcaatcctcctgcctcagcatccacagtagctgggaccacagacgtgcaccaccatgcccagctaattttttgtagagatggggtttcgccatgttgcccgggcttgtcttgaactcctggactcaagtgatcttcccaccttggcctcccaaagtgctgggattacaggcgtgaggcaccacactcagcccccattttcatatagaaagcacaacatggacatcaggaagcttgccctttgatactaatagaatcactgaagttcactgaagaagatttaggaatattctgaaccaccaagagggaaccctctgaaccatttctaatatattcaggcattttggttattaactaaataataaaatatgcaaaccaaccta

SEQ ID NO: 246748 - DNA, 263 bp, Homo sapiens
aggagtagaagatttgatgggactacaaaagaggaactcactccattattaccagcttacactggaaaaatgatcaacaaattaagaaactatgttgggagctaatgagaagtacatatttgctgccagtagcattttggatacatactgttacaggacagaagactgatgttacttagaaattttgtagttggagtatcactgacaacatcttaaatcagatcttaagaattaacagcttaaatattatatttgatcccata

SEQ ID NO: 246749 - DNA, 476 bp, Homo sapiens
gttgcccaggctagagtgcagtggctttaacatggctcactgcagccttgacctgctgggctcaagtgatcctcctgcctcagcctaccgagtagctgggaccacaggtgtgtgccacatgcctggaaatttttattttttgtagagacactgtctcattatgttgcccaggctggtcttgaactcctgggctcaagccatcttcctgtctcagcctcccaatgtgctgggattacaggtgtgtgccatgacacccagccggattatggatgatttttaaataacttccagtaatttttaatcttaaataaaacacaaatggaacctaaaaatctcaaataatactttttttggagacagtgcaacatagtaaatagaaaataaattttaaaaaccagcaaatcctggattgaattcattagatctcttattagaaatgtgatcttggcaagccagttaacctctctgaacttctc

SEQ ID NO: 246750 - DNA, 422 bp, Homo sapiens
tggccctctttgaatatctttaatgcttttagagattagcatcagagaattattaatactagagggcacaaggaattagccattgccagtggacacctacataggtgtgactatgtgactcagttttaaaaatgtgacacaatgaaaaaattccttggatgttatggaggacgaaaattttgtaagtcctatccattctttaatggagaaactaaaatttacaatattactttatttagcccaagattttcttaagctttgtattttctaattcagctttggcttacagaatcatgcttgaagtttgagactgccagctttcaacaggcagttactagtgaaactctttggaaagatgagaagatgttgacataagtgtaatgtgagacaaagcaaagtaaaatgtaatttttaagaaaatg

SEQ ID NO: 246751 - DNA, 974 bp, Homo sapiens
tagtttaggtaaaataaaatctcccagagaaaacaaagccgggaagggagccccctttctgtgaaacgcatgccatcttctccatttgtcagtttgatgctgtaacgtacatggggttttgcaagagcttcaaaactgtctgcagacgtcaatttcgcccccctcccccttgtgagaactcgctacgtagccagcaactgtgtagtgtctacaaatgatgaaaacgatcagaaatgcgattaggtgtcggggaaaaaagggtttcccctgtttttaacttgtatttttactttaattgttacaatcttgatattcttaacgtgacttttttgggaaaccaccaagtgctttttaagcaaggagttactggtatttatgcccttaatattccttcattataggcttattgaatacgttaatatctcagtaagtgtatttgaattataattgactggctttttctgtggtactaatgtgaaaggaaaaaatattaggactgcaaaaataaatgccgcttgaatattatctgtagtgcttgcttttgcattactgtagtagaatgcttttagctggttttaagctgctaattagccgttcgtagccgaagaatgaatacaagtaatcctagttaataaatggccaaagcttgactccccaaaatgccagagcaatttatgaggtatatttcaggaaatacatatgtatatatttcgtgggggagtggagggtctgtctcttagggaatgtcttggcagttgaatacttctgattgtatatttcgtgtaacacactggagaaaagaacagtgtttaatgtcagccttcattttcttctaacttgtatgtatagttttctcatcgaaaattcatttttgtaggttagtatgaaggaaatagcgtttggattttttgctttatattttcttgtttgggccaattaagggttgttaaataaattggaaaaaatcctactac

SEQ ID NO: 246752 - DNA, 762 bp, Homo sapiens
tcttttgtgacagaaggtataaggccaaagggcaggttgtcagcgagaccgcctcccctgcaggccagttgggcttggagctttgggaaggcaagtttgcaagagcctaggcctgttgcagaaatactctgtcctcagcttttccttcagggccaggtccctggattcttggataagacatttacaatatgcgggcaccacactgaatcaggactgtgtgcagagaagcaaaccaggcctttccacatagataggaaaaaataatcataacagttcatggttatgcagcttccagtggactccattgttacctggtaatcatcagtcaattgccatcacccttaaccttaaaggtgtcactttcgtacttcaggtattctttccaaagtccctctaccccttcttctccctgtcttatctgtccctgatctctgccaccctcagttgcttacattggccaaccagcctgaaatgggagaggttgaatccttcatgctatgtgcatagccaacattccacaagatttatgtcactaaagcctgtgaaaatgacaaatggtgagaaagagggccaaaaagggaagcaaaaataaatccaactacgatttaacaaagggcggcccagtatctgtacctagtgggtactgtgatatcttgagggacatgaatttaacaagagaaataaactgctgtatgaggatctttaaaatgctcttgttttccattcaaattctctttagtaaagttgctttttgccctgaag

SEQ ID NO: 246753 - DNA, 471 bp, Homo sapiens
agccttgggtcatactgcccccgcgaggccacattggcaaaccagcaagggtgttcaacttccagacttggccatggagaagacatacgaggaggcttttcacattcagctctttaatgtttgtctctgccggcaccatcccagttgtgaataagaggtatttccacagcggctcagggtaggtagtgcacagctcacattcatcatttctgaaaaccgagaggagtctccattcggggtacaggttgatgcctgtcgtggaatgaaggttccaacacccagaccaatctctgcagtgtgctgctctcatgagcttgcaacaagatcagaaaatgttttgtgactaagcatttttcatattgcataaaatgcttcaagctcctcccttgtttctctctataatcctgtatatctgatgattgtgggtaccaagtgtttgaaataatcaaatgtgatttgatgttggtaaat

SEQ ID NO: 246754 - DNA, 228 bp, Homo sapiens
catgtaagtacatgacaagatgttctgcttcctcagagaaggcaaattaaaagcacaatgagaggagtgactcagtgaaaattatgtagtgggtagctctaagagcctgtctctccacagaaacattgaaaaataaagaacaaactgcccatttcaactctgttggaactctgaagaaagagacaaagatttatagctactaagcaaatgttgatttaaaaaaattat

SEQ ID NO: 246755 - DNA, 362 bp, Homo sapiens
caccactttcaccgcggcaccacctctccaggaatgcatccctacagaatttatccagcggcatttccagagctttctcacttgcctcaagtccccaaacccacctttactattctgggtccagtcttaggtttcctcttgtggaaggccattcccagctttgctagctccactttaagaatgtcctcatctcttcactcattatggtttgtccctctggtctcagaggaagaggtgctgatcatcctctctggatctgaatgctccacgtgtccttatgtcctatcttatcccacttcctctttgactttgttccatcagttcctctccttctctccctgctgcgtctttccttcaacttg

SEQ ID NO: 246756 - DNA, 336 bp, Homo sapiens
caggaaaacaattcttataactattccatatgttccagaaacttagaggaaatgttgaacatactgagatgtaaaagatgtaaaaaaacaaaattctagagatgaaaactatagcatgtgatgtgaaagtatataaaacagtagattaatagcagattagacattgcagaagagattaatgaatttgaggacatagcaatagaaaactattcaaaagtggggctgggattacaggcgtgagccaccgcgcctggccaggaaaacaattcttataactattccatatgttccagaaacttagaggaaatgttgaacatactgagatgtaaaagatgt

SEQ ID NO: 246757 - DNA, 349 bp, Homo sapiens
tgcaaacacagctcaccacagctttgacctccgggactgaagcagtcctcccacctcagcctcccaagtagctgggaccacaggtgtgtgcctccatgcttggctaacttttgtactttttgtaggctagtcttgaactcctaggctcaagcagtcctcccacctcggtctcccaaagtgcttggatgacagacaggagccagcgtgcctgacctaaagacatatttttccttctagtgtagttcagccttaagactgtatcagcagatagagatggaaaagtaagaaaaattgagtatcagattatatttataaataaagcagttactaattgatgtttttttttaaa

SEQ ID NO: 246758 - DNA, 472 bp, Homo sapiens
gatccgcccaccttggcctcccaaagtggtggggttacaggcgtgagccaccgtgcccggccaggaaatgaacttttaactgaaccgtagtcaaggcaaaatattcccctgattgcagtacaattctaactctgatctcctgactttaaactccaaattgttattccttactgcaattaagaatttagaagcaattatttaaattatttaaataatttaagtttccattttcccaactgccctatttatgaatccatgacatccacttgacatttttctgcttgaggagaatattatatattttgttaacttctggtctagaaatgaccaaaaagctcttttgaagatgctgaaattgttagattatctattctcttcatttcccctatcctgcaccaatagtttagaaatagagtaatgcagtacattgaggtcaaattttgaaatctttaggatttttttttttatttta

SEQ ID NO: 246759 - DNA, 313 bp, Homo sapiens
gatccgcccaccttggcctcccaaagtggtggggttacaggcgtgagccaccgtgcccggccaggaaatgaacttttaactgaaccgtagtcaaggcaaaatattcccctgattgcagtacaattctaactctgatctcctgactttaaactccaaattgttattccttactgcaattaagaatttagaagcaattatttaaattatttaaataatttaagtttccattttcccaactgccctatttatgaatccatgaacatgatatacatttgtctatttactcttctttaatttctctcaccaatagctt

SEQ ID NO: 246760 - DNA, 377 bp, Homo sapiens
cactgttggtcattagtggtagctcattcacttggatcctatgttgctttaaaatagccccatcattgtggagttaggtttgttttaattgcacattacacttaaaaatcagtcaaatggccgttgtcaacttgtctcctctgtgtgccaggaatcaatcaatttctattcaagtaaacaagtggcatttttaaaaaaaaagtcacatttgattattaactagaagaatattcagtacccttgatctgtcttctatatacttcccagtcctgacaccctttttggattcaaagattaattaatttaaaggcagtgatgagcagattagatcagaagtaactagggacctagaatggaatatgaagaattagatcatg

SEQ ID NO: 246761 - DNA, 627 bp, Homo sapiens
ggtcatactggtatagaatgagccctaaatcgaatggttggcgcccttagaaggggacacatagataaatgtgcacagagggaagaaggccatttggagatagaagcagggattggagtgatgcaactggaagccaagaaacgccgcagaatgccaggagccagcagaagctaagaaaaggcaaagaaggattattccaaagtgccttccgaagaaggttggccctgccaaaaacctgatttcagacttctagcccccaaaactgcaagagaataaattttgttgtttcaagaaaaaaaaaaaaaaagaaaaagaaaaaaaaaaaaaaaataaaaaaaaaaaaaaagaaacagaaaaaaaagaggggaggcggacgacaacacgcatcaccgaagagagcaccactagatagacaggacacccccgctgcccataaaaacagaaaaaagcgccacacataacaaagcggcggaacacatacaagcaaacgagcagagccgataggcgcgaagaaaacacaacgccacacccgacaggagagaaacaaagcacacaccgagacggcgaagcgagagaaggcaccacacccatcgcgaggacggaagacaaaaagaggcaccacccaca

SEQ ID NO: 246762 - DNA, 475 bp, Homo sapiens
agtcacctgacattccttggagcctagtccttctctgctcttgtaaccgcccaatgggttcaccttgcctgctgcctagacagagccgattcatcaagacagaagacctgcatttctctcctgagtcacctgcacttgggtgccccagctggaagagacatctttatacctgttgccctggggagaaacttgatggttgggtgctagccggctccacacaggcctgattcatgcctttgaaaaactggcagtgtccactaaactaacttgtaagtatctcctaacacacagcatttccaccactaaataaatactcaacagaaacagatttgtattcacccaaagacactacagcttaaagtttatagcagccttaaccacgttagtccaatgctggaagaaactcaaatagccatcaaataagaatgggcaaatagatggtggcatgttcttgtaattaaacactacactgcaa

SEQ ID NO: 246763 - DNA, 367 bp, Homo sapiens
atggtcaaaatgaatgttttgggatacaatttaaaattgagaatgcatttttacataatggattcaaatatgttatctcatttaatcctcacaaatatatgaaataagataattattatccacattttacagctgaagaaactgaagaagtaatagattaagtaacttgccctcagttatccagttgtccagctaactactgatggaggcaagtattgagcccacagctcatattttaaccatagaacctatgctgctaatatttaggaaagacaaaatgcatcaacagtgcttgttttatggaaataaaaagtggatgatgatagattacataacaatgataaaatgacaggctaatataaaatac

SEQ ID NO: 246764 - DNA, 479 bp, Homo sapiens
ctgttcctatttggacatcttggaagtaactcccgtttgaacatattgatgtgtttcagtccactgcagctattatccttatcagttggcaaattgaaccatctttggtcattgagaggctcttgaagttggcttcctaagaccttgggacatgaccaaataaagtagtctttaaaagtttccttactctttggtattgcaagattttccagactaatcttttatattcctgcccaaggcctggagtcctcatttctccaagaaaccctgttccttaggatggctactgagagtgctcattactattgggttggtcattgtttccaggtcgaaatcagcaccaaagtgtttttttctttaacttcttctaacctgtgtcactgtctttcctctcatacattgctgggaagcacaggattaaagtaacacgtaattactaatttgcttcatcatgtattacacatacgttacactgagta

SEQ ID NO: 246765 - DNA, 244 bp, Homo sapiens
gcatgtgtagctgaggtcctgctggaaaaataccaccggagctctctgcagctggagtggaataattctgaagtgtgtgttttgcctcctttcccagtgtctccccatggggttaagctctggtcgcctgctcctgttgctggtcttgtggcacacacgtggcaggatgtcaccctttccctgggttgcgtccactttccttgctgtgttattcacactccccaaataaaatactttcactcaa

SEQ ID NO: 246766 - DNA, 461 bp, Homo sapiens
acgtatgtttgacatttgttttgacttccagagagcttcttttaactctctttccctgattccctttagaaaactacacagtgtgtagtgtaacctctatcttcattgaatctaccaatttcttctattggcattccactataatctccactaactttgagaatgctcttagacttggccgggtgcagtggctcatgcccataattccagcactttgggaggccaaatcgggtgaatcacctgaggtcaggagtttgagaccagcctggccaacatgacgaaacccccgtctccacaaaaaatacaaaaattagccgggcatggtggcaagcacctgtaatcctagctacttgggaggctgaggcaggagaatcgcttgaacctgagaggtggaggttgcagtgagccgagatcacgccactgcactccaacctgtgcaacagagtgagactctgtcaaaa

SEQ ID NO: 246767 - DNA, 181 bp, Homo sapiens
ctctttaccctttgcctctaatattgctgtttcttcttcattcattatttttccctctttcagcagtagacttgcaccttcctgggtgcccataggatgtttactaagcattgagaatttggaaacataaattctagtctaaactttgtagccctaggcaagtcacttgtgtatgccttac

SEQ ID NO: 246768 - DNA, 321 bp, Homo sapiens
ggattcacattgagacgttgttctctccatgtgtgatctcagacagagctaatcagcttctctgagtttcagattcctgctttataaaagagtaagacttttgtagggttgtttataaggattaaaaataaaatgaatttgaaaacacctgactttgaaaagtctcaaacacacatggtttagcatataaaaaacaagtgaattaaagacgttttttgaaaattgtgtttttggaaaagttcatcaagttcatcatgaatgtcccctgaattgatttgtacttaggagatctcactgtaaataaagtcatgtggcaaaaca

SEQ ID NO: 246769 - DNA, 929 bp, Homo sapiens
gagccggccagccagggcaggcaggggcggcctctctgacgagaaggaggccactgggctgaggccaatgaatgggaaagagccagccacatggtgagctgggagagggcatcccaggcagtgcaaccagcgcttgcaaaggccctggggctggacagttcttggcggagtctgagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcgttgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtg

SEQ ID NO: 246770 - DNA, 870 bp, Homo sapiens
gagccggccagccagggcaggcaggggcggcctctctgacgagaaggaggccactgggctgaggccaatgaatgggaaagagccagccacatggtgagctgggagagggcatcccagggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcgttgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtg

SEQ ID NO: 246771 - DNA, 846 bp, Homo sapiens
gagccggccagccagggcaggcaggggcggcctctctgacgagaaggaggccactgggctgaggccaatgaatgggaaagagccagccacatgggcttgagtctgggggagcctggctgcccagaggtggcagatgacatgaagaaataaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcgttgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtg

SEQ ID NO: 246772 - DNA, 448 bp, Homo sapiens
gagccggccagccagggcaggcaggggcggcctctctgacgagaaggaggccactgggctgaggccaatgaatgggaaagagccagccacatggtgagctgggagagggcatcccaggcagtgcaaccagcgcttgcaaaggccctggggctggacagttcttggcggagtctgaggtacaggatgatccctggatgagcgcctgagtgcacgaagcatgggtggagagggtcagctcccagcgtggctgcaggagggggtcgtgtaatgaatactaagtgccagttctgcaggatggaaacagttttgaaattggacggtggcgatggtggtgcgataatgcgaatggacccaatgccactgaaatattcactttaaaaaagttaaaatggcaaggtttacattaactagactttgccataataaaaggaaaaggaaaaaatataaa

SEQ ID NO: 246773 - DNA, 468 bp, Homo sapiens
ttcactgactgggcaaccttccccagcttcagaagaagccgtgaggcaggaaagctaaggcatatacttgagagggaatgatggcctcaaacacagagattcccactgcagccgcactaaaaccaagctgatctatgcactgcggcttggggttcagaaattatctggtgtggggatgggtgcggtggctcaagcctgtaatcccagaactttgggaggccgaggcggggggatcacaaggtgaggagtttgagaccagcctgaccaacatagtgaaaccccatctctactaaaaatacaaaaattagctgggcagggtggtgcccacctgtaatcccagctactcaggaggctgaggcaggagaatcgcttgaacccgggaggcggaggttgcagtgagctgacatcatgccactgcactccagcctgggcgacaagagggagactctgtctcaaaaaaaaaaacaa

SEQ ID NO: 246774 - DNA, 400 bp, Homo sapiens
gtactcagcagtaaacaggaatgagctgcaaatgtgggcaagtcagaatggatgtgtctcaaacaagatccaatgttgaggggaagaagccaggcacaaaaacaaatctaacgcacaacaccgttgacattctacagacaaggctcgtctgtggtgaagaacagtcagaagggtggttgctcggggcgggaaggagactgatggggaagggcaggagctccggtgagatgaaaatactctatggtgtgggagggcatgagtgacacaggtgtagccacttgtcagaaaggtaccactaagggcgtattttgatccttaaaaagcttagcaaaaatattatgagaaccctatgcttggcatttctcaccaagcttcagacgcagcgggtgctacacagacg

SEQ ID NO: 246775 - DNA, 319 bp, Homo sapiens
atgaactctgagactctacctcgagtcactgtagcatagagctgcagcctataaaaccaatttaatataatacttagctgcagcatggactcagcatctcagcaacagagtgtccttccccttatgtagcactaccagttcatctggcccttttctgtttgtgtctttctgtaggacaagacatacgggaaggccgcacctttgcatcttactgtctgtgtaagtacagttgaccctccctatctaagggttctgcatccttggatccaaccaaccacagatgaaaccattaaagacccttaagagccaaaaaaaaaaa

SEQ ID NO: 246776 - DNA, 362 bp, Homo sapiens
ccaagaaagctaggtgaataactgtaagatataggtgagagcagaagtcagatcttcagattttaatgacagaatgtcaccttttcaatcagcaacaaagtagccgagtataatcttcaaccatctgctctctgggagaggagagaggagaggggaaggagcgaggaatgaggagccagagagattgattttagctaatcacttctaactctttcattaaatttttatggagaattaatacaggctgggcgcagtggctcgtgctggtaatcccagcactttgggaggctgaagtgggaggatagcttaagcccaggagttcaggaccagcctatgcgatgtggtgagaccctgtctttaca

SEQ ID NO: 246777 - DNA, 552 bp, Homo sapiens
caaaaggagcgagattctgacactcgctccggtgcggatgaaccctgaaaataccgtgtcaagtagaaaaagctggacacaaaaacctcatattgtgtggttccatttatatgaaccatccagaatagataaacctgcagagacacaaaggagattcgtgttgccaaggcctgggtgagggactcttgggggaaaatggagagtaactgctgatgggttgaaggtttcatgttggggtgatgaaatgttctagaactgatggtggtgatagttgtagaactctgcgaatatatttaaaaccattgatttgtatagcttcaacaggtgaattgtatctcaggacatctgatatctgttgctcaaatatgcacatcatgttgtagactttatatatttatgatatatctagatttatgtacatatatttatgtgtatatgaactatgtagatgttatgtagaattcattttcctgttgctaacagtttatgtgctccacttactagactggtcagatagcataaagcataaaagcttctgtaataagtcctaaa

SEQ ID NO: 246778 - DNA, 591 bp, Homo sapiens
acttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataa

SEQ ID NO: 246779 - DNA, 522 bp, Homo sapiens
tgagacggagtctcgctctgtcgcccaagttggaatgcagtggcgcaatctcgactcactgcaaactctgcctcccagctacttggaaggctgaggcagaagaattgcttgaacctgggaggtggaggttgcagtgagctgagatcatgccattgcactcctgcctgagcaacagagggggactccatctcaaaaataaaataaaataaaatgtaagacaccctgactcttagaagttcttcaaatattatccatcgagtcccgaccctcatcccatcccacccttggttctcagttgttcttaccaacaatttctgtgtcagagactggaactacggactagctccctcaactcagcagtgcacaacaaatttggccctgttgactttgagggaagcccttgttcttggccccagtatggacctttggccaatggaactatcaaccagtttgttctttcttgtatagaatgacctctcagcttcacacctatggttctttttcagctctgaaactcttgtg

SEQ ID NO: 246780 - DNA, 101 bp, Homo sapiens
ttttttaataagaaaagtagtaaaaccactatgtagcgtacacactatggcaagagtgtagggaaaaagcattctcatacatctttggtgggcaaataagt

SEQ ID NO: 246781 - DNA, 919 bp, Homo sapiens
aggaaaagcggagagaaaccgccctctgcaggtccccttggctcccccgggaggaaaggcagcctgcccttctccgattgtcactttactctccatccggagccgcttcctttctcgccgcgaggctcggggttggggggggaccagattggagccgcgggctaactgggatccgtcccatttccctgggcttgacgttctctgaatttttagctaatgtggaaagttacatttatttgcatttgtttatcgcttgctcacataggtctgtgtcccgaagcttggcagatgagcgaacttagccagcacacccccggccgtgaagcagggaggtgaagcggggagagcaacgagccccacccgggtcttgccagctggacgttcttgtggggcagcgttgagcagcggttaggagtgccgtggactttggattcaaacagccccagctcttctgcttgctagctgggtgactttgggcaaattaacatctcgaaaatctgtttcctcattcctaaaatgcgggtctgaaagtgatcatgcctgtaaagccatctcatatccatggttctagaagcatggtgagcacctcaatttgaataatcagtgccatgctttagctacctcttgactcactcgtttgtggcaggaaatgttcccaaattaatcagaagaattcagtgactaagaggatgtaatagtatatagcgcaggcactggaatcagctctgctgtgtgatcttggacaagctgcttctgttccgtttctcttatctggggcaatacctgtctgaatagagtgactgttgggacgaaataggttagtaaatatgtactgtaaggcattagaaccttgcctggcacatagtaagtgctcaataaacgctaggtcttgttaccttggcttcccgtttaggattgg

SEQ ID NO: 246782 - DNA, 539 bp, Homo sapiens
cttatcactggtctattatttgactggtatacacagctccttatttgttttcattgtacctaaccatttctctcctcaaaccagagcataatctcagagtttattcttagtcctcagagaggctatgttaactaaatctgaagagaagagttatataatggaatattgtgcaaaaacaaaaaaaaattggcctgttaagaatggcctatgagaacttttttaacctgattcagtttaattgaaaccagcaagggttcaaactatatcgacaagatcgtattcaaattctactgttcagcctcaaagttcctgcagaaagctaggtgaggttttcttccttgactgtttattacattttctttataatacactcattttaacgtaaaaatatttttacctatatttaagttaaactagattctaaaccctgtctgcactatagaatcacgtgatgttttgagaaaaagatgacgctagctgcacaccagaatctctaaagtagtgcccaggcatttggtactttagaaacaaagaaaaaa

SEQ ID NO: 246783 - DNA, 509 bp, Homo sapiens
ctctggagtgtgtctctgtgtctgtcctcctcttcttgtgatatcacgagtcatattggaataagggcccaccagacaccagtatgatttcatctcagctaactgcactggcagtgaccttatttccaaataaagccaaatgctgaagcagcaggggttaggacttcaatgtgtctctcgcagggacacaattgaacccacagcagtcaaatacatagtccttattaaccatacatgtaggtctgctttctgctgtgtctaacagatgcgcttttctgtccgaggttgaaaattaaggcagcttcctccctgccagggtaccccctgcacaggcccctgccacagctggtggttactagaagtctttcatactcttcagtcctgtgacaataatttcgtgtttccatgcacccatatacagaccctagcgcttttggcaggaagagaagaatttctaagttgaggctgtttaaaagcgtctccccagtgaagggtcaccagatttagca

SEQ ID NO: 246784 - DNA, 920 bp, Homo sapiens
cacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcccgtgtgcacgcccaatcagaccgagcacttgtgacactaccccaacacctctcccagggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaa

SEQ ID NO: 246785 - DNA, 1486 bp, Homo sapiens
cacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcccgtgtgcacgcccaatcagaccgagcacttgtgacactaccccaacacctctcccagggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaaaaaaaaacaaagaacaaaaacaaagaaacaacaaaaaaaacaaaaaaaaacagcacaacaaacacaaaaaacacgacaaaaaaacaaagggggggccaccaagaaagagcccgcgagggagggcccccacaccggggccacgaacacagagagcagcggcaaaagagggggccccacaaaagcaggcgccaataaaagagagacgcgcggcagggagcaacagcgccggaaaggcgcaaaaccgcctgccaccagccggcacatctagtggggcaagcaccaccaccaagaggaggcgcgcagggagaaacccacgcagcgcggacagacacgcaaacaccgacagagccgggagatgaaagtagaggcggcccacaggaaggagagaaaaatacagagcagcacgtcgaccccgggcgggaaatcgaaacggggcggcagacacacacaacggccgacacgcagaaaaacagcacagacgccagcatggacaagaagaaatgccgtgggcaaccgcagcgcaggagcagacgacgccggcagaagacacaatatctcaagcccgc

SEQ ID NO: 246786 - DNA, 821 bp, Homo sapiens
cacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaa

SEQ ID NO: 246787 - DNA, 409 bp, Homo sapiens
gaaaaaaaaaaaaaaaaaaaaaaaaaaaactcgaggcccaatcagaccgagcacttgtgacactaccccaacacctctcccagggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaa

SEQ ID NO: 246788 - DNA, 932 bp, Homo sapiens
gtgcgctggttgggcctgctgggcctgggccacctcgcgctgaatcgcaggaaggtgtgagagaaggggaggggtggagaggggcttggcccggtcgcggcgaggtctgcaagaggctgaccccgatgtcccagcaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggttcagcgatacccaggccacgtgcccaacttcctgagccagacccagggctacctgcggagtccacaggaccccctgcgccgggcagccaccgtgcttataggcttccttgtccaccacgccagccccggctgtgtcaaccaggacctgctggactccctgttccaggacctagggcggctgcagagcgaccccaagccggccgtggccgcggcagcgcacgtgtccgctcagcaggtggcgatgctggcccgtgcccggggctgccgccgcggccccgccttctccgcatcgccccgcgccccgcccggcccccaccagtcttcgccgacagccccttccagcgccggagcgtcgcgggccgctggggctgctccggaccccgccgagcctgaggctcgggctggggccgagggccagggtccgactcgggcaccccacgcgcatagcagc

SEQ ID NO: 246789 - DNA, 854 bp, Homo sapiens
cagatcacaccgagtcagcagccttccctagacccgccgcttcctcgctccgcgctggccgccccctcccacccttgcagcccctctctgtctccgcctgccctgactgcgccctcccacgcagacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggttcagcgatacccaggccacgtgcccaacttcctgagccagacccagggctacctgcggagtccacaggaccccctgcgccgggcagccaccgtgcttataggtgaggccgcccggggtcacactgcccctggcaccggggctttgggagctgggccagcctccccctggggggctgtggggcctgcactcatgcatctgctgtggtccaggcttccttgtccaccacgccagccccggctgtgtcaaccaggacctgctggactccctgttccaggacctagggcggctgcagagcgaccccaagccggccgtggccgcggcagcgcacgtgtccgctcagcaggtggcgatgctggcccgtgcccggggctgccgccgcggccccgccttctccgcatcgccccgcgccccgcccggcccccaccagtcttcgccgacagccccttccagcgccggagcgtcgcgggccgctggggctgctccggaccccgccgagcctgaggctcgggctggggccgagggccagggtccgactcgggcaccccacgcgcatagcagc

SEQ ID NO: 246790 - DNA, 908 bp, Homo sapiens
gtgcgctggttgggcctgctgggcctgggccacctcgcgctgaatcgcaggaaggtgtgagagaaggggaggggtggagaggggcttggcccggtcgcggcgaggtctgcaagaggctgaccccgatgtcccagcaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggttcagcgatacccaggccacgtgcccaacttcctgagccagacccagggctacctgcggagtccacaggaccccctgcgccgggcagccaccgtgcttatagggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaa

SEQ ID NO: 246791 - DNA, 670 bp, Homo sapiens
gtgcgctggttgggcctgctgggcctgggccacctcgcgctgaatcgcaggaaggtgtgagagaaggggaggggtggagaggggcttggcccggtcgcggcgaggtctgcaagaggctgaccccgatgtcccagcaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggtcagcagccccccacaccatcccacccctatgccatccaacactcaccactcccaccgtgcctcccctccgacaattacagagctcagagtggaccctggcccgctgtgaccacgccttttgctggggcctgctggaggagttggtcaccgtggcccactatgacagccccgaggccctgagccacctct

SEQ ID NO: 246792 - DNA, 409 bp, Homo sapiens
cagtgagtcacgattgcaccactgcaccccagcctaggcaacagcgcaagactgtctccaaaaaaaagaaaagaaagaaaaagaagaagaaagaatgttgtttcagtcagagatgtaaggggctcacagtttcttcagctgatgacctcgagtagcttttaagaatgggcaatgtcacatttgtctttcacatgatgggaccactccacaaggtcggtggtctcaggccagagactgggcactctcctcctgcattagccttccactgcccctgccacacacaccaggatattcagttaactttgaattttcagataaacaacaaataatttttgaacataagtatgtccccaagtggggacttatcatacttataagtgtgtcttacttgagacacacttatactaaa

SEQ ID NO: 246793 - DNA, 587 bp, Homo sapiens
acggagactctctatatctacttgtctcatgttaggcaagtagatatagagagaagagctgaagataaggacctgatttctgtgagtaagaaacaaaagagaagtaaagtaatttacccagttgctatagttagcatgtggtaggtccatattagaggtctggtctgtctgcatgatggttaattttatgagatagcaagtaaaacattatttgtgtctgtgtctgtgtctgtgaggatgtgttcggagaggttcacaagcatttgaatcagtagacggagcaaataaggtccgccctcaccaatgtgggcaggcatcatccaattcactgaggactcctgctcacacagaacaaaaagtcagaggatgtgcctatagttccagcttcttggaaggctgcggcaggaagatgctggggcccaggagtttgaggccagccagggcaacatagcaagacctttctctttaaaaaaattttttttggctgggtgcagtggctcatgcctgtaatcccagcactttgggaggccgaggcaggcggatcatgaggtcaggagatcgagaccatcctggctaacatggtgaaa

SEQ ID NO: 246794 - DNA, 877 bp, Homo sapiens
caaaagagcaagtcagggaactagctttggttgggttcggtggtacacaaagcacaaggcctgggttggggttaggaggaaatgagacttgcggcgggtcggggctgaagatgtggcagcgccctgaacctggagaaaggctgaatccctttggtcaaggagagggagagagaggtaagggtctggtcttactttttaagcaggaagaagactacaaaccaccatctaccatctgccaggtaattttaaaccagtccacttaatccccatcagattttccagatgctttgaatgcagagctaaggttgagaaccactgatttagacaaatatactatgggagaaggggaaggaggttccaccagcagagagcaaccagctagagccatttggggcttatcacaaaagacttcttgtcagggaaattcacctattgagagacattttggttgtttccaattctgggccattgaaaagaatgctaataagcaaagcccctcttctgctatgaaagtaacagtgggcagatattccctctctggcccttgggtaactgaaaggaggcttataaccaaagcacagccagtgagatgctcctgctcaggatgttgattttggagaagtgacacaaggtatatgatcagagttaagggttcagtaggccagtaatgagtgccagtggtgttggttccagtagcacaatggtaagtatccagtttagaaggctcgggtggcagcatcctaagcccactatccctagcgagatgctggctgtgcctcaccaaccctcatccctgcctcatccttgttctccagcttcccattaaaactgtgagcttcctaatacctttccaataaattaaattttgtcataaata

SEQ ID NO: 246795 - DNA, 682 bp, Homo sapiens
caaaagagcaagtcagggaactagctttggttgggttcggtggtacacaaagcacaaggcctgggttggggttaggaggaaatgagacttgcggcgggtcggggctgaagatgtggcagcgccctgaacctggagaaaggctgaatccctttggtcaaggagagggagagagaggtaagggtctggtcttactttttaagcaggaagaagactacaaaccaccatctaccatctgccaggccctggaatttgaaccaccatcttctggagtgactcaaatgcagaggaagccaggcctgctgctaacgtttctgagaggcggcaagagtataaatggagatccacatatgtataaataaagagtgtgaatcaagctaacaaactgtttaataaaatatgatctaccctcttagcttgacaaatcaacttttcaaacacctggaagaacaagtttgcactcaggattctcagactcctcagagttctgcactgggatgtggaagggctgtgcaagccagcccttgggtccctgatccctgtctcctggcctgtgcccgtctcttctcagcctggctccaactcccattgagaggaagttcttgtacacatatgatactgcagcccttatgtctaatatttatccataccttctgcaaacagccactgtgtgaccacccttggg

SEQ ID NO: 246796 - DNA, 273 bp, Homo sapiens
aaagggacttcatcctcctccctccttcccaggcagttctcccaaccacccaccaacaggcaacgtaggtgtgattgccttcaaagttttctacttgccttcaagcttgaagcactggagactgagggaagagagcactggaagtggaggaagaaaaaagagctgttccctccaaggttgttcccttgggcctgactcgactggaagaagcagggtgtatatgtgtgtgtgtgtgtaattgactttgtgaccatgaaactgagttaatactca

SEQ ID NO: 246797 - DNA, 1410 bp, Homo sapiens
gaggaagggagcgatttcgagagagaatagtttgagaagttgttctcagtcccttccctcgcgggagtgtggtatttagggaagcttcggcctcttaacccatggactgttaggatggagggaatccttcccgctcgattcctatcgcggagtcctttcggagcatcgctattgatcattctcgccgccccaaccccgttgtttactttggcttcgcagatctctgtggtcttttgccctcccgcagcgcccatggccccgtcaaggttgggcagcctttctctgcaagaaggcccacgaacaactgcggttatattgggatggattgcgcgtgattttactctttacaatacattctttcatgcttcctagggattgagctgcgcggcggatccctccgacttaattctgggcctgagaaaagtttctcttggaatgcgcagtttcgtgacgcagcattattgcgtgactctagggctgacccagtttttcactttctaattgtaaggaagtgcgctagtagtccaccgaggatcctcgaggttggccttattgtatcataatttaacgaatttgcgttccaggttgttacagcctttgaaataatggcctcatatttaagaatgtagcaatttttctttgaaatttccgaaagtggggaaaaaagtaatagaagactgcacctatatggaattattttctgattcgcagttctttataatcgtagacttaatttggtggctttattggacctgtttgaaacaggaagcctttctgtaatgtggtttcgggtcggcttcacctctggcactctctgaaacgtcgttgtctatggtttccctaagaagctagaatgagcgggatgctacggagggaggtgtatacaggtgttagacaaagccccctccgcttttttggtaaagggccaaataggcattagatcaacttgtgctagctctaaggagttaaatgcggtattattaaagactgcttgtaatgttgactgttaagtgagagtgttacttctttcagtgtttatggaatcgaactaaattgctaggtattttaatgcagagttttaccttttctcgggtattttttaagacatacacagacatacatgtagttatgttgaaataaatgtgttttattagaacgttaaaaaattagaatttaggtgaactactggtatcggaacagattttggtttgttgttgaagactgtacactggtgtaggtactgtttaatacatcagattgtcatttcaaagactttgtcttcttaactttgaaaattaaataatgtgaaataatgtgataatggtttttatcttttcaggacacttgattgacacttaattgtgcttaggaatagaataggtttttttttaagtcaccatcctccaatcc

SEQ ID NO: 246798 - DNA, 336 bp, Homo sapiens
atgcataaaatatagaaaggtcaacattgtagatataaaatcagaggtatagatataaaattggagagacgacattttgcagtttgatgcatcttagagtcagagaaaaccacgtttaaatccctgagataccatttacccactgtgtgattgcaggcaatgtactgcatacacctaaaattcagttttctgatctataaaatgaagatctgaatatcttttattctggtgacaagtgatttagtgggaaaaatcaaagatgccaagcacacaaccacttcttgataattgtcagttatgaaacctaatacatatggacgttgaattgagagagta

SEQ ID NO: 246799 - DNA, 712 bp, Homo sapiens
tccctattgcaagaaactatgatgagaccatagggaaatgaaggacccatcaatctaatatcaatattaaattactgtacctttcaatggagtgctaagttctttaccttcatttattaactcaggatgaccacttactttctctgctcttgttctaagtcttctaagtattattggaatcacataactactttgacacagttttttcatcctaacctgtgcactgaatactcaatatatccatgcacaacctcctaccatgctatatattttggggctattccaaacctggcctgggctgccagccctgacccccataccatgcagcctgtcctctgggaagatcctgtcacccctgtattcctgagaagagaaatgagttctatggaaagtacctgatcacttccttccttcacatgacggggtctatctgcatcttcatgtgacctctctctgatggacattgtatttgcccaactactttgcagacatgtgccacataactgtgcttctgcactcaagccctccagcttcctctagaactgttccatcaacccttcattcccttcttttccttcctgcacttctctcctctccactcctggtctctctccactggctgggcatttctcttgtcttaaaatactcttctttttgattctgctatttctgcaagccaccaacttctttctcatcattccttttgccacca

SEQ ID NO: 246800 - DNA, 1210 bp, Homo sapiens
tgcggccccgcgccagagggccggtggctcctccgggcttctgaggacccgcagggagcgggcctcatcatttctgtctcctgtttctccacttccttctctgttggttggtccactgatgtatggacttgcacatgatgaactgtgaacttctagccacatgtagtgcccttgggtacttggagggagacacttaccataaggaaccagattgcttagagagcgtgaaggatctcatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtgttgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggt

SEQ ID NO: 246801 - DNA, 570 bp, Homo sapiens
cctgccaaggttaaatcagcaaagtctattactttaagaggcaatttaattagtaatcctttctaagaggggaaaaccagcaagtccgtacctggaatgtggtcctttcagccaaagatgaaaaaaaggaagcaataactaacaaactggtggaaggtcttaatcttaaattaatatatgcagaagcagagctctttttgtaattaaaaaatggattcaagaatgcactccactttcccatctccctccattaattattaaactttggcttgttctcaatacaatgttaaattataaaccaaatgaatcatttgcatgccagtaaatatgtattcatgagggttcacaatatgtaaatgtgcatattaaaacaatagctagatttttttctcataaaataaaactttacctactagaaatctcattattgacaagtttctcttaattagaactcactgataattgctaaacccctgttgtggcaggcagaattctaaaatggacgcccatgaccctaccccttggtatacacacctgcataatccttaggactttaaatttggtggattt

SEQ ID NO: 246802 - DNA, 844 bp, Homo sapiens
tggagagagaaggacacttcaggtggcgtggtcagggagggcttctttgaggaggtgacatataagcaaagatcagaatgaccaaaagagtattccaggaaaaggaagtatatagggtaaatcctataatacaagagcaaattcaacaagtttgaggaagagaaataaggctggtgtcactgcggtggtggagagtggtgggagatgaggttgaagaggtggtcggggatgccgtacagggctccacgggccctgcatggaggaggagtctggactttatcacaggtgccatcagcagacatggagggattctaagatgagaaatcacatgatctgatttatgtcttaagacttatgatttatgaaactctagctgtgctgtggtgaatgaggacaagagcagaagcaggaaaaccatttagaaagctattacaagagcacagaagggaaatgttttggaggtaaagttgacctgaattctgaggattgtgaaaacggaggaaaagagaagaatcaagaatatctacatgctttttgtgttgagcaattggtgggtggtaatgccatttaatttgaagcctgagagaatgaagaattctattagtgtagtatttccttctttccttgtgcagccttaagcttgcagaccatggattacaccactctcttttattttccttccctacttgccctttagtccttcttatataaaagaacttcatctatctgcatcctctactcttatcctgtcttgaactcactgcagtttggctactatccccattttactaataaactccttcttgccgaacacaacaatgacctccttactaaatccaaaaac

SEQ ID NO: 246803 - DNA, 898 bp, Homo sapiens
tggagagagaaggacacttcaggtggcgtggtcagggagggcttctttgaggaggtgacatataagcaaagatcagaatgaccaaaagagtattccaggaaaaggaagtatatagggtaaatcctataatacaagagcaaattcaacaagtttgaggaagagaaataaggctggtgtcactgcggtggtggagagtggtgggagatgaggttgaagaggtggtcggggatgccgtacagggctccacgggccctgcatggaggaggagtctggactttatcacaggtgccatcagcagacatggagggattctaagatgagaaatcacatgatctgatttatgtcttaagacttatgatttatgaaactctagctgtgctgtggtgaatgaggacaagagcagaagcaggaaaaccatttagaaagctattacaagagcacagaagagggatgatggtttgtattagggtggtagcagtggagaccgaaagagacattttggaaatgttttggaggtaaagttgacctgaattctgaggattgtgaaaacggaggaaaagagaagaatcaagaatatctacatgctttttgtgttgagcaattggtgggtggtaatgccatttaatttgaagcctgagagaatgaagaattctattagtgtagtatttccttctttccttgtgcagccttaagcttgcagaccatggattacaccactctcttttattttccttccctacttgccctttagtccttcttatataaaagaacttcatctatctgcatcctctactcttatcctgtcttgaactcactgcagtttggctactatccccattttactaataaactccttcttgccgaacacaacaatgacctccttactaaatccaaaaac

SEQ ID NO: 246804 - DNA, 384 bp, Homo sapiens
caaaggatgacttacatggttttgggcctgaggaactccaaaaaagtcattgctttttacacaggtgggaggtcttggaggaacaggtttttgcaattcagagtacagctttggcggccaggtgtgatggctcatgcctataatcgcagcacattagaggggctagcatgggaggattgcctgagcccaggacttcaagactagcctgagcaatgtagtgagaccccatctctacaaaaaaaatttttttaattttctgggtgtggtggcacattcctgtagtaccagctactcaggaggctgaggttgggggattacttgagcccaggagggcaaggctttaatgagctgttgtcatgtgactgcacgccagactgaacaata

SEQ ID NO: 246805 - DNA, 363 bp, Homo sapiens
tttgaagttaatgtcagattatcatctggaacaaaagcaggggcccatgatttttctgtattgttgtagctcttgaatttaaagaaaatggagagctggctgggtgcagtagctcatgcctgtaatcccagcactttgggaggctgaggtgggcagatcacgaggtcaggagattgagactatcctggccaacatggtgaaaccccatctctattaaaaatacaaaaattagctgggcatggcggcacgtacctgtaatcccagctactcgggaggctgaggcaggagaatcgcttgaacccaggaggtggaggttgcagtgggcggagattgcaccactgcacagagctatactccgtctca

SEQ ID NO: 246806 - DNA, 229 bp, Homo sapiens
atgcgcatgccaccacgtctggccaattttattttaactagagacagggtttcatcatgttggccaagctggtctcgaactcccgacctcaggtgattcctctgcctcagcctcccaaagtgctgggattacaggcatgagccaccattcccggctcccttcccttttcttatgggaacagcattgaattttcctttgagaaaatacctctccctataggggtagttcc

SEQ ID NO: 246807 - DNA, 171 bp, Homo sapiens
acgttcttcagtatatacacatatgcttactatatgtgactactgtagtactatacattactactgtgtcttagctcattcaccttagagacaaatggatagtaaaattattttttttttagagttaggaaaggaaaaaagaagaggagaggggtcatgagttgattatat

SEQ ID NO: 246808 - DNA, 449 bp, Homo sapiens
tggtgatcagaatattttgacccacaaaaatcaacggtaaattgagcatcaggtgtctgtctcctaagttgatgcttgatatttaataaggaaaatttttagatttactgagcagaaacctaactcaagtcccataaagaattcacagcttcttacccagatcccagatctaacctgcttcatagacctagagctccccaagtaacctagagagaggttccttgaaacccttgcaaagtggccatagttccaaaacactttccttccccagggagtcttcagcatttatcatgtgactgagcactgaagaaatggaattacccagaccctttcaagtgccaccacagtccaatactcaagaacttacctagatcaggtgctacctggagtcttagcccaaatccatctcacatctgttcagtgggcctatacacccatccttggcttaa

SEQ ID NO: 246809 - DNA, 447 bp, Homo sapiens
aacagtcctgccattttgcagattgaagggagatttaaggcaactgtgtcttccacccgtgcgctcaagaggttgggatgtgaatggagagagggctgcacctggtggacctaatgttctgggcaggggagtggaggtggtgtagacagaaaatcataaaactctcaggagaagccaagatcagcgatcctcccgtcttggccccccaaagtgctgggatgacaggtgtcagcctgtcctggagtcctccaagcccgtggggtctgatgagcacagacggctcagctcttccttgcttccatacccttacataaaactggagctcggctttctcagagaggatgcttttatttgcctgagatgcaccatctgttactggctccgtttgaccgatctccttgttcatcgtggtccaggtctgcacctgacagctctgagtgctgacct

SEQ ID NO: 246810 - DNA, 567 bp, Homo sapiens
cgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacg

SEQ ID NO: 246811 - DNA, 633 bp, Homo sapiens
atctaatgccaccactgatctgacaggaggtggagttcaggcataataacgcttgctcatttgctgctcacctcctgtgccacccggttcccaagaggccacggactgctacccatcagtggcctgtgggttggagacctgttttaacagaagtaggaagcattccctgtgcaccaactgtgcctgcagtaatacaataatgcttccgagtaacctttaagtatcacattttccattcacttttctagttacccattctgagctgcaagaacacaaaaacgttctctgatagcttttacagcaaacacaaaaactgtcacccttacataagcagaatatgaaaaaaaaaaaaagtcacttcaatccctcccgtgaccaccaatttagccatcatggaaaggcagaattctaactaattttgcttgcataggcatgtaacaaaatgcctccttgaaaaatctttgtaaaactgatgctccaagaaagtgtgccataattatcctgtggctcctgcattcttcctggtattctaccacatactctcaggggatgtacacttgatatgagaagtatgaaaatatgtgactactggttctttccatacgaaagaattcttacttaagtatcttttta

SEQ ID NO: 246812 - DNA, 499 bp, Homo sapiens
atcgtgggctcatgacattcatgttttataaatgtggcataaagcctcacgctgactgccatgtggcccaataccagttcgatgctacattcaaagaaccatcattccagcatgcaagcatacttaaaggcaattgaaatgtttaccaccgtccctcaagacaaacaccaaagaaaaattattttcaaaatgcatagcaacacttcttaaaatcttattttcccatctctttctctctctctaccacattcccaggagtttcccaggagcaaaactatcataaagacccagaagcaaaatgattaatgacttcactatatctgattctgatttagttggtttagagtggtgtccggtcttacgtattttttaaaatcttgctgggcacagtggcacacacctgtagtctcatctactcaggaggctgaggcagaagaatcacttgagcccgggagtttgagtccagcctgggcaacatagcaagaccctgtctctgaaa

SEQ ID NO: 246813 - DNA, 300 bp, Homo sapiens
ccagaacaagtcttggttcactgggtcaggccctacacaccccgagagcatcagctggcactggaatcaggaagggtgaccctgtatcccccgaaatgcagccacttagtgactccgaaaggccactgagcaaaggcaggagccctgcactgggagaagggatttgcctatggctagaggttgagttttcccactgcagaattccatctattagaacaccaaacttggctttattatgattatggatattattataaataataaggagctgatttgatacatgcagcaagcttggcatgg

SEQ ID NO: 246814 - DNA, 427 bp, Homo sapiens
gaagtactgaaagaacagaactgtgaactgtaaattcaatacccagcaataatattcttcaggcactaaagtgacatagaaaacattgtctaatgaaagaatgctaaggtaatgtgttgctaacaaacttacctttaaagaataagttctctaaacagaaaagaaatgataaaagaagaaggtttgcagcttttacaaacatccatctaaatgggtaaaattaagcataaatataatgtataatcaaacttctcttaagtttttaagccatttctaatagttgaagcaaaaattaaaatacaataatggaaataatagatgcagaggatggtcacaaaagaagagagcacagagcagaagatggaatcagtgaatctgaaaacatgccaacagaatttactgtctgaacaagaagaagaaaaccgat

SEQ ID NO: 246815 - DNA, 261 bp, Homo sapiens
cgccaggacttaaggcaccttctatatctcccagagtgaaatgataaaagaagaaggtttgcagcttttacaaacatccatctaaatgggtaaaattaagcataaatataatgtataatcaaacttctcttaagtttttaagccatttctaatagttgaagcaaaaattaatgacctatctggttagatgctcaaggaacatagaggaagtatttaagataattatatctaaaaagtagtgatagtaaagagactcatatg

SEQ ID NO: 246816 - DNA, 455 bp, Homo sapiens
cagcccctaattgggcaggcaacacacagggagttgggtttgctgacaaggctaagcattttgggcgttgaatacctattatgtgcctagggcattaaagtgataagaaaatctcttaaggtctgccaatgattttgaaattttaacagctcagttttcctgatgccagatgggggacagggagtgggagaactgggtacaagggtgttgctggaggagagatggggacaccctgagggagggttgtcaaatgttggcctaggcacagtgattgggtgactgggaggtgagcgatcagccttctgcacctggaaaatagggcatggctgggcttcccctgtccagcctcattttgtatgaggatcgatatactgtctccatatttgactattctgaagattttgtacaagtggaattatacaataaaaataataattattttaaaaagagaatac

SEQ ID NO: 246817 - DNA, 299 bp, Homo sapiens
atatttgctatctattgctatttattgttcaaaacccagcttggatatcatcccagcaaagccttccctgcactctccctgcaaagtcaactattgcccactcagcagcatgccatagcagacatgcacttttacccaggcacacatatggcattgtactgtcttgttggtttacacgtctgcctttctcccaagactgtgaaatgcttgtgtttttcatcctgatatgtctggcaaccatcatgatgtcttgtcagggttatttgtctaataaaagtttattggcatcaacttaatgt

SEQ ID NO: 246818 - DNA, 447 bp, Homo sapiens
gtgtggaggagacgcagcagctaccactgcaaatgctactcgaggcagagagacggaggaggtggaatgtggcctgtttcctccttgggcccttcggttttccacagtgtctttcactggccttcttgaaatccaggaaacaagagagctggaaaatattggtctctgagttatagcacagggcagagaagggcagaaaatgcacctgaaagaaaacaggcaagtgacctatataccttcttttaggccttctccctcttgtgtaccgcatagcatattaagtggaaaattattataacactcattgtatcacgtggctgtgttttgcttacatatccatctcaacttttatctcttgctttccccagcaccagcactggcacattgcaatttttgaacaaaagatttttgaactaatgaataaataggtgattagatttaattcaa

SEQ ID NO: 246819 - DNA, 400 bp, Homo sapiens
tggatgggaataaactgatctgtatgcaattaaccattaaatgaaacatactgagtaaactgactttgttttttactttatttatttagggacagagccactgttgcccaggctggagtacaatggtgcaatcacagcttactacagcctcgacctcccaggctcaatcaattctcccacctgagcctgccgagtaaacgggactatagacacataccactgtgcctggctaatttttgcatttttaggagagaaagagtttcgtcatgttgcccaggctggccttgaactcttggccttaagcaattctcctgccttggcctcccaaagtgctggtattacaggcataaaccacagcacctggctgactttgttttttaaatcctctatttttaatctg

SEQ ID NO: 246820 - DNA, 473 bp, Homo sapiens
gatggttaaaactgggacaggccaatggagaaggtccttctgtctttggtctgtgatgcgaggaacacagggatctttcctgttgtgtggagaaagaggagcccagagccgtactgagccaagggggtgccagggagaggctgccaggcctgggccctggaaccagccccccaaggccctggaaccagcctgctccatgcagctgcggctcttccagtctgtgagctactcagtgccctttcaacaaaccccgccttgttttgctttaatcagtttgcattttctgttgcttctttctggaaaaatcctctgtgctttgactgactccagggtcttcctccttgaggtggatttcttagtcactgttaggtatccaaatataggcgagtgtaaggcatttttctttcaactgttcattttaatgaattacattcaggaaataagtaggaaattaaattcattgaaagactatt

SEQ ID NO: 246821 - DNA, 431 bp, Homo sapiens
tagtagagacggggtttcaccgtgttagccaggatggtctcaatctcctgacctcgtgatccacctgccttggcctcccgaagtgctgcaggtcacacagcctgatccactgcagggcagcagctccaggcagggcacccgaggagggtttctctagcagtgacatcggcctcagaggtggggcgggtgcagttaagggctgtggagggacacagtgcatgaggccagtgcagagtgactgtgggcagggggacgaggctgggggcccagagcacttggtcttggatgtatggctttggatgagaccgtagggccaccaccaccctagggtgcttgcagatggtggggagggcactctggacgcatctacaaatggcatttgcacaggtcacagatgagcagatgctcaaagagtcgatggctcccaaagg

SEQ ID NO: 246822 - DNA, 638 bp, Homo sapiens
ctttaaagtttcagtcttatagtttcgcacagtcgcctcctacctggtctccctgcatctcttcttaacccctctattcactctttatgtataatccagagcagtgtttttgaaacaatcacatcatgtcacttctgtgcttactcttttccagtagcttcccaacatatttaaaatacaatccaaatttcttaccaagaccagtaaagcctcaaatgagatatgatgtcttcctgtctagaattttataataccaagcctactaataattgaggaactttccactcattttctctgccttgaatgtttttcttccaagtctttattgactttcatttaatcatgtagttcaattgcagcccttcaaaaggcttttccattcatagcagctaataaaataatgatgcttatcctttaccaattactttgccacattactttgctttgtttcattttcacagcagttacttctgttcaaatttatcttgttttagtgtccttttcttttctttccaaaaatgtaagctctaccagtacatgtgctatctctgacttacttgttgtcctatgcctagtacgttaaaacagtgcctagtatgtggtaagttttaaatacaattgttgaatgattggaattc

SEQ ID NO: 246823 - DNA, 407 bp, Homo sapiens
cgggggcagctgatagagagcctagagccgtctcagtgctccaggcgcttggcccctcctttctacacagtggtcaccagcatcctccctggcgtctccttcatgagtgggcactccaccctctgcccggccacctggccccctcctggggaggacagtcaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtgagccgagatcgcgccgctgattccagcctgggcgacaagagtgagactccatctcacacaaaaa

SEQ ID NO: 246824 - DNA, 368 bp, Homo sapiens
acagtagctcatacctgtagtctcagcaactcaagatgctggggtggaaggatcacttgaggccaggaattcaagactagcccggacaacatagcaagaactcatctctaaataaataaaaaatttaaaaattagccaggtgtggtggcatgcaccttcagtcccactacttggaaggctaaagtaggaggatcgcttgagcccaggagttggaggctgcagtgggctgcgatcaagctacctgggtgacagaatgagaccccatctctaaaaagaaaagaaaagaaattatgtgtatatgaactaggtgacaccagtagcttgaggtatgatcaagctgcccaggtgacggagtgaccccatctcta

SEQ ID NO: 246825 - DNA, 445 bp, Homo sapiens
ccccttaatgcctggggcctgtggtgccgccgccgctccgagtgtgggcccccgagcctgcgcccacccggaactcatgctgcctgcgagccccatgcgcagccctgttcccacctgcgcctctccctccacacctctctgccagccaagggagctgctccggcctcgaccaacccagagaggggctcccacagtgcagcggctggctaaagggctcctcaagcgtggccagagcggacgctgaggccggggaggcgctgagagtgagcgagggctgctaacacgttgtcacctctcactattgctgcccctttcccatggcctgagctaaaagccatagaaagtgtgtgtatgtgtgtgtgtttaggggttgctgggcaggggaagggtgggacaccatcattccacaagacctcgaagttactcctcccatagaaaaatgaaa

SEQ ID NO: 246826 - DNA, 1827 bp, Homo sapiens
cgcctcgccggcgcgcggctctctcagcgtcccaagagccactttctcgccagtacgatgctgcagcggttttccggttttccgcttcccttcatcgtagctcccgtactcatttttagccactgctgccggtttttatatccttctccatcatgcatcgtgagcctgcgaaaaagaaggcagaaaagcggctgtttgacgcctcatccttcgggaaggaccttctggccggcggagtcgcggcagctgtgtccaagacagcggtggcgcccatcgagcgggtgaagctgctgctgcaggtgcaggcgtcgtcgaagcagatcagccccgaggcgcggtacaaaggcatggtggactgcctggtgcggattcctcgcgagcagggtttcttcagtttttggcgtggcaatttggcaaatgttattcggtattttccaacacaagctctaaactttgcttttaaggacaaatacaagcagctattcatgtctggagttaataaagaaaaacagttctggaggtggtttttggcaaacctggcttctggtggagctgctggggcaacatccttatgtgtagtatatcctctagattttgcccgaacccgattaggtgtcgatattggaaaaggtcctgaggagcgacaattcaagggtttaggtgactgtattatgaaaatagcaaaatcagatggaattgctggtttataccaagggtttggtgtttcagtacagggcatcattgtgtaccgagcctcttattttggagcttatgacacagttaagggtttattaccaaagccaaagaaaactccatttcttgtctcctttttcattgctcaagttgtgactacatgctctggaatactttcttatccctttgacacagttagaagacgtatgatgatgcagagtggtgaggctaaacggcaatataaaggaaccttagactgctttgtgaagatataccaacatgaaggaatcagttccttttttcgtggcgccttctccaatgttcttcgcggtacagggggtgctttggtgttggtattatatgataaaattaaagaattctttcatattgatattggtggtaggtaatcgggagagtaaattaagaaatacatggatttaacttgttaaacatacaaattacatagctgccatttgcatacattttgatagtgttattgtctgtattttgttaaagtgctagttctgcaataaagcatacattttttcaagaatttaaatactaaaaatcagataaatgtggattttcctcccacttagactcaaacacattttagtgtgatatttcatttattataggtagtatattttaatttgttagtttaaaattctttttatgattaaaaattaatcatataatcctagattaatgctgaaatctaggaaatgaaagtagcgtcttttaaattgctattcatttaatatacctgttttcccatcttttgaagtcatatggtatgacatatttcttaaaagcttatcaatagatgtcatcatatgtgtaggcagaaataagctttgttctatatctcttctaagacagttgttattactgtgtataatatttacagtatcagcctttgattatagatgtgatcatttaaaatttgataatgactttagtgacattataaaactgaaactggaaaataaaatggcttatctgctgatgtttatctttaaaataaataaaatcttgctagtgtgaatatatcttagaacaaaaggtatcctcttgaaaattagtttgtatattttgttgacaataaaggaagcttaactgttaaaaaaaaaa

SEQ ID NO: 246827 - DNA, 718 bp, Homo sapiens
cgcctcgccggcgcgcggctctctcagcgtcccaagagccactttctcgccagtacgatgctgcagcggttttccggttttccgcttcccttcatcgtagctcccgtactcatttttagccactgctgccggtttttatatccttctccatcatgcatcgtgagcctgcgaaaaagaaggcagaaaagcggctgtttgacgcctcatccttcgggaaggaccttctggccggcggagtcgcggcagctgtgtccaagacagcggtggcgcccatcgagcgggtgaagctgctgctgcaggtgcaggcgtcgtcgaagcagatcagccccgaggcgcggtacaaaggcatggtggactgcctggtgcggattcctcgcgagcagggtttcttcagtttttggcgtggcaatttggcaaatgttattcggtattttccaacacaagctctaaactttgcttttaaggacaaatacaagcagctattcatgtctggagttaataaagaaaaacagctccagccagacggtgtcctctccatggaaaactaccttttctaggctcagggaaacagctccctttccttgcctctttgggactagggatgggaagggcccccactgttgctagtcccaagggactgcactctcctccttggtttctctaaacctgcccacacctttataaagagtcgctgttattaaagtcctgttacattaaa

SEQ ID NO: 246828 - DNA, 1583 bp, Homo sapiens
gtggggtgactcaggctgccaatgcaggtgagcaggttctttgaatgcctggagatctgcctgtgtataaagcagagagggccccactgcaccacaatctctgcacagaaagggtagggtggctcaggctgctcatctaggtttcttcagtttttggcgtggcaatttggcaaatgttattcggtattttccaacacaagctctaaactttgcttttaaggacaaatacaagcagctattcatgtctggagttaataaagaaaaacagttctggaggtggtttttggcaaacctggcttctggtggagctgctggggcaacatccttatgtgtagtatatcctctagattttgcccgaacccgattaggtgtcgatattggaaaaggtcctgaggagcgacaattcaagggtttaggtgactgtattatgaaaatagcaaaatcagatggaattgctggtttataccaagggtttggtgtttcagtacagggcatcattgtgtaccgagcctcttattttggagcttatgacacagttaagggtttattaccaaagccaaagaaaactccatttcttgtctcctttttcattgctcaagttgtgactacatgctctggaatactttcttatccctttgacacagttagaagacgtatgatgatgcagagtggtgaggctaaacggcaatataaaggaaccttagactgctttgtgaagatataccaacatgaaggaatcagttccttttttcgtggcgccttctccaatgttcttcgcggtacagggggtgctttggtgttggtattatatgataaaattaaagaattctttcatattgatattggtggtaggtaatcgggagagtaaattaagaaatacatggatttaacttgttaaacatacaaattacatagctgccatttgcatacattttgatagtgttattgtctgtattttgttaaagtgctagttctgcaataaagcatacattttttcaagaatttaaatactaaaaatcagataaatgtggattttcctcccacttagactcaaacacattttagtgtgatatttcatttattataggtagtatattttaatttgttagtttaaaattctttttatgattaaaaattaatcatataatcctagattaatgctgaaatctaggaaatgaaagtagcgtcttttaaattgctattcatttaatatacctgttttcccatcttttgaagtcatatggtatgacatatttcttaaaagcttatcaatagatgtcatcatatgtgtaggcagaaataagctttgttctatatctcttctaagacagttgttattactgtgtataatatttacagtatcagcctttgattatagatgtgatcatttaaaatttgataatgactttagtgacattataaaactgaaactggaaaataaaatggcttatctgctgatgtttatctttaaaataaataaaatcttgctagtgtgaatatatcttagaacaaaaggtatcctcttgaaaattagtttgtatattttgttgacaataaaggaagcttaactgttaaaaaaaaaa

SEQ ID NO: 246829 - DNA, 447 bp, Homo sapiens
aagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcatggaatgagtaattattacagtggagaactcctcactgtgaattaattacacagatgatattcaagacttagactgggctagtgcaggggttagcaaactatggcccactgttcttgttttataaataaagtgttatgagcaca

SEQ ID NO: 246830 - DNA, 549 bp, Homo sapiens
gcctgagtgactgagtgaatgagactccatctctaaataaataaataaatcaagaaaattccccctttctttccttgtaaagatgtaatttgccaactcaagttgagaggatattaaaaaatcaaatatgtttataatataaataattatgtactgatattttgtttcttaggttaattaggtcatcaatgtgcaactactataataaatccatataaacacatccatatttgttgggcatttacaaagaattctgaggactaatatatttcacagaatttatcttatttagtccaattttctgaacatgtagttaaaactatccagaatcattcagttatccaagacttacctgtaaaattatagtcagactatatgattttcaaggatcatttcagaaataaaattctgcacagtattgaattacatgggataactagatcaaatgcagcagatataaaatagaacaggttttattttaaacctttgttctacaaaaatccataaaattgggcttcaacacattttaaatgttagaaggactgaact

SEQ ID NO: 246831 - DNA, 353 bp, Homo sapiens
tgaacacaagctacttctgaacactattttagcaaacagaattttagaagcataaggctctagcagagggctatacagaattttgcataaactaaataacaaccgtttcctcctgaaatgcaggaaatcaagctgcacgggtatgtttgctgattgggtgagtgaatgagtgagtcaatcagtgaaaactccaggctcctttactcttcctacctttctttaacatccttaaacttttatttgaattttttaaagtttgtaaattgttttgcttgtccatcttggactgtcagtttctgccaccaaaaaaaaaaaggagtaaaattaattttaattgactttaatttcaaaaa

SEQ ID NO: 246832 - DNA, 764 bp, Homo sapiens
agctgggattataggtgcccacgaccatacctaggtaatttttgtgttttagtagagacaggatttcaccatgttggccaggctggtctcaaacttgagacctcaggtgattcacccgccttggcctcccaaagtgttggaattacaggcgtgagccacagcgcccggccttcatttttaaagtacatgaaaaaactatttatgacaatgttgagttttacctaagcactgtgctcctagagaacagcaatgattaaccccttaccccctaaccccacctcaaccccgtctctcgggttctggaaatggctcactgcaatgactgagataaaactcatggattcccctctatggcgattccccactataccctgttactagaccggatacagatagccccaattcccatttgcctcataagtgactagctgaaatgcttggcccattgatcagctctgaattttggcccaccctcagcctaaaccagcatgaaatccctctgtaacagcccccttgagaacaggctggcctcaggataaagcaatctctgatctactgccccaccctgtcactctcgttcatcccacttacctacaccaggttctttctagactggtttactccttcctataaaagaaaatccctttttacctaccccttgagagtttgtagatttatggcctgagtgttctccctgtttacagagtcttaccaccctcaccccaccccaaaatcatccttttaaataaaatctctctttatca

SEQ ID NO: 246833 - DNA, 463 bp, Homo sapiens
acacacacccacggcagttacagcaggtaatttatctcctagcacgcaagtctctcccccatttcctcactggtcgagtactatggggttacaatcttcccagacgttgcctaagtttcattatcccccttataaggttataccccagtccccttcctcacttaagtttcgattttccgatagcaaaacttttccctttcatgggctgacccctcctctacattctgatcacttatagtgactttctaggtgcatgagctgtgtggtttgtcacatctgcaggttgactgccagtacttagatttagcatgccttgaaaatggatcatttaaaatgttttctcacacaatggcactcttttcaccaggttttccttttttttaaattgtcgttttccatcaaaattctagttaatcatgcagtggaagtttattatgtttaaataaattttaaaaagtttaag

SEQ ID NO: 246834 - DNA, 425 bp, Homo sapiens
cccccctaagggacagggtcttattctgtcacccaggctggcgtacagtggtgctatcatatagctcaacttcttggcctcagcgatccttccacattagcctcccaagtagctgggactataggcatgtgccaccaggcccagctactttttaaattttttgtataaaggggtcttgctatgttgcccaggctggtctcgaactcctgacctcaaatgatcctcccaccacagcatcccaaagtgttgggattataggcatgagtcaccatgcttggccatgttccaatctcatagatgagaaaatgaagacagttaaaagtcacaaagctgggattcaaaaaccaggaagtgagttctcaaaaatatgatgtattctgtctcccacatttatttaagtaaaaacccaaatcatttgatgcttc

SEQ ID NO: 246835 - DNA, 362 bp, Homo sapiens
tagctcgcacctgtaatcccagcactttgggaggctgaggcgggcagatcacgaggtcaggagttcaagaccagactggccaacatggtgaaaccccatctctgctaaaaatataaaaattagccgggcatggtggcaggcgcctgtaatcccagctactcgagaggctgaggcaggagaatcacttgaacctgggaggtggaggttgcagtgagccaagatcgcgccactgcactccaacttgggcgacaaagcaagacttttctcttgatatgaatattctccaagacaagtgttggttgctttaataggtaggatcaattcctgagactgcctaacatgggctggggtctacaacccag

SEQ ID NO: 246836 - DNA, 276 bp, Homo sapiens
gtgcacacacacacacacacacacatactcaaagactacttttccaacaagtgcacattttaaaactactctttggcagaaactgtactagtattagaggacacgaacatgacttaaggaggtaccctgccttatctgcaagggagtatctagttgaaaaaaaaaaaaaacaatattgtgaaattttcccctcatctttgcctcattttttcctgtgagtcatgaaacaaatatttcttgagaacgactggtaattaaacaagtatttgcagaaat

SEQ ID NO: 246837 - DNA, 407 bp, Homo sapiens
gtttttaacattcttttgttcccatttccaattgttggcatttctttgtagatttacgtattaaaaacaagaacgactgtcaggaaggcgaggaagcactgcctaacagagcatggcagtggtggaaaagcagaccagggagcccacaaggagacaatgatagagaagtctttctttgggagagcatccttagctgtggaacaggccgagatgcttacagaggaaggatggacctctgtataagctctgtagccttctcagtaaaaagtaaacagaaaaaaatggggggagagaaggaatgaagaaagtgagtctatggccttagtgcttctctgcttaggatagagcactggcaagcatatgaaaacacatacatttcattgctaaaaataaagaatcaaaagtgc

SEQ ID NO: 246838 - DNA, 330 bp, Homo sapiens
ttgatatattctgatttagttgggcctgacatttgtttttgccactcattacatgattaatttatttctgctctaaaaggagttcattctgcctgagtgcagtgactcattcctgtaatcccagcactttaggaggccaaggcaggaagactacttgagtccaggagtttgagaccagctaaggcagtatagtgagactccgtctacaaaaaaataaattagccaggcatggtggtgcacacctgtggttaagcccaggaactccaggctgcattgagctgtgattgtggccatggcactcagcctgaacaacaaagcaagacactgtgt

SEQ ID NO: 246839 - DNA, 469 bp, Homo sapiens
acagtaagtctccagaacttacttcatctgcaggtttgtactctgaccaacatcatcttatttcactccccaccccactttcagcactggtaaccacatttctattctaagccttctggtgaaatttctttcttatttcactcccagtgagtaacacaagagaaaaataaacaacaaaagccagtcaataattataaagtgaatcttaccagtatagagttataagccttgtttttacttcactgataatgttgtcgtgaacactgtttgaataatgaagactaaaggaatgatggcatgcactgtgagttcttgatgtggttgaagcaaaattcccaacaaacagacattttgctatttcattagtgtttatggctgataaataccttgtatgtttgctatactattgtgttagtaacataattttatttttatgtaacactaacaataaatagataaaagcaaaatt

SEQ ID NO: 246840 - DNA, 693 bp, Homo sapiens
gcagaaattgacaagctaatcctaaaatccatttgaaaatgtaagagacccacaatacccaaaacaatcttaaatggaacactcacttctgatttcaaaagttactataactaagtaatcaagactatgtggtactgccatatacacatatatatcatcaaaacagaattgagagtctagaaacaaacccttatatttatggtccactgatttttgacaaggatgccaagacaatgcaatgggcaaggaaaaaaagagggacaataagtgttgccaacggtatggaaaacctggagccctcatatactgctgctgggaatataaaatgatgcagctactttggaaaatagtctggcactggtagttcctcaaaaagttaaacacagttgccatgtaacccattaattccacttctaagcatatactcaaacaaaaccatatgtccaaacaaaaacttgtacatgaacgttcatagcagcactactgataatagccaaaaagtaaaaacaacccaaatatccatcaactaatgagtggataaacagtatgtagtacagccatacaataaaatatcatgcagacataaaaaggaatatatgccacaacatgaatgaaccttgaaagggctgtgttaagtgaaataagccagacatagaagacctcatatggtatgagtctatataaaaagtccag

SEQ ID NO: 246841 - DNA, 446 bp, Homo sapiens
ctccctcttcttcccaataaaaacctgaactcaaagaaaagaactggaataatcctccctatcccacttcccatggtgagccccagctgggacgctgacacatggccccaactttttctcctgcctgatgtctggacccacaggggacagatggtggtccctggtcactgaagtacccacagaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttaaaat

SEQ ID NO: 246842 - DNA, 580 bp, Homo sapiens
ctccctcttcttcccaataaaaacctgaactcaaagaaaagaactggaataatcctccctatcccacttcccatggtgagccccagctgggacgctgacacatggccccaactttttctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtg

SEQ ID NO: 246843 - DNA, 604 bp, Homo sapiens
accaacccccgggggccccccgcctagtatttcgggggtactcgggggggacccccttttttacaaactggaataatcctccctatcccacttcccatggtgagccccagctgggacgctgacacatggccccaactttttctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtg

SEQ ID NO: 246844 - DNA, 339 bp, Homo sapiens
ctccctcttcttcccaataaaaacctgaactcaaagaaaagaactggaataatcctccctatcccacttcccatgaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttaaaat

SEQ ID NO: 246845 - DNA, 294 bp, Homo sapiens
agcggctttgaataaagactgaagaacacgaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttaaaat

SEQ ID NO: 246846 - DNA, 121 bp, Homo sapiens
cttgttgcaaggaggtttaaaaagtaatgttcatttctgcatcagtttcagccaaatgttgatattaaaaccttttattcttttttttaatttttgcctctagatgtgatgccttaagata

SEQ ID NO: 246847 - DNA, 478 bp, Homo sapiens
cagaaagtgcaacactttctcatggtcacgggtgagcacgaaacatctctccaaatatgggttgggaagattaagagactagtccagaagaaaacagtctccagggagaaatatatctgggaataggaatcgagaaagcaaccaagagagcagaactgagtggatgagaggaactgtcagaccacatctgcagctctgattagtcaaatccgaaatgtgcctgttgatctactattccgtggaaatactggaatcaccagctcaataataagaggaaagtaaataataccatacttgcgtggataattcccctctgctcataccttcattcaggtcaacatagatctatcatactcctacagtgtataagggacgtgctaagcttgaagtacattcattctaaaaatcaaaatacaaaggcatgggaagactaagaaaatttcataaaccttcattaaattatcagaaataaaaagga

SEQ ID NO: 246848 - DNA, 578 bp, Homo sapiens
aggataagggggaatcagagcttaagggaagaggagttacaattttgaatagggtggccagggtaggcctcatagagaagataacatttgagcaacacatccatggaggcaagggagtaagccatgcagctcttagagaagaccatactaggcagcgaagggcctagggtgaagtggtactgggacaaaaaggccaaagtggagggggaaggcgccttccctgtacttagtaaacatttgtttctgagaagagactaccagctagcagaatgaactgcatggacgttactgcttaatctgatgctcttatacaattaaaggatttgctctgctctcaactgtaatcttagtactgctgaattgtgtactgacactgcaggaaacagctctgttcagcaaagcgctgctacaaaggttctccatgtgcgcctgtacatggacaattaagttttaacaacaaaattagcagaacaactggatgttctggaagttgagatcccttcacttcattttttttccatcaaccgcagatgacgccgatgtaacgtcgctttcccgctaggtttatcctctagagg

SEQ ID NO: 246849 - DNA, 1043 bp, Homo sapiens
aggataagggggaatcagagcttaagggaagaggagttacaattttgaatagggtggccagggtaggcctcatagagaagataacatttgagcaacacatccatggaggcaagggagtaagccatgcagctcttagagaagaccatactaggcagcgaagggcctagggtgaagtggtactgggacaaaaaggccaaagtggagggggaaggcgccttccctgtacttagtaaacatttgtttctgagaagagactaccagctagcagaatgaactgcatggacgttactgcttaatctgatgctcttatacaattaaaggatttgctctgctctcaactgtaatcttagtactgctgaattgtgtactgacactgcaggaaacagctctgttcagcaaagcgctgctacaaaggttctccatgtgcgcctgtacatggacaattaagttttaacaacaaaattagcagaacaactggatgttctggaagttgagatcccttcacttcattttttttccttcccccgctgccaaggagttatcctgtggactgcccgaaagatccgcctgtcaggattgtcttacaagtgttctgagttgctgtgcaaacagcaacttcctccagattaattgttgaggatgtattacacctagtgtaaaaatgactgttaaactgctgttgagtaaatctcaaaattactgttaaaatgctgctgagtaattctcaattctctcagagaattaattgccttctaacatttgcttccagttgcaagcacctatgatttttaagagactttgtataaaatataccatttctgcatagagaaccaaattgctttcggtacattgtagttttcttagccatttttcaatagtctacacagtgtttatgtttccttttatttgtgtatagtggagtagaggggaggtttttttattcaaatagaagaagctaaaactcaaatgcaatgtcagatctcagaataaactgacccaatttctgaaacccaataaacacatttcatttgtaatattcttta

SEQ ID NO: 246850 - DNA, 564 bp, Homo sapiens
cagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatgtgagtgtcccatagggatggggagggcagtcgggaagtcttttcttacccacctccctctggacccacctttgtcaaggtgactcagggtgcactattggtgtctctttaaagagagcttcatcctaaggggcacaaaagaaataggagacttgactgagtgcagcccagcactttgggaggctgaggcaggcagattgcctgagcccaggagttcgagagcaccctgggcaacatgatgaaaccccgtctctacca

SEQ ID NO: 246851 - DNA, 696 bp, Homo sapiens
cagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtgg

SEQ ID NO: 246852 - DNA, 736 bp, Homo sapiens
tttttacctagtgatcataatcacattctactatcttcagctaattgcctttctccatttgcttttttttaaaaaaatggcatgatacgttttcagtgctagtttaaaaggaataagagcagagctttgttggaggagccattttatttaaaaaaaatctgtatctagaacatttggggatattctgaaaattaagttcccctcccaaaactgtaaaagtagagatttcgaaatatatgacaaaactccaaaacagctagttgagcaagctttaaaaacttactgtttaatttagatacagtataattcatttttttggtgcccagttctgtgagctttgacaaatgcgtagagttgtgtaaccaccaccacaatcaagagataattgcatcactcctaaacagttgtttatcaagttttacatcacctgaagacacagacctattactgttagcctgtaaatgtacaaaagataagatgagtatattgttagtactggtcactaaatggaaacaatgtggattatgtcttgctaaaatatcagaataacaaattcagcttgtgtgaattgttcctatgctcctatgctaaactcagtgtgctaaaactctgactttaaacatttatagaatgataagactaaactttctatgtttctcagggttaaaatgataatgcagataacaaaatgatgaaattttgtacttggatttaagctggctaaaattattcagtt

SEQ ID NO: 246853 - DNA, 660 bp, Homo sapiens
aactgggacttttaaaaccatcagatctcatgagaaatccctcactatcatcagaacagcatggcggaaaccgtcctcatgatccaatcacctcccaccaggtcccttccttgacatgtggggattataattagagatgagatttgaatgggcacacagagccaaaccatattacatatgtccacaaaattatctgtatgtgaatgtttatagcagttttatccacagtaactccagactcaaaatcatctaaatgtccattttctagtgtatagcgtacatacaatgaaataccacttggcaataaaagggaataaactactggaatatgcaacaacatggatgaatttcaaaagcattatgctctgtgaaggaagttaaacacagaaggcaacgtaatgtgtaattccttttatcatgcagttcaaaaaataagactataggaacagaaatttagatattggggaagcagattgatccaaaggagcacaggagaatttctagaaataatggaaatactctatctcaatcaattgatgattacataactatatatgtttgtcaaaactcattgaactgggaagccaaggcaggaagattgcatgaggccaggaattcaagactaaactggacaacacagtgagaatctgcctctacaaa

SEQ ID NO: 246854 - DNA, 194 bp, Homo sapiens
taaatgatctatctctacattatccagctgtgcatctcaatctctacggcattttattctttcatctttccctgaggatgttcagtgtggagcctaaatttttccgtccagagaacacatttcaaccacctgaaaaatgtctgagctttttgtcatatcataatcatcacttagagatcttttcttctctggga

SEQ ID NO: 246855 - DNA, 558 bp, Homo sapiens
aattgtgtcccactcagtgaaacttctctggaaagctgtaaggtatagtccagagacgagaggaagggaagaagaaatttatcctctgggagcctcccatttcctgtctcctaatagtgagaatttttccatgagaagttaatgtccctatactttcacaatgtgttaccttcttttgttgctgttcaagatgccaagcctatgccctgcagtgtggccttttgtcagagtccataaagggcaggaggaactaggaactctgggtgtgtatggttggcccagctgcagagttgacagtcaaggggataaccaactctaatcagcctagaagggaacttggtagcctaggtgagttggtcaggcacaggctggggctaaggcaaggcaaatggctgaggtctaagacgtaggtggtgctgagaaaatgtggggaagcatacaagatttgtgactgatgagtaatattctagttcttggttaggataatgggtacatggggtgttccttttattattttcaaaatgaaatgaaataaaagagggatatgtgtggactgat

SEQ ID NO: 246856 - DNA, 293 bp, Homo sapiens
aggaaacatttgggctaggccttaaaaaataaataggaattaattaggaggatactggggatgttataatgtaggaatttatagaagtcaaagttttgtgtgatcggaatgagtataaactacttcagacctacaacctgaaggacattggtagatgctgccaacaatcaagaaagttcttcactttgcagccattattgcaataacagaaaaccagactcctttgtcaaaggacactcgaaatccataagtcaaaaaccctaataaaagatttttccggctttagtgttttc

SEQ ID NO: 246857 - DNA, 774 bp, Homo sapiens
agtggatcaacaaacaagacccaactatgtgttctctacaagaaaccctctttaaatataaagacacatacatgtacattaaaagtaagtggatagaggccaggcatggtggctcacacctgtaatcccaagcactttgggagaccaaggcaggcggattgcctgagctcaggagttcaagaccagcctgggcaacatggtgaaaccccatctctgctaaaaatacaaaacttagccaggcttggtggcgcacacctgtaataccagctacttgggaggctgaggcaggagaatcacttgaacccaggaagtggaggttgcagtgagctgagatcacaccactgcactccagtctaggtgacacagcgagactctgtctcaaaaaaaaaaaagtaagtgcatagaaaaagatataccatgctaacactaatgaaaagaaagtaggagttcctatattagtttcagaaggagatttcaaggaaagttatcagggataaagagggatattacataacgataaaggtgttcattctccaagaagacataagaacacctaacattgcatgtacctaagaacacagcatcaaatacatgagataaaaactgatagaactgcaaggaaaaatagttgcatccactatgaagttggagttacagttggaggcttcaacatctctctatcagaaataacacaaagccagcaggtaaaaaatcagtaaggactaactcattgtatgaggccaacattaccctaatatcaaaaacaaagatatt

SEQ ID NO: 246858 - DNA, 393 bp, Homo sapiens
atgagatgggaaaatgcaatgagcatgctgacaccctccccaaaccttagagaaggaattaggggcaggcctgaagcaggaatttcagagggtaggccttagctctgagctccactgcactgtcacctccaggagggcccagggaggggcttcacctttgtgaccccacagcacccagaaggccctaaacagaggccagaaatgttgccttgagctgacttgaggtgacgtcacagactccagacctcaaaatgagtatttctttttatgtcagcctgatttgtgttacagtgcttagtacggcactgccataaatctcacacacacacacgcacacacacactcacccacacaccccttcattttttttaatttacattctttatatactgt

SEQ ID NO: 246859 - DNA, 490 bp, Homo sapiens
tacaaaagttgcatttgctttcctagccaaattagcattttgctctctttcccatgtttctgtatctgaaagggaggctgcatatgctacgctgtcagcttttccagcaacactcacaaatattttccttatgctgcaaactaagcccttgattcagtgtctcacccagtagacattattcattttgaaacaacacagctgtatttcagattttatgtctgatacctttcctccatgagttaagttgcaaaagtaagcaaaaatatggagagaagtgcctttaataaatttcactgagagagagaaagagagagaacctgtcaatgcaatcaacattcaaaggctaaaagcagggtgtaactgttgttaagaggtgaaccagaacttttggaacagatatggaacacaggatatgtatttttaaaaattgttgccaattctattggtttatttaccattgaacatcattccttcaataaaatgtgtatac

SEQ ID NO: 246860 - DNA, 228 bp, Homo sapiens
gtttatgtacatgaaatattctgatatccttctcataaaatctctttttgcctaagtaaattcaagctggagtttcatgacttgtatctagtgttcataactaatacagttgttcagttttaggagttaaaatggttcttactgttgaattggactatctaactgtacccgaaaagtgctgtctttttaatgcaaacagtaaagttaataaaaaatagttgcagatct

SEQ ID NO: 246861 - DNA, 344 bp, Homo sapiens
agctgattctacttaaaaaacacattacttaaaagtgaggagtatcaaaaactcagaaggaattaataaagaatacttcatcttgcttaagagtcaaccccatcattctctaattctcattctctattccttaaagcccacatttgctactaaatttagataccgatgtgtcctttgttcaagtttggttagaaaaaaaatattaaaaaagcatatttaaggaaaagaaagagcaaaatagtcttggctttttattaaataccccttaaaagcagtaaatccaattacagatccagtctggatatcacattatagtaattttcttaaaattctgaatgaagcat

SEQ ID NO: 246862 - DNA, 324 bp, Homo sapiens
aggaaagagatgttggcaggcagtgagaaggcttgagctaccgctccagtatgagcaagccagctgcacaacctcaagccagtcgctgaacaacagtttcctcatctgtacaaacagagataatgacagccaccctgcctacttcaaagatctgcagtggtaactaacaagtattcctccagtgatgctgtgaccaaggtctgacagatactaagaaacaattatgtaaagacagggttcctgccacagggaattttacagtctggctgagaaaactagacactttcctatgataagataaatagtatgggcaaagtgccaagt

SEQ ID NO: 246863 - DNA, 477 bp, Homo sapiens
ttcaaagcatagagcaaacatcaattaatcctcaaaagacgctttcaagaagaacattatcccttttggagacgcagaagctaagaggtgccgcaggagaccacggagtgaaaaaagttggaggcctaagtacagccgtgtgtacccagccgggcaccagagttaagacaactggacttgtgctcaaaaacccttctttagtaaaacaacccgtaggagtctgtgggaggaggaaaaattgaagtctggatgcaatttgccacactgagtctgttctggtaaccgcccccaacacactcacacccccttgcctgaaatggggagaggggtgggatcggtgtgtgtaaacagaggcactgccctgcctggctgctctttccatcttaggagaaccaatccagaactttctacggctcacactctgatcacagcctgtcgccatgattggcaataaacgtcacacattctcacgttata

SEQ ID NO: 246864 - DNA, 371 bp, Homo sapiens
caaggctggttttaaattttttctagaaacgaggtctcgctatattgcccaggctggtcttaaattcctagctcaatcagttctcccaccttggcctcctaaagtgttgggattataggtgtgagccatggaggctggccaggaacttgattttcagggagaagcctattcagtgtttccttggacttcctcagcctggttttatcatagcatattataagatgataaactgaaaccatctgatttgaaatcaccaacctgggaaataccagtcagaaattaattctatttttatgacattcttaaaagactgtttaaaactgaccaaagtaaaaaatcttcttttagagttataagtgtgtaaaaaaagg

SEQ ID NO: 246865 - DNA, 395 bp, Homo sapiens
atataagggatagtagggcaaacatatgcattcattcatttttgcatcaaatcactcttatgtactgcactgtgttaagcccaggtcatctagcagtgaatcaaggacataagattcctatcccttatgaggtctacaggaataaagaactgaaatgtgtttggccaggagcagtgtgatctttttgaagtttataagctccatatattggtaacttaaaaatttgcctatacctattttttgacaatatggaaaacatcagctgggcacagctgtggctcatacctgtaatcccagagctttcagaggctcaggtggaaactgaggtgagaggatggcttgagttcaggagtttgagaccagggtgggtaacaaagcaggacctcacctctacc

SEQ ID NO: 246866 - DNA, 403 bp, Homo sapiens
tcaggatggcaggggtgattaacttggtgtgtgttttacagataagtaaggattttgaactaatctgtacatagggatatttggtcaggcctgaagatttaattgaacttggcattcacacaattagtttggtttgtttactttcttatatcattaacaaacttactaaaaaggagatacaaataaactttgtgccaattacataagaaaataattggattttattaacccaggaactcaggcaatcaattaaggcaggtgtactctggtctcagtcacctcattattctttatatgctaatttaatcacaaatactaatggattgtatagaaatgagacactttattccattaaacaacatataaaagctcttaaagtggcaatgcttgtttccttgacaaa

SEQ ID NO: 246867 - DNA, 407 bp, Homo sapiens
cccctagtgtttttgagttgccggaggttgtgagaatttgcatttggaacaagttctcaagtgatactgacactgttggtcctggggccacgctttgagaaccattctttcagctttttggaatcttaagaactttagaagtctagtccacaggctccgtactgatggaggtaccagcaagggcttccttttccacttcaagagaaagaacaataagtttcaaaatttgaagaacacattgacctagcattgaagaaagcaaactctaagaacctcttcaccaaaagtattttattgttggaaaaacacctgatttcagaagtttgcaatttacgtacatagaaagtttatcaaagataacaatgattctgttttccttacaataaatgaattctaaaacatgcgaa

SEQ ID NO: 246868 - DNA, 473 bp, Homo sapiens
atttagttagactggatcttatttaaattttggagtatattgatactattgttttagcaagcaatcaccctggtgagatgaagacaatctgtgggatctggttccaatgtcagttccattctgaaagcctttgtagtgctattcagacatgtgcatcaaccaggggtgaaattgggaactgtgcaatgctctactcattagttcaggtcttagcatctttagtgtgccaattagaaccatatctaggcatgcataagttgaggggcaggtgaatccaggagtttatgaataatgttcatgggtctctttctaaagtttcttcctcttcaccatctgacccgtactttcaggttcccaggggcttctcctttccatcctccagctagaaatgcgggcctccttttattctgatgaaccatatacttctgcaattatagctgcatctttaagctcatgtggcagacggacagtga

SEQ ID NO: 246869 - DNA, 745 bp, Homo sapiens
gggcaggtgctggtgcaactgctgtgggcgctgaagggtgtcttcgaggccggagccccaggcactggcggccacacgtgctcttggggagatgctggctgtttcgggctgcgtgggagccacgaggggcttctacccacatctgctgcttgcgctggtcacacagctgcacaagctggcccgcagcccgtgctcccccgacatgcccaagatttgggttctgtcccaccgagggccaccacatagccatgccagctgtgctgtggaggccttgaaggcgctgctcaccggggatggaggccgcatggtggtcacgtgcatggagcaggcaggaggctggaggaggctggtgggagcccacacccacctggagggcgtcctgctgctggccagggctgttgcagagccggcccaccgcacggctcctgcgggaggaggtcatcctggagcgactcctcacctggcagggagaccccgaacccactgtgcgctggttgggcctgctgggcctgggccacctcgcgctgaatcgcaggaaggtgcggcacgtgagcacgctgctgccggcgctcctgggcgcactgggcgaaggcgacgcgcggctcgtgggtgcagcgctgggcgccctgaggaggctcctgctgcggccccgggcgcctgtgcggctcctgagcgcggagctgggaccgcgcctccctccgctactggacgacacacgggactcaatccgcgcctcggccgtcgg

SEQ ID NO: 246870 - DNA, 498 bp, Homo sapiens
agctatccatgcagtccgggaggggagccagacagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtaaaactgcatt

SEQ ID NO: 246871 - DNA, 809 bp, Homo sapiens
ggtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagatgaatggaaaccaa

SEQ ID NO: 246872 - DNA, 783 bp, Homo sapiens
ggtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagatgaatggaaaccaa

SEQ ID NO: 246873 - DNA, 828 bp, Homo sapiens
  misc_feature (792)..(792): n is a, c, g, or t
ggtagcgcttgctgagcggcggcggcaaccgacgtacacaaggggcttgagcgttctgtggagagagtgcgagagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtagagaatgaatggaaaccagctgatatattcagtactctnggggaaaaggaatgtgatagagttcgttggaagcaa

SEQ ID NO: 246874 - DNA, 879 bp, Homo sapiens
  misc_feature (843)..(843): n is a, c, g, or t
ggtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtagagaatgaatggaaaccagctgatatattcagtactctnggggaaaaggaatgtgatagagttcgttggaagcaa

SEQ ID NO: 246875 - DNA, 859 bp, Homo sapiens
  misc_feature (823)..(823): n is a, c, g, or t
aaagttcctgaagtaagataatttctagttgttgatgaagatttgcaagtattaagagttagtttcttatggttatattacctaaatagcaaaatggaaaaaagtttagaggactgatttatcacagatcatataaagataattggtgatttttcttggacagttataaagaataagcttctggtgttttaacagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtagagaatgaatggaaaccagctgatatattcagtactctnggggaaaaggaatgtgatagagttcgttggaagcaa

SEQ ID NO: 246876 - DNA, 880 bp, Homo sapiens
ggtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaatagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagatgaatggaaaccaa

SEQ ID NO: 246877 - DNA, 778 bp, Homo sapiens
gactgcaggacggcatggtcccatgtagagagagtgagctagccacctgtggacgcataatagtgctgaaccaggatatcaaatactggaatgcaaagggcgtgatgtggttcgactacatataatacattgttggcagtgaattgtgaaatatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagatgaatggaaaccaa

SEQ ID NO: 246878 - DNA, 960 bp, Homo sapiens
ggtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaatagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaacaccgtaaatacatctctagtaggtaaacagaagcctcacaaaaaacacatcacagctgaaaacatgaagagcagtttggtgtgtctaacacaagaccaactacaacagattttgatgactgtaaaccaaggaaatagatctctttccctgactgagaatggaaaggaggcaaaaagtcaatatagtctatattaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatagagatgaatggaaaccaa

SEQ ID NO: 246879 - DNA, 747 bp, Homo sapiens
cccacttgttgaattattgtaatctccatagtttgttctttaaacacagctgaactctatctcattatcatcaagtttaacatatatgtggtcaaagtgctttcctaattctatcaaaatctgtgcatttttctttttttttttttttttttttttgttatttagtttttatttcataatcataaacttaactctgcaatccagctaggcatgggagggaacaagcgaaattccttctcaaaaaacaaaagcaaaaaaagccaactgttttgatacttctactcttcttgctacctatttcttttttaatttttagattaatatcagtaggaatttctcttctcttccataacttactacagcccccttttatctttgcagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgt

SEQ ID NO: 246880 - DNA, 549 bp, Homo sapiens
ggtagcgcttgctgagcggcggcggcaaccgacgtacacaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagtgtcttaaagtctttgcttgtctgtggatagaacccagtttggatgatgtaccactttatccttcaactctaagcccttgatggctttacttgcaggtttaattaaggtgaagaagttgctggagtacccgaaatatcactcaataaataggtgaagatgatcagaacaattccacaaactacatataaaaattgtttctctttctctatcatatagttatataccatgtatgctccccaatcacagactacagattgtatgttattcctacccctttccctattaaaaattgcaactaactgctgttatttgaaacacattcacaaatacagtggcctttatcaagttcctagatgaaaagctgt

SEQ ID NO: 246881 - DNA, 225 bp, Homo sapiens
gtaagatttttctaaagttttcatgaattttgattttttcaatatgtgttttagaatatcagattcattgggttttatgtaactgtgactcttaaactctaatttaacctgtcaatctattaaaataattgttcttttagaggactttctctaatatgcaaaattatttttataagttgtgccatattttaaggttagtgttcagaatattaagaaacctagtgt

SEQ ID NO: 246882 - DNA, 460 bp, Homo sapiens
gaacattcatcaaaaggatttgaacaacaaagacctaagtttagacttggccttaacaacagggaattcggatggctaaaatggaaaatgggtgtgttcaggagtcacccagacttggtgattgttatttttgagacaggatcttgttgtgtttttcaggctggagtgcagtggcccaatcagggctcactgttggcttgatatactgagctcaagcgatcctcctgcttcagcctcccaagtagctcggactatagccatgcaccaccccacctggctaatttacagacttgggtttgagtctgtccctttctgtagtttatgggagtgggcaattttcttaactgcagaatctcagtatcttcatctggaaaatggcaataatcatactggtgggtaatgggcatctgtggttttgtctttccagcatccatatccattccgactctttaaaaaaaaa

SEQ ID NO: 246883 - DNA, 773 bp, Homo sapiens
tgctgtgtcctcacatggtggggagagagagactaggttctctgccatctcttcttgtaagggcactaatcccagcgcgggtgccccaccctcatgacctcatctcaaccaagttatcttccaaaggccttatctccaaatatcatcacgttgggcattagggcttcaacatataaattttggtgagttggggggtggggtatacaattcagaagggaaggagggaagatacatgaagccctctttggtctagtctgaccagagcccaaatagctctgctgctccctgatactccctgtgtccccgtctgtcaccagcatggagttgggggtctggggagcctgaggggagcagcctgcaaattgggagaccagtcttggatgttttaatcatgttttctagagttaccacacgatttccctctggagttgggaggccatggtaccctcctgtgccattctttggggagtgatcaagttcccctgggcctggtgtgtaggccagcctgtgagctcaaaacaaattaacttcaacatttagttacacaatgacacactggtttatgattcgaagtggtcgggcttctggcatgtatggattagggtggagccagctctctccattttttatggcagctttattgaggtgtaattcacataccatataattaacccttttaaagtgttgaacctgattcagtgctttttagtatattcacagaattgtgcagccatcatcacaatcaattttagcacatttccatcaccccagaa

SEQ ID NO: 246884 - DNA, 317 bp, Homo sapiens
atcacagtattgctggtgatactgaccatgctggcatggtcagttctgatgaggccttcttcctggtttgcagacaacagtcttcctgttattcctcgtatggtggagatagagaggaaggaagctataaagctatagtaatcaagacagtatggtactggcaaaagagtggacaaataggttaatagaacagaataaagggtccagaaatagacccacataaatatagtctgctgaattttgacaaaggaataaaggcaatacaatggagtaaaagacagtattttcaacaaatggtgctggagggggcagttgca

SEQ ID NO: 246885 - DNA, 615 bp, Homo sapiens
  misc_feature (600)..(600): n is a, c, g, or t
attaaaactatctcatattaaaaatatatgtatgtgtgtgtatgtatatatagtgaaaatgacagctataccaactgctttcttctcctcacatctttccttgttattgaatattcttcttttgtatcattttaatgtttgtagaatggccagaatatgaatatattagttttctgatattggatatttgtgtatgtttgcaactgtttctcctgttttattgaaattgactgttaatattgagatgtttagatgcttcaaaaacaactcctttctttttctctaaaaataatgctttctctggtgttgtctgtgccaatttgcatacacatttatttggaacttattagttgcacctataggccctatcctggttttcagtttgttgttgttcaaccccactactgttaattagagctgctttacaaattctagaattttcattttgtgtcaagtttctccctataagcatatattcttttcttcgtagcttttcagagtttttaatctcctgaacacatgtgtcttctctctgagtgatggtataattaaaaatttctgacaatgattacctttcaaaaccttccacaccccaaacantcaatcacacccggg

SEQ ID NO: 246886 - DNA, 545 bp, Homo sapiens
caaaggtaagtagataggtctgaatgcatggcatctcacatggtccacttcttcttgcctccattcaaaatggttatatttaatttgtgaaagtaaagcactatagattggaggcttgaagtcgcaatggtacagtggttctctgaaatatttgctctccctggatccataaaagagactgcattaaagtacttcagttcttttgcccagtaattgatctgattgggtcatccactgagcctggttgatctgtagatgcctgtttgggtcaagtgtctgctcctagaccagtgagttgcatagggtgtcagtcacatggcaaagcatgggaccatttttcttagaagaatataagtgatgggcattttgagactacacatcctattcaaggttgagtgaatgatgaattttaagagatttcacagaaatattcattgccttctagaataccaaagtattgctttctctttctctactgtcttctctgcagaaactatttatggtgtctaagtataccaagtctttttaatcctttttgattagca

SEQ ID NO: 246887 - DNA, 476 bp, Homo sapiens
gctgtgtcccgtatatcctgtcatttccatttattttatcctcaaattataaagaattgtagtgttaagtccgttattcactttaagatgcagccagaacagtgactggagtggtttcatacctcatgggtttcccacacttccatcaacacacacttcacaacaccttggaggcattgtgaaaaggtcaagctttggagatggggaagagtcctgaagatgttgggtgacattgtacagtgaatggaggctgcctgcttggcacactttccatcacacatcacattttgctaatcttttggaataagggggaaagacatttaaatgagataattagagataagaatggagattttaatcttttccctgaagtcaagaaggcagataaggagaaattgctgtcactgaaagactgtatattttacaagaagttatttcagaagcagtctctattcctttaggctttaaatgaactt

SEQ ID NO: 246888 - DNA, 373 bp, Homo sapiens
aggtcatgaactagaagtctacaagccatggatggagccaatgagagtcaacccacttgccacgggcctctagtgattaacaagctacggcccagaaagccagttccaccaggagctcccttgccagccatccacacctcataacgggcagaccgaagcagccgaccctcgagacccagtcggagcctgcgatcactcgggcgaccctcgcctaccccgccgtaaaagccgcggcctttccacctaggtgctacgggacctacccccgtggcaaggaagagcaaacccgaacttgcgcacacccggcggccctgtctgaaagagccaccccaacttttgttttgtaaaatgtatgagttttcaaatgacacca

SEQ ID NO: 246889 - DNA, 594 bp, Homo sapiens
tagccagatgtgatggaggctgagatgggaggatcatttgagcctgggaagtcaaggctgcaataaattatgatcatgtcactgcactccagcctggatgacagagcaaagctctatctcaaaaaactctcaagacaaccacaaacatctcacaccatctatatatgatgaagtaatacatataaaccagttgtttaaaacaatttcaaaattttgggtaatctctgattgcctggattatttcccatgcaagacgatacagttacctgaacaaaggaggagatgggaagaaaaaaagtttcttggttgagggcatccctaatattaagtaaccagatgacaaccagataagcataattaaaggaaagaacagagggtaaccaggttaagagccagggctaaaaactccaaagagagaggaggagacgggtgagagaaagagagagaaagagggagagggagagagagagaggagacagagcgagacagagagagagagagagaacgagacagagactctcactgagggacagacccggtcaaagtaaatagaaacagcaggagtacaacccaacaaaagttgaaaatcaggca

SEQ ID NO: 246890 - DNA, 1186 bp, Homo sapiens
tagccagatgtgatggaggctgagatgggaggatcatttgagcctgggaagtcaaggctgcaataaattatgatcatgtcactgcactccagcctggatgacagagcaaagctctatctcaaaaaactctcaagacaaccacaaacatctcacaccatctatatatgatgaagtaatacatataaaccagttgtttaaaacaatttcaaaattttgggtaatctctgattgcctggattatttcccatgcaagacgatacagttacctgaacaaaggaggagatgggaagaaaaaaagtttcttggttgagggcatccctaatattaagtaaccagatgacaaccagataagcataattaaaggaaagaacagagggtaaccaggttaagagccagggctaaaaactccaaagagagaggaggagacgggtgagagaaagagagagaaagagggagagggagagagagagaggagacagagcgagacagagagagagagagagaacgagacagagactctcactgagggacagaccagctaaaccagaaatcttaagagggaaagtaacagtgtgtgattcaagacataggtattcaatcaaatatccttttactttcgtatatgcatggaacatcaaatcactaaatagttggtgcttcttcctcaactccaaagtcaactaggtaaagtggctcaggatgtgctttaataacctctaatgcctaaacaaacataaggaaagttagtttcagggataatcatctctcccaatgtgcaagacagaaatacggatatggtgacctataaaggggtcctcaaagccatgaattctcaacaatcagggcatggggaaacaggagctttttggtcaaatgagcaaaaggagaagcagcagacaagtggggcaagcctatttggtcaaaagcacataaaccaaaccaataaattttgtcctcaaaaggaaactgtacaggtctaggctgtcactcctgcttatagaaaactgactagttagataagaagatggagaaatatacagtatttctcttggaaagaaaaatttgggggctgggcacagtagctcacacctgtaatcccagcactttgggagggcgaggcaggcagatcacttgagctcagaagtttgagaccagcctgggcaacagggaaaaaccctgtctctac

SEQ ID NO: 246891 - DNA, 1460 bp, Homo sapiens
tagccagatgtgatggaggctgagatgggaggatcatttgagcctgggaagtcaaggctgcaataaattatgatcatgtcactgcactccagcctggatgacagagcaaagctctatctcaaaaaactctcaagacaaccacaaacatctcacaccatctatatatgatgaagtaatacatataaaccagttgtttaaaacaatttcaaaattttgggtaatctctgattgcctggattatttcccatgcaagacgatacagttacctgaacaaaggaggagatgggaagaaaaaaagtttcttggttgagggcatccctaatattaagtaaccagatgacaaccagataagcataattaaaggaaagaacagagggtaaccaggttaagagccagggctaaaaactccaaagagagaggaggagacgggtgagagaaagagagagaaagagggagagggagagagagagaggagacagagcgagacagagagagagagagagaacgagacagagactctcactgagggacagaccagctaaaccagaaatcttaagagggaaagtaacagtgtgtgattcaagacataggtattcaatcaaatatccttttactttcgtatatgcatggaacatcaaatcactaaatagttggtgcttcttcctcaactccaaagtcaactaggtaaagtggctcaggatgtgctttaataacctctaatgcctaaacaaacataaggaaagttagtttcagggataatcatctctcccaatgtgcaagacagaaatacggatatggtgacctataaaggggtcctcaaagccatgaattctcaacaatcagggcatggggaaacaggagctttttggtcaaatgagcaaaaggagaagcagcagacaagtggggcaagcctatttggtcaaaagcacataaaccaaaccaataaattttgtcctcaaaaggaaactgtacaggtctaggctgtcactcctgcttatagaaaactgactagttagataagaagatggagaaatatacagtatttctcttggaaagaaaaatttgggggctgggcacagtagctcacacctgtaatcccaccacaaaaatcttttcactccacaaagatacctcctaatgtgctactgcactacaacatagaacaacatagaaagcataaataaaacagatgatttactccggagaaagtaattttttttttgctcaactgtcaactaaaccaaaatgagtaattaatcaagaaatgcagatgaaatctaaaaatcaaagataaaaccaatctgaatcactagaagagatcagtcttcttggattacaattgtatgcctaaactagatctaactgaaatgaagtggtatcctaacagttgtacctttagcacatgggtacaagaaacagaaatacgtctttatgttaactgttagtgaggcaaagcaacg

SEQ ID NO: 246892 - DNA, 1249 bp, Homo sapiens
tagccagatgtgatggaggctgagatgggaggatcatttgagcctgggaagtcaaggctgcaataaattatgatcatgtcactgcactccagcctggatgacagagcaaagctctatctcaaaaaactctcaagacaaccacaaacatctcacaccatctatatatgatgaagtaatacatataaaccagttgtttaaaacaatttcaaaattttgggtaatctctgattgcctggattatttcccatgcaagacgatacagttacctgaacaaaggaggagatgggaagaaaaaaagtttcttggttgagggcatccctaatattaagtaaccagatgacaaccagataagcataattaaaggaaagaacagagggtaaccaggttaagagccagggctaaaaactccaaagagagaggaggagacgggtgagagaaagagagagaaagagggagagggagagagagagaggagacagagcgagacagagagagagagagagaacgagacagagactctcactgagggacagaccagctaaaccagaaatcttaagagggaaagtaacagtgtgtgattcaagacataggtattcaatcaaatatccttttactttcgtatatgcatggaacatcaaatcactaaatagttggtgcttcttcctcaactccaaagtcaactaggtaaagtggctcaggatgtgctttaataacctctaatgcctaaacaaacataaggaaagttagtttcagggataatcatctctcccaatgtgcaagacagaaatacggatatggtgacctataaaggggtcctcaaagccatgaattctcaacaatcagggcatggggaaacaggagctttttggtcaaatgagcaaaaggagaagcagcagacaagtggggcaagcctatttggtcaaaagcacataaaccaaaccaataaattttgtcctcaaaaggaaactgtacaggtctaggctgtcactcctgcttatagaaaactgactagttagataagaagatggagaaatatacagtatttctcttggaaagaaaaatttgggggctgggcacagtagctcacacctgtaatcccaccacaaaaatcttttcactccacaaagatacctcctaatgtgctactgcactacaacatagaacaacatagaaagcataaataaaacagatgatttactccggagaaagtaatttttttttttgcctccttcttctcttcattcggacc

SEQ ID NO: 246893 - DNA, 658 bp, Homo sapiens
tattttttatttttgagacggagtctcactctgttgcccaggctggagtgcagtggtgcgatctccactcgccgcaacctccacctcacagattcaagcaattctcctgcctcagcttcccgagtagctgggattacaggcgcccgccaccacgcccggctaatttttgtatttttagtagagacagggtttcaccattttggccaggctggtctcaaactcctgacctcaggtgaaccacctgccttcggcctcccaaagtgctgggattacaggcatgaaccaccaccgcgcccagccacaaaaatcttttcactccacaaagatacctcctaatgtgctactgcactacaacatagaacaacatagaaagcataaataaaacagatgatttactccggagaaagtaattttttttttgctcaactgtcaactaaaccaaaatgagtaattaatcaagaaatgcagatgaaatctaaaaatcaaagataaaaccaatctgaatcactagaagagatcagtcttcttggattacaattgtatgcctaaactagatctaactgaaatgaagtggtatcctaacagttgtacctttagcacatgggtacaagaaacagaaatacgtctttatgttaactgttagtgaggcaaagcaacg

SEQ ID NO: 246894 - DNA, 437 bp, Homo sapiens
tataaagagcattcaggaagcggctctgcctatccatgtcagagaggccagggttctgttgtaaagcacagaagtgaggatggaggaaaggcgtttctagaagataggaaggcattggggtgtctgggattgatggtaaggatttaaacctattcgtggacataagaaaaggagattggggagatattaagaatgagtttgggccgggcacggtggctcacgcccgtaatcctagcctttgggaggccgaggctggtggattgcctgagctcaggagtttgagaccagcctgggcaacacagtgaaaccccatctacttgggaggttgaggcaggagaatcgcttgaacctgagaggcggaagttgcagtgaaccaagatcgcgccattgcactccagcctgggcaacagagtgagactccatctccaaaaaaaaaa

SEQ ID NO: 246895 - DNA, 398 bp, Homo sapiens
gttgtggagggctgtgcgctcagcgtggaattatagcagttcattttctaaagtgccacgagacctggggatgaaccttccgagagaagggaaaaccacaacagcagtcccctcgtagagatgcaattcatcatgggcaggacggctgggtctgtcaacaggaagggctcttttccctgtgacgcacaaaagcaatcccacgggctctgtgttgcagcaagaggaccctgaactccctcagacaccctggctgtgtgcagggagcctccgaaatccagagacgggaggcatgcatcgccatgtgagcaccgagcggaggcataatgggactccagttcctatgcccccaccatattttctctctaattaagagtggggatagtttgtggtgagggtag

SEQ ID NO: 246896 - DNA, 312 bp, Homo sapiens
actgctggtcagaggataagttctggagttttcttgtagagcatggagactgcagttaataataacatatcatatacttgaagattgctgagagtagattctaaacattattatttatttattttcttagttttttcgccccacttcaataagctagtcgaagacagtagattttaaatgttctcaccacaaaaaatggttaagtatgtgggatgataaatatgtttgatttactcattccacagtgtgtacgtatatcaaagtatcatgttgtaaactataaataaatatcatttcttatttgtcaattaa

SEQ ID NO: 246897 - DNA, 97 bp, Homo sapiens
gaagggaactgtcaggggaacggtctacagtgagcggagtacttctgcagctctcagctgtgttgtaagcactagaactgtccttgtcagacttttc

SEQ ID NO: 246898 - DNA, 421 bp, Homo sapiens
cagacccgaggagcagagaaagacttgacacacagtgggtgggaagaggcatctctgggggcagtaggtcagccagctaccttgggaaaacaacaggcaactgtacagttgattacagcaagattgacagtgtacacttgtggggaaagtgggcagatgaggaggtccacttggggaagggaaagcgaagtgacagtaattggtcatgatctgcatgaccactggaggccccagaagggagtgctttgttttcctacctttgtatggccttcatttctgcttcctataccctagtgttttcatatttgggattaagtttacagtgctctaaaagcccctgcatttatataccagtagcttccaggagacagaagatcaaaaattctttctctgccaacccaccacttagttcttaatttaa

SEQ ID NO: 246899 - DNA, 334 bp, Homo sapiens
tgggtagggaaaaaaaattccagggaaaatcatgtgaccttctcttttttaggctagtgaaacaagagccttggccatccaggcttgtaatagtaagttgcttattttagtatatgcttccctgtaaagagtgaatttcaccttgccttccagagaagcacacttctgtgagtgtgctccgggtcagattctgttcatcacttaggtgcggagggcacagctggaaagagctgggtgaggattcccagctgctgaacaaagttgactttgatgtttactttcaacacaaggccaagaaaatctggattcacgtcctgtctttatctcctcattg

SEQ ID NO: 246900 - DNA, 360 bp, Homo sapiens
cagataattcttcaaggagtagaccaaattccatccccaaggtgataatttctttgcctattctagcccacggtcgtcttgcccatctttagaatttgtaacgcacttaaagatagaatcatccagtttagtcttcgcttcatgcatatgtgttttatccacccaactaaagtataggatacttgggggaatatagatccagtaatgtcttctgtatccatgccaccaaggacaagtttttgtgcatatagtaagtgtccctgtaagtttttgttgactgtcaaattttccaagtgctatataaattcaaattcctttcacaattattgctttatataaagggtaagctacaaaaaaaaa

SEQ ID NO: 246901 - DNA, 421 bp, Homo sapiens
caaaagaaggaccagtactcaagtatcagaaaagggtagccctgtacattgctgctttttgtgggtacattgaactcactgaatgggccctgaagcagggtgcgcggccccacgaggcagtcggtgttcacccctatcgagcatggtgccatgaagcccttcatgcagatgtctctaaatgccccattcatgcagccgcagaagcaggccaactgttgattctgaaggcctttgtcaactacagtgtgctgtgcctggaatgcaaaaatgcagcaggacaaactcccctgaccattgtgttcaaacacaagcataaagactgtgtattatatttgctcagtaaaatgtggtccacagtttcttttccaaaaatttcagtcccaatgaggatttatattaaaataaaacaatggatcctcag

SEQ ID NO: 246902 - DNA, 394 bp, Homo sapiens
gatggccttgtgttgatgtacattccttctatacctaatttgttgacagttttttttatcatgaaagatgtcgaattttgtcaaatgctctttctgcatctattgagatgatcatatgatttttattcttggttctgttaatgtggtatatcatcttcatagattggcgtatgttgaatcatccttacaacccaggggtaaatttcatttgatcatgatatgtgatctttttttatgtgttgttgaattctgtttgctagtgttgtgttgagtgaggacttctgcatctaagtttatcagggatattggcttatgattttctttttgtgtctttgcctcctattcttagcagtgttcccttgaaagcaatttgtctttttataatctctgtctg

SEQ ID NO: 246903 - DNA, 444 bp, Homo sapiens
cagcctcagtgaactaaaggctttacaacagaaggtgccaaaactttttgattctcacatgtatgtttgtccatgtatctctgtgctgtggcttgaatgtttacgtccgctccaaaatttacgtggaaatttaatccccaatgcaacagtattaagaggtagggcctttaggaggtgattagtctatgaaggctcctccctcaccaatggcattagcaccttataaaagcattaaaggaaaatagctaggccctttgtgctcttgtgcccttccactatgagaggacacagtgttcgtcttctctggaagagacagcatttaaggcaccatcttcgaagtaaagactgggccctcaccagacactgaacctgctggcatttggattttgaacttcccagcctccataactgtaagtaatacatttacactgtttataaattacc

SEQ ID NO: 246904 - DNA, 389 bp, Homo sapiens
tgatcccagctatattaattccttccttcctccgttgactcatttattaaaaatttattgtcttctccgcggcatgcctttgctgggactggtgattcagaaatactagtcataggccggatgcggtggctcacacctgtaatcctagaactttgggaggccgaggtgggtggatcacttgaggtcaggaattcaagaccagcctggccagtatggtgaaaccccatctctactaaaaatacaaaaattggccgcgtgtggtggtgggcgcctgtaatcctagctacttgggaggctgaggcagaaaaatcgcttgaggtggaggttgcagtgagccatgattgtgccactgcactccagcatgggcaacagagagagactctgtctta

SEQ ID NO: 246905 - DNA, 504 bp, Homo sapiens
ggtgctccttattatcactccttggtaacataacactaacagaatcataatccatactcaaaaatataaggaagtaatgggtaaaaaacattttttctacataagcaagacaaactcagagtcaatacaagaatgactgatagattttgctgcattaaagccataatattctggccgggcattgtggctcacacctgtaatcccagcactttgggaggccgagacatgtgaatcacctgaggtcaggagtgcaagaccagcctggccaacatggcaaaaccccatctctactaaaaatacaaaaaattagctgggcatggtggtgggaacctgtaatcccagctgcacgggaagctgaggcagaagaattgcttgaacccgggaggcggaggctgcagtaagccaagattgcatcattgcattccagcctgggcgacggagtgagactctcaaaacagaaaacaaacaaacaaacaaacaaaacctataatattctatataata

SEQ ID NO: 246906 - DNA, 414 bp, Homo sapiens
ccttggtggagtggcccgcggagactgtcactggaaggagtcctctttgttagttgccatattaccgcatttctggagcatgcagtttgctcagccttgagccaagttcttggggaggagggaaggtagagaagagtgtaagatgcatcctctggaaaaagaaaatcgtgtgggagaatgaaacgtggaacagtgaactgcgtagggggcagaatgccattggtgggatgcctgcctgcccagacccacgctcaacccttcatgtgcaagttcccatttcattttgataacaacccaaggagatggttattgttggaccatttttgcagttcaggaaatgaaggctaagaggggtctgatcatttacattggtcacacccctagtaagtgaaaggctggagtgtggatgcttcc

SEQ ID NO: 246907 - DNA, 422 bp, Homo sapiens
tctcctctgtttccaagcctttgttagttgagatttctgctgctaacggccaaagccattcctcactgctattgactttcccagtatttattgatcattcttgggtgtttctcagagaagtcacaaattcttgctaatatcattcaatcaatacctgctactacttgccccggagggagcaatttacagttgaccatgtgagaagctgcatctccaccaacctaaaaacatcaccccttgaattcagagctgctgcatttctacttgaagctcaagctcaagttctgttttctctgttcatctggatccactccagccacactggcctccttgctgcttctcaaaacacaccagcctcattcctgtatctagttctatgtttttgttttgccatagcacttaaaacctttggacatagtata

SEQ ID NO: 246908 - DNA, 354 bp, Homo sapiens
tgcttgggctgaaaggctccgtgttttctattcttctgtggatcatgaatcagcaatgaatttggaggcaggtttagacccaatgatgtccaaatcacctccctcagccaaaaacaaaaacaaaaacaaaaacaaaaaaacactcttctagaaataagaggaggacaccacaccaaaaaagagacatctcccagtgtttcattttccagaagccaacccactaagagacagtagaaatcctgtccacattgccccttgaatttatcacgaattcagttccagccaagcagttgcgtcacgtcgtgaaaaggcactctttcatcatcttgggatttcatcttgggacatagagct

SEQ ID NO: 246909 - DNA, 549 bp, Homo sapiens
ttcagagatctgcatccttcaacaaatgcacattttcactgactccaaaaaatttcattcaaactttggtctgtattgcctgacttcttagactagcttcttcattcttgttcaatgaaactgtgataacctaagcggtaagttccagttggtctctctctccaacccccttcactcttcatctgcaagtttagtcactttattgaggttaaaacaggtcatagatagtatgtggtttaaaactgtttaaaagtttcacatgtgaaaatccggatttagggcctggcgcggtggctcacgactgtaatctcggcactttgggaggctgaggcgggcagatcgcttgagacctgccggggcagcatgaagggacttcccacccccactaaaacaatacaaaaaatgagccgggcttggtggcaagccctgtagtcccagctactcggaggatgaggtgggaaaatcacctgggcccgagaggcggaggttgcagtgagcccagatcgcgctaccgcactccagcctggacgacagacccactctgtggcc

SEQ ID NO: 246910 - DNA, 425 bp, Homo sapiens
ttcagagatctgcatccttcaacaaatgcacattttcactgactccaaaaaatttcattcaaactttggtctgtattgcctgacttcttagactagcttcttcattcttgttcaatgaaactgtgataacctaagcggtacaggagagggagaggacagacttagggttgtgccttcgaacaagcacattcaacgacagcctcagttagaattcccagacgctgcctgtcttcctgggtcttgaaaaagtggggaaaaagtgaggttggcccactcagactgccagtgatgctgtggtgtgacgggtgtgtatctctatctcatacaatgggcgcaggtgaggaccaggacctgcgaccttcgtacgtttacagtccctgaaagccctcacctttaattagtagggaaaataaaagtcatctggc

SEQ ID NO: 246911 - DNA, 326 bp, Homo sapiens
aagggagttgatgctggtactgccgtctagaaaatggcagcctctgccaagtgccacgactgcattgtgtagctgtaaatggctccaagatgccaggccacagatactcctttgcataggtgccctgacccaaaagccggtgttaaaatgatggggagtaatgacaatattggctgctatccctacgtgactgtctctcgattaaagaaagtatgtgctctgaattgtttttccaccagaagatgaacttgatctgactcctctacccagtttcatttagccttgatgagaaataaatgcaaacactattttcattaacacctttc

SEQ ID NO: 246912 - DNA, 1066 bp, Homo sapiens
acattagtgaaaacaccgaagtctaaataaagtctgttgtctagtaactagtatgatgataatgttaatgtgatagttttgatcagtgtaccagaagatgagatgctaccgttaggggaagctaggtgaagggtatacatgaactttctgaactacagttacaactcttgagtaaatctaaaattatttcaaaatgcaaagttaaaagaaactaactatagtctttggaaaactaaatatactgattgaaagctaattctagaaaaaccaggtctggaaaggtgttaaggccacatctcgagggagagaattttactcactcagatacccagatatgtactagatgtttgactgactgtaagtaccaaccctgacaaggtgacaagaggggtagtgtgcaacaattcttttacagatatggaacttatagaagcctatcaaaaaaaaaatctagttcctttctttccatataagcaaggctagttcaaaacacagtggcccaactaaaagaggttcaatataagttattttttggttttttgttttttgagtagcgtctcactctgttgcccaggctgggtacagtgctgtgattatagctcactgcaacctcagtctcctgggctcaagtgacccttttttttcagcctcctgagtagctgggactacaggcatgtgccaacatgcctggctaatttttgatcgttagtagagatgaggtctcgctatgttgcccaggctggaaatgtaaattttcttaatctcccatcttagacttatttggtcggcttggagttaggaaggaatttctcactgtagtgccaaacctgaaatggtaattgtgtttgagcaagttccctgaacataagggggcgaggggaggaagaggaacgatccaggccatttttgttgatacataatagttgcacatattttttcatgtgatgtttcgatatatgcatacaatgtgtaatgatcagatcagggtaattgagatatttgttgcctcaaacattttttctttgttgggaatgtttaaactcttctagctgttttgaaatataca

SEQ ID NO: 246913 - DNA, 604 bp, Homo sapiens
tgacttaacaagaacattcacagcagctttattcataacaataaaacctgcaggattattcacaatagccaagatatggaatcaacctaactgtccatcggtggatgaatggataaagaaaatgtggtatatctacacaatggaatactattcagccttgatgaggaaggaaattctgtcatttgtgataacatggatgaacctggaggacagaactcaaatgtttgtaaacagaatagaatttttaaattgtggtatattcagactatggactattacacagcaattaaaaagcataaactactgataatacaacatagataaatctcaatgacactatattaagtgaagaaaacagacacaagagggctgtttatggttccatttacatgaacaggaaaaacaaatctatggtgatagacatcagaatagtgataacctttgaggatgaggtggggcccaagggaaatttctgggacgataaaatattttgatggagaccgtggtgggtatagacatatacaaaattcaccaaggtgtaccctaagatttattaacgtttatgtaagttatacctaagagaactttaaaaccaaaaaaaaaa

SEQ ID NO: 246914 - DNA, 791 bp, Homo sapiens
ggcatggaaggatagctgggattgcaggtgttgaaaagtgtaagatgtgttctgggcacaaagtacattccaacgtgggtgaagcacagaggaagtgaatggtggggctgtaagaccagaaagacaggttgagcactgctgtggagaaccctaaggtgaatttgtacatgtggtgattcagctgacagcgggtagcctttgagaacctgagagaacagatggggtgatgcaattgaatccgagctgcagaaggattaagggactgcagttaggtggatgggatagagataggaaggtagaaggttggtcagggactgtttcagtagtcctgatgagtcatattttagcctaaattagagctgtgatagaataagaaagtggggagttatccaagatgaattgcagagcaaaaatcttcaggttttaggaaatgattgacagaagtgggcaaagacaaagtaaaatctaagataacctggtgcttctgagtctgattgcaggaggttggtagccacacggtaagggaaaggaggcccctaaggtgctcattgtcaggtttgtgcaagtgcagagttggcacctgagaatgagtgcctttttaaattgtgagctgggcaccttgcagtccagtccctaagttccctgggtaccattggcaggagtacagatagatgtcagaggaactgaggaggaaagaggtgtctctaattttggacaagctgaatttaagtgtttgaagtgtccaaagaaatatgtctagcaagacaattaaaatactgttttctaataga

SEQ ID NO: 246915 - DNA, 270 bp, Homo sapiens
catcttttgttttccattttttattatattcttttcaaagcctatcttaaagaaagtgaaatgtagctgataaaattgtatgatgtctcattaaagaagaaaaatgaaaatttataaagaaaataactaaacagaatattacttagaaatatattcttagaatacatagtaattttcttgaccatctaaagttttaaatggaaaagtgatacaacctgtttttatgagtaattttatattaaattttactactgtcatccccatcttcaa

SEQ ID NO: 246916 - DNA, 533 bp, Homo sapiens
tggtggcattatagcctacaaaatgcttcctgatactttatctcatatcatagttgaggaaactgatgcttggagagggaaagtacctggcccagaggagccgagctaagtgacagggcccggacttgagccctagtgtccttgtttcatccaagctggttacacccaccacgatgcaaagactttgaagctgtgaggacgcgagcacccagagcctggcggggtcatctcaccaaactccaagcgcacaggtctggggacactgagggttggctttgggtgctgaggctccagaggcacccagagccctgcagaggatcccatgggggcagcaggatgaggtggggtcggggaactttgtccgagaggaactggggatgcagagcccggaaaaggctgtcatatggggacagcctgggaggtgtttaaggagccaggggctcctgggatcgaatcccagctctgcctgtcaccagctgggtggctttgggcaaacctggctccagatggtcattaataaaatggggacaata

SEQ ID NO: 246917 - DNA, 127 bp, Homo sapiens
aactataaatccattcagtgggttgtataacatttatatttagtctaatttagactttgataatttaatgctacttttatattttaacaaaaatataaattaaaattttcattagtctgttttgttg

SEQ ID NO: 246918 - DNA, 1355 bp, Homo sapiens
acatgtcgcggctaactgcagcctcgaactcctaggctcaagtagttctcccacctcattctcctgaggcaagcaacaccctgcctagctaatttatttttattcttgtttttatctgtagagacagcatttcagttttgcccagactggtcttaaactcgtgatccgcctgcctcggcctcccaaagtgctgggattacaggcgtgagccactgcgtctggccagaaatctcttaaccatgggagttaagtctcaaaattctggtgatacaagtggttgaaacttaaaactttgtttaaaaaataggattagtgaatttgagataattcataagtctgtgaaagacaataaatacatacatattttacatttactattactaaatttgtagtaaatttgagtacagcactacctctttatctgtgaaaacttcagactctcccctattactttaatttcagtgagacagggtttcactatgttggccagggtttcactatgttggccaggcttgaactcctgacctcaggtgatccacccgccttggcctcccagagtgctagaattacaggcatcagccaccacgcccggccaggatagggatttattgactcacttaggcatttatctgttctcagcatagctggatcattctagatctattctagaggtccaagcattaacactagctcatcctgtttctcagatctattgttctctgtgctgactggcttcattcgtaggccttctgtagtaagaggaaaatggctttgggtacttttgacttccatgtccttaacacctatgtctcagacagagatagtatcttttttgataattctggttaaagcacaagaagttctttcattggttcagcttggattattcctggtccaatcagtggggtctgatgtttggattggatgggtgtgaatggtgtacccacctccctaatggggatgcagtgaagtatagggtggttaaccatcccttatcaccatccataccctatggatagattttctgataagaaacacagaagaaaggaaatgatgctaaagagagtaaatagttaactgttaaaagaccaaaacctagtacttgtgtcatctaatagagaatcctatgtacattgtacacttccttttttttagaaaaattaaaataattttaaatagtctttgtgaaagcttcaaagattcttccaggccttatgtgtttgtcctttcagcttttcattataactttatgaaaatattttagccactcttttaacaatttattgaatgtctgctatgtcgttttacctgcagtgtcatttaatcttttctcaagttgataatttaaaaaataa

SEQ ID NO: 246919 - DNA, 417 bp, Homo sapiens
ctatggagctctgaggggtactcttaaatacaggttttgtataaattgagagattgtgccacaggaatagagagaaaaatttcgaagattctcatggagagccgatgtattcatgaggactgttgatccaatatcaagcagaacaggagttagttacatgggctgaactaacagaagactgagttaatcttttacggcttcttcaaaacatttgctgactctttgttttgtttttcagagtcaagaaaagtttctcttcttttaagctatttaaagctgttaacaattgagtaaaggatactcttatgagcaaaatttgaaatgcaacccctttctcaaaacctaatttctttaaaatttgaaaactgttttgtgagcattcttaatttatgacaatatagttatctgcataagttc

SEQ ID NO: 246920 - DNA, 362 bp, Homo sapiens
agacattcagctcgtaagttccacaagcttttttatttcagagttgctgacagtgagcaggtccctatactgaggataatatattcaaagctttgttcttgtttttttcttaattggtcagtctccctgggggttctctcagttttcacccagactcctgggtgagagggctgaaacagaaatgcatggtgaatgcagatggcttgtttcctggccgtcatcacacacaggggtcacatgaaggccagatattgcccaattaagttccctaaggtgggaggttaggctgagttggaggaggacagaggactgcactcagagtggccaaaaaattggcaattacctgcaatctcagttttagg

SEQ ID NO: 246921 - DNA, 416 bp, Homo sapiens
gctggcaacattgttccttggctggtgtctgggaacttgcatttaggaagggctcccactattccctgaatagtaagggtggctgttctctaaactgttcatgtgagtaatacggtttgtgctgaatacctggatttcttcagggagtctgcaattcatgtttgtgctaggcaggggatgcctacatgaccagctccttataaaaactctgggcactgagtctgtaatgagcttacctgctagacagtgttttacacatgctaccaggactcactgctggaggaattaggcacatcctatgtgactgctgggagaggactcctgaacttgcgcctggttttctcaggaccttgtcccaggttctgtgtcccttcactgattttgctttgtatttttttgctgtaataagaccctta

SEQ ID NO: 246922 - DNA, 419 bp, Homo sapiens
acgtttatatcatttcacttctatgtagcctatggtggtagatattatttatccctgtttagcgatgaaagcaacatcaggtaagcagttaactcaagggcacagttagtaggagtaccatttggaatcaacgttggtcttatgactccagttcaaatttttttcacatcatagttgtgtttaaatgtaatgtctttatttgaaagtaaacctacaaaggctaccaaggataatctgaaagaaatacaatgatatgttggtatttgataagttttgttggcaagtgtctttgcttttttgtatgcttaaaaatatgtaaaaaaatagattttcaaaatgataaaacaaaaactataatacaaaaaaggatgctaatacataaaatgttcttgcagataaataaatgaaaactttggata

SEQ ID NO: 246923 - DNA, 336 bp, Homo sapiens
ctcccagccccctccccattttgctcctccccattttgctcctcccagtagtcggtccccccatccttctcctggccttccatccccagctggaacagagatgaaggccgccttgccagccctcagtatcctgatggggaggtgtcaggcccactcacagacattagggaacctgggccaaggtaatgaagcagcggggcagggcagagccaggccggttttgtctctgggagaatgtttgactgctccagatcagggtcaccatcttgcctctctgccacccccctcccccatacccctgtcatgccctccctccaggccttgagagcattctct

SEQ ID NO: 246924 - DNA, 572 bp, Homo sapiens
agctttatcaccattattgtttacttgttaagtctcttttagctgactcatatttttaactttaacaaacatataaaggaaacttgtattactaccatatatgtaaaattggtattacttgccatatatagatgttagctgtttaaaaaaaagaaaaaggagttcttggttacttagtctgtaacttgacatagcagagtgaccccaaaggctcccttcctcttatcttgttgtccccagaggcattttgttacaattcctaacttttttttttgaggtgaggggctgcaatgcaattggatcacaggctatgtattgaagctagccaagctgcatgtaccctaatttacctctctccatccttccacttcccatccccagtgaagtgtatcacctaaaatcatctcccacaccacgagaggtgtgcaatacatagtttgggaaacactgatctgactaccttcttcacagagacccacctcgaattcctttccctttgaaaaaacttttctaactaattcagacctcagtgatcccctcaaccacattcataaagctactgtgtctattta

SEQ ID NO: 246925 - DNA, 359 bp, Homo sapiens
tgcttaggattgctttggctatttggggtctcttttggttccacatgaattttagaaaagtttttttcttattctgtgaaaaatgactttggtagtttggtaggaatagtgttgaaatctgtagattgctttgggcagtatggacatattaacaatattggttcttccaatccatgagaatggaatgtttttccatttgtttgtgtcatctctaatttctttcagcagtgtgaattttcttaacataggtcttcttgggccagcttgccttcagagcagagaagaaaagctaacagtttttgatagctactgttactgatagtgaataacataagaatcgcctttgatctattttggtt

SEQ ID NO: 246926 - DNA, 499 bp, Homo sapiens
caatctaccaagttcttcgccactgttgttttatgatttcttttaggatgggaagactaaagagaatgtaagttttaaagagaatactcctcttcccgttgtaaacccctatttacctctgccacaggaggaaacagcaataaaagcaacctgtagagcagtcacttctcgaaaggatgcctatttggtagttccaaaaccataaaaaaagaaaagtcatttttccctttctgccaattttggaagaatacatttttctggttctctaaaaacaacattaagacttcctttccacagtgaagagaagagagcatgagctgattacttggtcctacaaaaaatcatccagatgccattagaactgggagcgattaaaaaaaatgacagtcaactgagggctttgaggattattcaaaacctcaacttctcccaaattctcaagaatactttatctatgtaatacctgaatataattcttgatctattgaattctacagag

SEQ ID NO: 246927 - DNA, 629 bp, Homo sapiens
tttcttccttatggactttacatcctaatgctggagacagacaatgaacacataaacaaggactgtagtaagataatgaagaaaaacaaagcagggtgcaagggatggggtatcattttagatagagtggtcatgatgggcctctcagagcctgaataaagagaagggctttacgcctgcaaatatctgagggaggagagtggatgagaagtcctgaggcagaagcatacctgtcctagaagaagcaaagatagatgtggttaaagtgagaaggtaacttttttggaaaaaaaattgaacttgcagaaaacttgtaaaaatagtacaatgaacttttgtatatgcgtcacctaaattaattattaaatttctgccacattcaggctatttatctagctatgtatacacatacacattaccattatctgctgaattatttgagaataatttgcagaccttttacttcaaaatatctcagtgtatgcctctaagaacaaggatatgctctttaataattcataaaaatttaacattgtataacactataatctaagagttcatattcaaattttatccgttgtctcaataatgtcctttaagaaccatttttccccctcatcagggtccag

SEQ ID NO: 246928 - DNA, 328 bp, Homo sapiens
ggaaaatgtagtccaattccaggtatcgtgcacctctaaaaataaggattatattcagaaaaagtgaagaatagataatggggagcagactgcattgggtctaacatattagatcagaatctaatatttttaaggtaccgaatgtatatcctatcacatcttgatttggatgaggcttttcattttatagatggaggaaactctgaagccttcccttgtgtgtctgtgatatatgagcttttaacttctcatttatgaagttacaatagatatataattcttaccttattgtgtgttctctaagaagcacagtaaaaataaaatgaag

SEQ ID NO: 246929 - DNA, 249 bp, Homo sapiens
gcagaaaactccgggaaaaattttatttatagctttatcctgggggctgttttgcttttctacatcttcagagtggaaatgctgtctaaaccaatcagttaacaatttggttaactattgttactgccattattttggtttcctgtgacactggaagaatgttttctagcttggtcccttgtccaagcaaatgttaccaatttttaaaaaagagactgcgcaacatcctcagaagtagccaagtctagc

SEQ ID NO: 246930 - DNA, 381 bp, Homo sapiens
tctaaaggatggagtttaggctaaaggaaagtgatccaggtacaataataatcatataagaaattgtgaagactattttcaaggttcatttctatagttcactactggagaagtttctctgaacatgtggaacaccaggaaacatgaggaagaagcacagcattctctcctaaatgtgaagccagctgttggtgttgctttgctataactgctatttgccattgatgattattttcctcttcttcccagagagtaagagggagaggatgcagtctgtgtggttcccattaaaaagaaagaaaaagaaaggaaggaaggaaggaagaaagaaaaaatttttggatagaataacaaagcgataacaaagaaagataaataaaa

SEQ ID NO: 246931 - DNA, 368 bp, Homo sapiens
ctgcatggaggaaaattgctttctgtaaatcttggtccaacagaacaaaacacctatttctttccagttgggaggacagccattctcatcggtataatgaacgtattgtaagctgtgacttttacaaagtctgagggaaaccaatctgcaatcttgacagatacgatctttccagatgcactgttcgtttacggcggcaagagagctcaattaatttctgagggaggacggcaggatgcgaccccttgtgcgtggcctaggaggaactgtccctgtgtgaatttatgttctggtaatttaaaaagatttatattaagcttttctttcattttgagagtagattaaaattctaatggaaaccatttgta

SEQ ID NO: 246932 - DNA, 601 bp, Homo sapiens
acgtagtcctctcaaagtgttgggattacaggcgtcagccactgtggcccactgtggttttggtttttccagcaagtgagacgtgaaagagcaagaaaggaagatgcggttgttgtgtgccagtaaccagctatgtgacctgccacttgcgaagtggtagattttcttcatttataaaatagtgcttagagagaataaggagaaaagaaagctggggagaggggttttttctaagatctctttgggttaaaatgatttgtgatttattgggcaacatatacgagcaagattatagcaggaaagagatgtgtcaggaaagacttcagacattgtggctgttgaatctggaaagataaatggaaaggagcaatgtccaggatccttgaaactctggccaggataatacagacatgtccaaaaaggctccaacttggatttaccaagggaacctaacagtgtaaattttaggacagaccaagtgcgatggctcaagcctgtaatcccagcactttgggaggctgaggcaggaggatcatttgaggccaggaatttaagaccagcctggggcaccatactgagatcctatctctacaaaaaaaaa

SEQ ID NO: 246933 - DNA, 350 bp, Homo sapiens
aggagctcaatgctgcctagtatccaatatccaaatagagcaaatactctagaaatgttctgtttgggcacagtagaaagatcattggaataagagtcaaatgacctgaattctaaatccagttcttccccttatttgctataattgactttgggccagccttttaacttctttttaacctcggtttgttcccaagagtataaactatttgcccttcctaccttccagagttgccttggaaataaagtgaccccgtggatgtaaaagtgctttgcaaaccaatgacctagagaaatagaaacttcttcctttcaagccacatttctcctctttccttcactacaaaatct

SEQ ID NO: 246934 - DNA, 482 bp, Homo sapiens
tggtgggcggggatggcgtgcagggtggtgggagctgggcctggggtctggttctagaagcatcagggctggagggccttagacagttacgaggaagggtcgtctaccaggcctcggtgagagaagtgagcccccaccttccagtcactgggagaggactgaagaagcagccatcccccaagcatctccatcctcaaaccacacagagctcccgcccaggcactgagagggccctggggttccaccagaaatggaaagtctgatcctaaaattcatacggaattgcaagaggcctcagattgccaaaactacccaataaaagaactaaattggaagacttacacgtcccaatttcaaaaattactacaaaactgtagtaatcaagacagtatggtactggcttaaggctaggtatagagacaatggaacagaattgaaagtccaaaaataaaacccctacttttatggtgaactggtttcaa

SEQ ID NO: 246935 - DNA, 451 bp, Homo sapiens
taaattcaatcaaagaagtacacaacttgaacactaaaaactacaaaacatcattagaagaaattaaacatttaaatatgtggaaagacatcttgtgttcctcaattagaagaattaatattgttaagacagcaatagtccccatattggtctacagattcaatccaatccccatcaaaattctaactgctttttttttctttttttttttttgcagaaatggaaagtctgatcctaaaattcatacggaattgcaagaggcctcagattgccaaaactacccaataaaagaactaaattggaagacttacacgtcccaatttcaaaaattactacaaaactgtagtaatcaagacagtatggtactggcttaaggctaggtatagagacaatggaacagaattgaaagtccaaaaataaaacccctacttttatggtgaactggtttcaa

SEQ ID NO: 246936 - DNA, 506 bp, Homo sapiens
tggtgggcggggatggcgtgcagggtggtgggagctgggcctggggtctggttctagaagcatcagggctggagggccttagacagttacgaggaagggtcgtctaccaggcctcggtgagagaagtgagcccccaccttccagtcactgggagaggactgaagaagcagccatcccccaagcatctccatcctcaaaccacacagagctcccgcccaggcactgagagggccctggggttccaccaggtgagtggcactggtggggaggcctggggacccctgctgcagaaagggccacgacagattacagtgagcccctgaggacatctttgaggttggggcctctgagctcaggtctcaggaggtgtctgctggtggcctgatgggctgcgagggtcttggtggtcagtggcccccccatgaacagcagcaatgcaagctgctcccacagaggagggggcagagtgagggcttctggggcctcgtccggatctcaaggtgccc

SEQ ID NO: 246937 - DNA, 437 bp, Homo sapiens
gtaggtaacaggaaaaatattaagtcatggtgatttacaaagtggtcaccaatggaagaccgagtacaagaagatgccttataaaaatgtctggtttttggaaaaagatcttgcaaaagcttgaagaaagaatgaaaaagagatgagtgaaatgagagttctaaaaatgatgaaagaggaaaaactgactggagaggtggagaaaaaggctcaggctgctgtgagacatgaaccaatatatgaattatagaatataggactgatttgacaaacctctgaaaatagacaaccggaaattctaactatacatctcatttcttataaaacttaaaagatagttttctcaaataataggccctagaccaaacttcttgttcaagccatattatatgtctataagatatgtacatataaataaaattccatgtagatctgta

SEQ ID NO: 246938 - DNA, 450 bp, Homo sapiens
tcaagagatgagatcaagccctcattggtgaggatgtggctatggtccactggatagggcagaagttcactgaggtgcctcaagttacagttgggtctccggctggtgggccaggactggagaggatggagccacccactgaggtgccagcaagactctctttgggctgtgcaccaccgcgtctcccacacactaatggtgaggaagccatgggctgtggtgtcagtgaaatttactagaaggtgggtgccactacattttccacacatgctaaccgtgcggtgctgtagaaacaagaagcaaggcacaccagaaccagaaagaaaagctttttcttttgctgttctttgcagtgttcttcctgcactgtctactaacagagactaacgttatacgagctgccaaagaggaaatgattacagggtccagctctagtatcacaaaatgtgc

SEQ ID NO: 246939 - DNA, 610 bp, Homo sapiens
atgggattagtgaccttaaaaaagagatcccctcccccttccaccatgtgaatatatagcgggaaggttctgtctatgcggaagatagtccctccccaaacacaagaattagctggtgctttgtcatgaacttcccagcctccattgttataactgcccaaacgtactaagacagaattaaccctatattgtattaagtaaagctgtttcaggttttattagtgattatagcataatcaaggattacccttgctaatataatgtgctctatttcttagttctctattatgttctattgatatatttgtctacccttgagccaatactactcatcttagtgatggtagcttcatattacatcctaatatcttagagaacaaactcttgcttcccctctgccctgcccaattcttttttttttacaagcctcttgtcttgatcctttgctttttcacataatttttaaaaatcagcttgttatgtttcatgaaaaaaatgaaattttcattagaattatattggatcaatagattaataatttggaaagaacagatatactcacgattctgagtgtcattattaataaatacagtgaatttgtctatttgtc

SEQ ID NO: 246940 - DNA, 423 bp, Homo sapiens
ctgtcacgggctgttgtcagtgctgttcccatcggcctccttctcccttccgtgccagcttctgactgctgcgctcagccctcctgggaacagcccgatctgcagaggtcatctacctgattttatgatctggaggtacagcatctcctgaaaagggcctctgtatagaaaatgaggcacatcatcgggcgcgtgataattgcatccacagtctgatttaaattgtctttggatattctctcagtggccactcaggtctttgaaaatgtagcactgggcttcttatcgagctcaggcctggaaacagatggtctatggtcgggtgaggtggctcacgcctgtaatcccaacactttgggaggtcacagagggaggattcctttaagaccagcctgggcaacatagtgagaccctgtgtctaaa

SEQ ID NO: 246941 - DNA, 418 bp, Homo sapiens
acaacaatcaaatatcggattctagactggatcctgttttggagggggaagatcaatataaaggacattactgggtcaatttacaaaactggaattgggaaggtagattagaaaaaagtattatcaatagttgtagttataaaaaaaactggcagttcttctcaacttgggtctgcagaagtcttcatgccctgaggcatccgttatatgtgagggattagcctctctcctgtgcataccagctaagtacatccttgagagaatgggaaaatagttcactcaggtcattttctgtagggctaaattctctcatggagctggataacaggctgtaaaggaatatcttcattcttaggaaataggcactgcagtatttaggagtaaggcatcatgacttatgcaatttactctctagtca

SEQ ID NO: 246942 - DNA, 370 bp, Homo sapiens
tactggatactggtcagtcatagctataaaaattagagcacaaatggggaaagcctgtcttaaaaagacctttcttacaaaagcaaagtcagtcaaaatgttgaagaggtatagcccaaaagtcactgcatcctgtttcttctagtacatcattctgaaagcagagaaggtgccaggaaaattcttaatctatctgtgcttttccagaatatagttattttcaaaattctctaaatgtgcaacctagaatattgtgaacaaactttttaaagagctaaaatcatcaaaatgtacatgagaaaacacagacccacagactccatcatctctatgttcttatcctatcttctggcctccaaaaaggcacaca

SEQ ID NO: 246943 - DNA, 749 bp, Homo sapiens
actggatctttactccttaaggcatgaagttttagaaaagtcttaaatgacacttgctgttatctctgcctgcgtgtgagtgatgctaacccatgttggtaattcaggcttttctttcattggacacgtttcactgaggcttagaaataaccatttttctaagtaccatgacaaataccacatgggagaagctgcttttattggaaaactttcatttattaggggcatactgaatttttatgtcatgtctttggttaacacaggaggcccccagcttatcttcagccccttcttgtcaagactcctgtgttctgcttttaggctaacattggctgtgacctgacttggcttgttcatttcagaaatagccactttctgacatgtttttctaatttacatctttgtattttgatgtaatttctccctttctcaaagtaaaagaacattataatgatttcctagtggccaattttattttatttttattcttacaaagtttcatccatacctagccacatcattttgactatctccctaaccatcttagaatctaccatctttctgacctttgttttctgactaccatttgtaaaccacttgcctatgttttattcagatatcccttatatcatgatgttatactgttattcagagtaatttcattttttcttttttgagaataggccttaacaccagtgtcagagtggtttatagatgtgtgctagctattttagttcattaaaaaaaaa

SEQ ID NO: 246944 - DNA, 279 bp, Homo sapiens
gaaatatgctaccaggaaagaaaactaatatcccttaagattattgaggcaaaatactcaacaaaatactagcaagccaaattcaagagtgtattaaaaggattacacatcatgaccaggtgggatttattactggaatacaaggatggctcaatacacaaaaatcaatgtaatgcaccacattaacaagtaaaggaaataaaaacacataatcatctcaattgatacagagaaagtatttgacatagttcaataccctttcatgattagaaaaaaaaa

SEQ ID NO: 246945 - DNA, 412 bp, Homo sapiens
tcacaccttacacaaaaatcaacttaaaatggatcaaagacctaaatataagagctaaaatcataataaataaatcactcttagcagaaaacacagggagaaatctttgtgactttggaataggcaatgaattcttaaatatgacaccaaaagcacaagaaactaaagaacaaagtagataaattgggcttcatcaaatataaagacttctgtgcgtcagaggacactatcaagaaaatgaagccagcccacagggtgggagaaataaacatctatcgcagcattctcctccacgcctcctataaaaatattccccgtgctgaccacaaccactgctcctcctccctgcttccctcgccttctgcctctggtcctttctttgccattacttctcctcttctttttttctctg

SEQ ID NO: 246946 - DNA, 393 bp, Homo sapiens
cataaattaatgctgatcttgctgtaaaaattaagtaattcgaaatcaaagctgttggaactttaaattattttgagacttaaaggagtgtgactataagacctgaatcatgtaaacaggcagctgtaacctttgttcttctcattatagattagcctcttctttacctgcatcattgtgcagtatgttgtaaaagacaacagggtgccaaagaagaccactttccctcttcactgttgatctctttatacactgacttcccttttacttctcccagacaaagacttcacgactatcacgttgtctaagatggaatgttaaatatacttttaaactggaaaaggaaaacaagttgtaatcaaattgctgtatctcataaactggccttgtacg

SEQ ID NO: 246947 - DNA, 500 bp, Homo sapiens
agagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaa

SEQ ID NO: 246948 - DNA, 338 bp, Homo sapiens
ttaactttttctagagacagggtgtcccaatgttgatcatgttgatcttgaactcctgggcttaggcaatcctcccgcttcagcttcccaaagtgctgggattacaggcataagccactgtgcctggccttcatttgaatgttaatagccacatggggccagtggctacctcactgaacaggccaggctttgcctgtgaaatgggatgatgactcctgcatcacctatcttactgaggtgcagtaacgatcaaattagaactgggttgagaaaatgtctgaaagaaccgaagcttacaactgtattttactggatattaattattgctacaatatttt

SEQ ID NO: 246949 - DNA, 514 bp, Homo sapiens
tcatgccatgagctacaggagctcagcatggcatctgtgatattcctgcccaacatacatgacagaatccaatcatggaaaagcaccaaaaaacccaagttgaaggacaagtctaccaagtagctggccaggtaatcttcacaaaggtccgtgtcatgaaagacaaagcagcagaaactttcaaattagaggggacagctaaatgcaacacatggtcttggattgttttgttataaaggacattatcatgaagtctgaataaagtctgtagatgagatgagagaattccctgtttttaggaaatatgcaacaaaatattcagagtaaatgggcatcacatcttagatgactcagaagaaaaagggaagaacagagataagtgatacagtgaaacattgatgtttgggggatctgggtaaacaatattcagaaattctttgtaccgtgttgcaaggtttctgtaagtctgaaactatgtgagaacaagtgtttaaaaataaagcataaaatgtaa

SEQ ID NO: 246950 - DNA, 378 bp, Homo sapiens
actgttgtttatttttctttttatttggccaatatatattgagtacctactatgtttcagcccttgccagggtcctattaggaaaaaatagtgtggcacatgcctgtaatatcaacacttcgggaggcggaggtgggagaatcgcttgagcccagaagtttgagaccagtttgggcaacatagggagacgtcctctctaaaaaaaaaatttttttaattagcctggtgtggtggtgcacgcctgtggtcccagctgctccagaggctgaggtgggcggattgcttgagtccaggagattgaggctgtaatgagctatgatcgcgctgctacactctagcctgggagacagagtgacagtgagatcctgtctccaaaaa

SEQ ID NO: 246951 - DNA, 483 bp, Homo sapiens
gcctagagtgaattttttcaaaggtaaaaaggagcccaaatttcacagaatgatctcccgcttcagaaagggaaaccctctaagtacactatacacttccctgcctgttttctggagagtgataccgagtgttggcactgtctgcaaggaaggaagtaggactttgactaattgcacaaacagcaattttgtgtttttgaagtgcgaggactcagtcctgtgtccacgaagcctccttcaggaggttacttcttgacatagcccatcaaccggacctcccgttgctaggttctgagccttagggtgctttcaaatgcaatatctaggccaggagtggtggcccacacctgtaatcccagcactttgggaggctgaggcaagaggatggcttgaggcaggaggatcgaagtcaaggtgccgcgagctgtgatcgtgccactgcatgctagcctaggcaacagagcaagaccttgtttcaaaaca

SEQ ID NO: 246952 - DNA, 402 bp, Homo sapiens
gcctagagtgaattttttcaaaggtaaaaaggagcccaaatttcacagaatgatctcccgcttcagaaagggaaaccctctaagtacactatacacttccctgcctgttttctggagagtgataccgagtgttggcactgtctgcaaggaaggaagtaggactttgactaattgcacaaacagcaattttgtgtttttgaagtgcgaggactcagtcctgtgtccacgaagcctccttcaggaggttacttcttgacatagcccatcaaccggacctcccgttgctaggttctgagccttagggtgctttcaaattgctaggattacaggtgtgagtcacggcacgtgatatcagtagtcaggttgtctgttttcttttccatgcaaagcaaaacttctttg

SEQ ID NO: 246953 - DNA, 340 bp, Homo sapiens
aagtaaatatgatggcagtagaggcccagaagtgttggagtaacaaaggacagttttgcccttctgtgggtgatgtgatggaagacacagaggggagctgtaggaagaacagaggcagtgaccttaatgtctgcaatcattaagactctgctactttgagtagttcacagagcatagtaacaaacttgaactgtatccattttaagttatacaatggttgtatcaatgtttcaaataccagttgttaaatggatagactgctaagcattatgtacccagcaatccatttttgtgaagtagtaatattgttataataaagtttatattttttgagtactca

SEQ ID NO: 246954 - DNA, 390 bp, Homo sapiens
tggagtaaaaaaaaagtttgagaaacactcttacttaaaattctagggaataaatccagaaaatgaatacacagatggaacatttcatatatgaaaccaaaacaggaaaaaacattaccaagagacattaagaaaataaacaagcatacaaaaattctctgaagagtacaaagaggtcagaaagtaaacggtttttccccaaatcagttttgattttagcttcttcgctgggactgcaaatcatttcaagactttaaggttctcagagtacaagatatggaaagtctgggcccaggcggggaagaatgagggtttcatccctacaaactgattctgttcaaagtttcaaacaaatgttgtctctggatggtaatcaacaaagaaaaaaag

SEQ ID NO: 246955 - DNA, 905 bp, Homo sapiens
aagggaaaaggggagcaaagggaaaacaggccgaagtggctaaccaagaaactaaagaagatttacctgcagaaaatggggaaacgaaaactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaataattacaatacatggctttttagaatttcgttatgtatgttaagatttgtgtacaaattgaaatgt

SEQ ID NO: 246956 - DNA, 786 bp, Homo sapiens
aagggaaaaggggagcaaagggaaaacaggccgaagtggctaaccaagaaactaaagaagatttacctgcagaaaatggggaaacgaaaactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagccatttaggtacagccatttaggtatagccatttaggtaacag

SEQ ID NO: 246957 - DNA, 695 bp, Homo sapiens
aagggaaaaggggagcaaagggaaaacaggccgaagtggctaaccaagaaactaaagaagatttacctgcagaaaatggggaaacgaaaactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccaggggttgtgccaattaagagacagtctagggtcgaccggcgctttgcatatcagaataaagctaatgtacgcagcgctccacggcgttttacac

SEQ ID NO: 246958 - DNA, 429 bp, Homo sapiens
tttgtccttttcaacaagggcaggaccatccctgagcaactttttggaaatgaggggatgggaaagtgagtaatgaaagtaagtaagcaagggtcagagatgccaaaggcactgaaatgcctgggtggtgccacacaactaagaattagactcctagggcctgaatgtttgtgtctccccaaaattcatgcgagtatcttaactgccaaggtgagggtattagggcagacccctcaggattgggatttgtgctgatataaaagagatcccagagggctagctagccccttctaccatgagacaacacagagaaggtgccgtctatgaggaacgagcccttaccagacactgaatctgccagcaccttgaacttagacttcccagcctccaggactgtgagaaataaatgtttagtttttgatccaccca

SEQ ID NO: 246959 - DNA, 366 bp, Homo sapiens
gaaaccttccttactccaccactacctccactctctacagctgacttctctccccctttatggtttagtcttgtttcccaggagacatcatcagctgcttgagtatagagacaggctttacaatttttctgtattccctgagctgggacgatgtgtagcacagatgctcaataagtacttgcttgttgattaatcacggtaatgaagctatttattggtcataaaccacggtggggtttttgtcttcaagaacttgttgctttcctcttagaaggaagaggctggccacagtcaccattctgtcctagacacttagcataacattcacctgcttaaatgaaaggagtaggaggacagatggacatg

SEQ ID NO: 246960 - DNA, 375 bp, Homo sapiens
ctgagaacttgctgtccaggcaaaaaaaaaactcacgatgaggaatacaacacaaaccttaggtggccagcatgtcagcaaacagagagacgaagggacactgacaaaagccaacccctcaaaagaaacaaagcaacacaccaaagaggtagaaagcaaaggattaagatatgcctagaatgctcttgcttatcaggacccttaaaactaatcaaggttcctgggaatctgaattaacattaatacctgaattttaacagaaattacattagacattcctttaggcaaaagagtatatatacaacaccgacatctggttataaagagctaaggaatctcccagcttccctaaatgcagaagatatcctagtggat

SEQ ID NO: 246961 - DNA, 519 bp, Homo sapiens
ctcgtgcctgctttcctagaaattagagcattccttttaaatgccactgccagttgcactcaatttctggactacagttttttaggccaatgtttcagaaggatggtttttcagttgatttcctcttggtcccttcccactttgctgctatgaaaagagataatgaaaaccacgcgattctccccaggcctctttcttttgccacccagccttactactactttcaattgattataaagagagaacaagaaaagaaatcattacccaagagttgctttatctaatttgggtcaaaaattctttccccttccaataaaatttctgaattacccaaactactcttgagtagttctaaccaaatttgggcaaagttaggaagcttaaagaagaacggttgatggtattccctaagatcaaggatcttgaaactaaagcttgattaataaatgtattcctcaaatgggaaatcctcaaatatctgagtgaagaaaaaaaacaaagcacaaataaacaaagttt

SEQ ID NO: 246962 - DNA, 119 bp, Homo sapiens
ggaggccgagggaccaggaggagagctaggagaggtttgggcacttcagacgccccacccatcctgccctaggttccccagagttcctgggaggagggagttcttgccgacctcgcgtt

SEQ ID NO: 246963 - DNA, 1094 bp, Homo sapiens
agaaaaagaaaggagatcagtgttttataaaacttagaaatagattttttaagtgtttcttcattgacttatgtgaaaggacttttcttaatttaacaaattatgtgctttcgtttatagcctcaaaacttcttgtgtagctaagaatgggtaaataatcaggctttactaaaggactaacgtaaagatcttctgtaagtaacatttctgctactcaaggaagagataaacttcatggcataaccttgccaaagtatactaagaataaccctgacacaaagctcttttttcagccaacatgccatgaaagaaagaagacaaggggtgatctccactctctaagtgaaccactaaacccaccaaagaagaaacgagggaaatagaaagaggacccttgcctgagataatggatctgtatgtatgagtagtagaaccctgctcaaagtacaaggaagggaaaaaaaagttagtttatttggaattttggacattaagagtctttattgttcattttcttttaactcacatgaatggcttatcacttcaattaataaatatttcatttcttttcaacatattcatgaaacaaatctgaaatgaacagtgcaacatgtgaatgtttagaacattataaaattaaacacaaaatctgtctggcaatcttcctagcatcttaggaaaaaagttgacaaaatttcaagcagcagaagggggcagtaaaactcaacagaaagctctggaagatttttaagattcttccttattttcttttcatgtagattatttcccaacaaatttcagacgctaatagaaattttgtacaacagatccatatatttgcctaaaatagacacagaaacattgaatatatgcaaacatgagagctataagttttacatgatcaaaccttttttttatggtacacaatagtcacagtacttttccatataaaacaggtttagtggtcttaatttagtttggcacatttaatacactcccatgaccagcatcccaaatgtacctatccgttttattttattgtctcagaattgtcagttatttaataaattatgtaacttttttccttatgctca

SEQ ID NO: 246964 - DNA, 436 bp, Homo sapiens
taaaataccttctgaaacaactctgggaagaagctcaccacccggccacgatacccacttcttgctgccaagaagcttctagctacacggtttttccttccaccccacagtgcagtggaaacaagacccaagctcttctcaaggagtaagcacaggacaagtttcctgctaagtggtcctaagtcaacaaggccatctgataggaatttgaggagtagtgaattttataggaatagaggggaaaggactctttttccatgtaggcttctcttggagtggggagattaggaaatctccatgatataaaatgatgaaagttcgaatcattgtcaccctaccggaaagactccaatttgaccttagtgcttaatccctttagtttgaagtgtagcttaaaagtatttaaataaaatacagctgcccccaaaaaaaaaaa

SEQ ID NO: 246965 - DNA, 458 bp, Homo sapiens
ccgggccggcctgtcagggagctgcagacgtccctgtgacaggctgtacgggaagcatagcggcttctgctcctagacctgtcactcaggacccaagcgacagacagccatcacctgcaatgctccagaccacaggtcatgcctgtcacttccccacatagctcgtcactcacactctccatgaccagaaacgtggccctgaccagccacgagggggccaggacgcacgagacagagacgactggacagcatcagcagctcccacggccacacactgctctagctcccaccgtctctacctaacaacggaacccactcgcagacgcctgctgcacacttgttcatggtatttgctatttctcctgagggactaaactctccttccattttttgtcaccgtgaacaaggaggcctgaccgtgctacagatgcggaggccgtcggtccacctggcgtccc

SEQ ID NO: 246966 - DNA, 880 bp, Homo sapiens
ttcttcaatgacctaagcctcatatatactcattgtatgtgtgaggctgagtatccttaatccaaaaatctgaaattcaaaatacttcaaaattcaaaactttctgaatgccgacatgacactcgaaggaaatgctcattggagtatcttggatttccttgttagggatgctgactcagtaagtataatgcactgtctcccgagtttttcttatcatttggctatctcagaggcctttacagagaaaggaatcctacaatttgaaatttcaacactttttttccaatgacaaaatgggggaaaatcaaatcaaacaggtctcttctgaagattttatttctgctctgagctgttctgggtgacctactgctctaattaggctggaaataaacctggctttcatgagatgcaggacacggctggaggaaaaagttgtcaagactacttacaatcatcagtgcccacaggcctcagagcattccaagaattcattgattcattccataattcattctgcccattaggcacaaacacagacacccagggagaacaaacaccactggctgatttagctttactgatctgcccagggcaggacagagattaaaaaaacaataatgctgtagtttatcaatagctcctcaaatgggtagtgtggtacagcagaagtcagcacagctgacagtcctagctctacctctctgaatgtgtgttcattgacaaaatggaagattaatcccgtcctttcaacttgactgagtgctggcagggatcaaatgagactgaggatatgagaagtgctttgcaaactgaaaatcattgtgacctacacgagagagttcttcacctaacaaacatgtgttgggcgcctattacgtga

SEQ ID NO: 246967 - DNA, 461 bp, Homo sapiens
atttgtaagcaaaattgccccgtgtttctacctccagagaagatcactctcagacaaccccacacctgaacgtaacatctatttttatttaaaaaattgttttggtagagacggggtttcttctccaactcctgggctcaagtgagcctcccacttcgaccccccaaagtgttgggatgagacactgtgccccgccctgcattcctaattcaaaaatttgaagtccaaaatgctccaatgaatatttcctttgagcatcgtgtcaacactcaaagtttcggattttagattactgagttttcagattaggaatactcaacctggataagtcagttttctttggctgctttccaggttaaaaaaaaaatgtcttttctttagtttattgcctcaacatggttttccttgagatgatcttattggaattcactcaccttcgtgaatctttaaagtatttatta

SEQ ID NO: 246968 - DNA, 385 bp, Homo sapiens
ataattatcatcctttctaagtgctgttttccataatcaggtccccgtgcttatccacatccacactccccttctctcacaaagtcctacttgtctcctgggagcccctgcacgcctcccctctctgaatctctgcgaattttcacttataaaacagtaacaactctctcaaggtcatcaaaaatggcagaacagtgttcccccatctctgaaaaatatgaatgtgagaaacggtttcatactgctgagagaatttataagacttaagcagaagaatcttcagatcccccatcccccagagatttttgcaaatgagccagcccagccacaaaaatgtatgcaaacttgaagataaaatggaattaaaatatgttttaaagagaag

SEQ ID NO: 246969 - DNA, 469 bp, Homo sapiens
attacattatatgtacagctgtttttggactttctgtgtaattcacgtgtatctttggatgttaatttaataaacactcctttttctgcctgctaattcattctcatgctgaaaagaaggctactctgagtttagctcattgttgaaactgtttgctttaattcaagtagtctagtggaagaaagaaaggtggcatagtagcagttgcagaatgaaacctggaagagagaaagctatgtctaacaagggcagcagctctgagttgccagctagttagtagcagttaggatgagaagtgctgaccaacttttctgtattctgaaatcttagggtcaaaatatatttcatctgtgttttaactgtgcagtaggactgtaaagttttcacaatactttggcttttccatatttgtatggtttgtatttagttaatcttaataaaaatttagacttcaagaaaaattgggaga

SEQ ID NO: 246970 - DNA, 331 bp, Homo sapiens
acagaaaaggatgtctagtgctcatcactttgcagggggtaagacttccctgtatgccttcaccaaaggaaagctgccccatggagaggtccaagctgcaagaaactgataccttcacctaacagccggtgaggacctgaggtctgtcaacagccacctgcgtgatctcggaggcagatcctcttctagctgagcctggggatgactgcagtcctggccaacgccctcatgacagccttgtgtgagagaccccgggccaaagggatgcagataagccacacttggattcctgactcaccgtgagacaacgttttgttgttttaagccacta

SEQ ID NO: 246971 - DNA, 296 bp, Homo sapiens
gaggaaaaatgtaaaagggctagattaaaacaattcaaaatgagtaatagtgttaattgaggaccaccaccaaggaagggaaatactggtttccccatgcccttgatacaggtgggtgttaattctctttaatgttcactgaataaaaaggagagagtatatttattttagcttgaatttttttaaatattaacagggctattctgtttctattattataggttctttcactcatttatctggtcttactgatctgtacatattcgttataataaagatactaattcatctttgtc

SEQ ID NO: 246972 - DNA, 168 bp, Homo sapiens
attttgttgtagtaatctaaagttatgatttgattgcataagaagttagaagaatttcttatggtaatgtaattagctttcatatttatttatcattataataataccttttgatatataacatcatgaatcttttccttaatacaaaaggaatacatttgcaatgat

SEQ ID NO: 246973 - DNA, 446 bp, Homo sapiens
ggttaatattgaagataacaataaaaacatcaaaagtaaatttgttagtagtcttgctgacagttgcatttttgactttatcaaagctcagtagatattttcatgcatttaattagttcataaattttctatttattacttgatacaatggctatgaggtttttggaagaatagatctattttaatatatccaaattagattggtcctcctatcagcatgaatcttttatcttaatttgtgagttttatataaggtgttcatgaaatatattaggactatacatttttggtttattagattcataagtgaagtctttttcctagcaatcacaaagtgctgtaatgtattcagcatcacactagctatggagaaataacctctaggtccatagacacactaatccatagcaatagagtaatttttttgcctccattgcctcttatgg

SEQ ID NO: 246974 - DNA, 589 bp, Homo sapiens
gtactttactaaaacaaagctgtggtgaatattcctttgttcaatctcttgtcaatttttttcttgttattctaaaaagaataacttaagactttatagtcttaagactatatacataagtcttaagactatatacatttttaaagattttatgcttactacttaattgccattgaaatatttatactttcatcatcagtgaatgaaagatctctaccaatgttacctatcataataaagaacactttgacaatttgataattggaaaacggcaactaatttgtatttcaaaatttatttttaattcagcaaatactaatatgcatctcctctgttccagtcactgaatgttgggaaggggaagtgattgagaggtgagcaaggcagatcaagtttctactttgatggaacttaaagtctaacaactttaaacaagtagcaattaaaggggtgatgataaggagcatttaaggttatgttccaggttcagggtgttagattaagcctcctaaagtggcacttacagatgaattgaagttagccaaggtgggaaaggagggcatgcagggaggcacagaagtaaatcttt

SEQ ID NO: 246975 - DNA, 491 bp, Homo sapiens
ttagaaagcctgttttatagaagtgagattcactgtgagaagttccagagatcaggcctcatggttagaagctacaggaagactttacaaactttgagcagggcaagcgcccaagagctaggctgcctgtgaggtcctggacatgttcaaccatctagattgtcaaagaatcaattgcaggactggaagcaggggaagctggaggagatgccagctaggtcctcgcctgctctgtgacaatgattcaaatgcatccaggtggtagacaccccacctgccaggaacagctgtcagtcttggaaccactcagtcaacacttattttgagttggattttctgattattctagaactcatttggatcttgccatgaaccaaatcagcccttttcacattagctgcagtccctggagtattaaaaatgctgccaagccttaggttttaccacttacggagtaagccttgagttctaataaaacgatgcttaaagca

SEQ ID NO: 246976 - DNA, 588 bp, Homo sapiens
aactgcaaaggagccaggggaccttggttctagcttaagtctgctcctaactagtttaggtgacctggaggaaattccttaagttcactgggcatttttcctcttgtgaaatgagggcagtaagtgatgatctctaaagccctatcccttcctaccatcccttgatttgctggtgaaggcactggcattgctgctctctagttctaaggaggagcacacagggcaacatgcacaaaccaggaagcaggcatggcttgctagatagggatggtctggctatgactcaatggcaaatgacttgaccattccactttagcctttgggccctgggagtttcctctcctggtgtggaaagtcgtattgacaacacggaattacctatggcctgctagtccggctctcaaaaatgccttatgcaaacctgcttgttagtaactgtaaagtacaaaagttaaaaagcacctgggtgtctaaatttgaaaataattcagtgtttagggctaacattttgagaagaaaaacaaacaaaaaaacaggtttaattgtatgccattaatctgtgacctttccagtttaaaactcacaatt

SEQ ID NO: 246977 - DNA, 355 bp, Homo sapiens
cgattttggttgaaacatacaaaataagagtgttcatctttgtcccagaaaccccagctctgcactttacacatggctgtatctgtggtgtattcaaggtgccctacaaaggacagtttggtgatgtgctggttcctttcttacagcccagctgttttcctgcctcctattgggagtagtagcctgccccaaaataggagcttggcccagagcaaaaaaggaatgggccatgcgcagtggtacgcctgcaatcccagcaatttgggaggccgagacgggcagattgcctgagctcaggagtttgacaccagcctggacaatacagtgaaaccccgtctctactaaaaatacaaaa

SEQ ID NO: 246978 - DNA, 232 bp, Homo sapiens
cacacccaaatcacccgcccccccaaactgcatttcacactacgaatggagctattacagttggagcaatacagactgatttggaagaaaaccccagaaaagacatggtagatatgatggtatcttcaattagaaacacttctattcatgatgacagtgatagctccaacagtgataatgataccaaatagagagaaatattcaataaatagcttttagtataaaaatactg

SEQ ID NO: 246979 - DNA, 900 bp, Homo sapiens
ttctggcggtcactcgaaaccgccgggcctgaagcgggcgctcttccagcctggagaaggctgcgggtctccatccgtggcgcctcgccagctgcaggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaaccatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagcatcccaatgtgtttgttggttaaccagcatcttagtcttctagcaagaaagtttccagaaactaaatttgttaaagccatcgtgaatagctgtattcaacactaccatgacaattgtttaccaacaatttttgtgtataaaaatggtcagatagaagccaaattcattggaattatagaatgtggagggataaatctcaagctggaagaacttgaatggaagctagcagaagttggagcaatacagactgatttggaagaaaaccccagaaaagacatggtagatatgatggtatcttcaattagaaacacttctattcatgatgacagtgatagctccaacagtgataatgataccaaatagagagaaatattcaataaatagcttttagtataaaaatactg

SEQ ID NO: 246980 - DNA, 691 bp, Homo sapiens
ttctggcggtcactcgaaaccgccgggcctgaagcgggcgctcttccagcctggagaaggctgcgggtctccatccgtggcgcctcgccagctgcaggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaaccatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagaacttgaatggaagctagcagaagttggagcaatacagactgatttggaagaaaaccccagaaaagacatggtagatatgatggtatcttcaattagaaacacttctattcatgatgacagtgatagctccaacagtgataatgataccaaatagagagaaatattcaataaatagcttttagtataaaaatactg

SEQ ID NO: 246981 - DNA, 303 bp, Homo sapiens
gaacttagttctttgggtacctgagtctcaaggtgtgagtggcagccagccctacccaggccccctcaaaagagagtttcttcgtcctcatgacatcaccaggaacactggcagatcctgcatcagcttccttctcttctattttcttagccgcatcgcactttgccaaaacgccttgacctttgttgagcatgttatgaattctgacgaataaaataactctctggaggatggggatatttttaattgaattgtagaagccaacaactgccaaataaagccagggtttctacattccgtggc

SEQ ID NO: 246982 - DNA, 441 bp, Homo sapiens
cattggggagaagagaatcacacttgggcgggaccgcactggttttctacccgggcaaggcagcaagagctctgctctgaaggtgcccagtgctgcaaagttactgatcatctgtttaccagcgttcgaaggctcaggcgtggactgcgatgactgcaaaaatcccgagtctgggatgctcgttcccgagctgcctcctgcttctttccctttcccagcattcccacgtcaacaccctggtgaaaacctgcgtactctttctaccactgtctgaaaatagcattgtggaaggccaccaggggtggtctttaggcaaaaatcaaacggtcttgtctcaataatcatctcccctgacttcttcagggcatttaacacttaatgcaaagagttttataaagctcctgctaaacagctattatgacaactgtgtatcaactttca

SEQ ID NO: 246983 - DNA, 473 bp, Homo sapiens
aaactgatgggtaggttttttttttttggaaagtatttcagtgttatttaatggctacaacatcaaaagaaaacaaaagtgggtaacattttcattctttaaaatagattaatattaaaacatgctaatttctccaaagcaggttggccctttacccccatcctcccacagtatgtcttttctttttctctcctggagataaaagctctttaccattttttatgaattgaatatttgtgtctccccaaaattcatttgttgaagctctaacctccaatgtgactgtatctggaggtagggcctataaggaggttaaatgaggtaataagaatggggctcatcagtaccgctgatgcttttataagaaaaggaagggataccagagctctattcctctctaccatgtgagtacactgggagaagggggccacctgaaagccagaaagagagcccttaccagaaaccaaataagc

SEQ ID NO: 246984 - DNA, 277 bp, Homo sapiens
gttgttcctgaaccatcacttactttgtgtccaagtttgctctaggcattaggactagaacagacacaaaaacctctgccttcttgaagcttatattctcaaagtgtgtggtttacctacagaattctttagctagatgtctggggaatgtttcatgttttttgcttgggttttcggtttgggcttttgttaataaaatagaagggaatggaagatcatttctgaaattttatattattctcttacctaaaatttcaatagataacagacaaggaca

SEQ ID NO: 246985 - DNA, 484 bp, Homo sapiens
gcacgtgcacagaggagcctcccacctcttttgaatgccatggactgtgtccgtgttccaagacagggtggaagcctcttctctgcccacaccccttcctgatagttctccagcccccctgccgcatttcctgagtgccacggcgccttgtggttagcagtcagtgacagggaagcgctgggaccaggcctttttacccagcacgtggtgtctacagtgccagtggagcctcccccggagagggtcggcatagagtggggtggggaatgaaagctcttcccacagacagacccagagtcttaaggggaaggggaagaccccagcgacctccggtgtcaccgaggcccgtgctggtgctcaggaaccgccttctcccaataacgcagcgcgagcgacacggggcgggggcgcctcgggcgcgctggctgggggcccgcggggcgccgctccgcagtggaagggggcagacttcggaagcggccgc

SEQ ID NO: 246986 - DNA, 249 bp, Homo sapiens
gggacacttgtacatgatttaaagtaaatatttctctggaaaacatgaattatagctctgtattttgaacacacaccattttggtgcctgatacaaaatagagatttttgtgataaactaaatgataaactaattggggttgtagaaagaaggtggaaaaccaattttaattagtagaagacagactaaaggatctactgttcatgtcaaccacatctgatgccaaatacatgatataagcacataaac

SEQ ID NO: 246987 - DNA, 507 bp, Homo sapiens
ttttatgattgtgtctgtttgtatttagtacacttgttatccttgatgttttcgccctgaggacatcaactgaacaaagttgcatacatctttgtggattaccctttctgcatccataagttatctgctcttttaaaataatttgtactaaaacaccgagagttttttctaatgggaatagacagctagtgtttttttaatgcaaatgacttctccccacattctccccagcccaaagctaaatctgcatcagcatcggaggggctcggtgcttctagaagcaatttaggcacagcagttgggaatggcagtgtgacttaaagccccttgctccgtattagggaaagctacatgcgaattccgaaagagattccataggatgagcagagatgtgttcagggcatttattatcatactcgctgctcttgtttttaagaaaccagcttctgttcaggtggttttgtttgtatgcaaagattaaactgttaaataaaatcacaagcaccg

SEQ ID NO: 246988 - DNA, 492 bp, Homo sapiens
aagatcacaccattgcactccagcctgggcaataagcgaaactccatctctaaaaaaacaaaaacaaaaaactgaagaactcactaactgctgaactgctgtcagagaacagttataaaagcattgataggtcttgatggaatacagtatatggccattagaagtgatcactgtcatgccagcagcagcctagatgaacacgcagtgaagtgccagagcagggaatggtgtgtgctcgggtacagcagttgggaggatatgacatgtacgtggagcccgcctctcgctaggcgcaggactgcacaagagtggaagttgtgacggggtggtgggatttgggtgcctttccttaggcttcttttaatattgtaaaatcaggattaaaagtctcactggagaattgctggaacatgggaggtagaggttgcagtgagctgagatcgtggcattgcactccagcccaggctgataacagcgagactccacctcaaa

SEQ ID NO: 246989 - DNA, 629 bp, Homo sapiens
atttttcatactgtagactgtcctggcttataattgttcaacttaggatttttttattttacagtagtttgaaagcagtctgcagtcagtacgaaccatacttcaagtacccatagccattctgttttttactttcagtatggtattcagtaaattacatgaaatattcaatactttattataaaacaggctttgtgttaaatgattttgcccaactctaggctaatgtgttttcaccatgtttaaggtaggctaggcctctggtgttcagtaagttgagtgtgttcaatgcattttctctttataatattttcaacgtgtaatgggtttatcaaaatgtaactccagcctggcgcagtggctcacacctataaacccagcactttgggaggctgagccgggaggatgacttgagccctggaggtcgagacaagccttggtaacatggcaaaaccccatatatacaaaaaaatcaaaaattagccaggcatggtgacatgcacctgtggtcccatctactcaggaggctgaggggcacggatcacttgagcctgagaggtcaaggctgcagtgagccatgattgtgccactacactccagcctggacaacagagcaagaccctgtctca

SEQ ID NO: 246990 - DNA, 93 bp, Homo sapiens
accagaatgtacttactcattagctgttttgttatagttatggtggagataatcttgtttttcaggcttttataactaaccaaacaaattacc

SEQ ID NO: 246991 - DNA, 480 bp, Homo sapiens
aaacgaacctgactaggggctacatgaaagccatactgtgcttcctcctccttctcatgaatccctttcctcccttctcttttccatcccccatagatcagaaatgtgaaggcggttaggaaatgtccagactccaaacagaaaaaactgtgatcctcagcagacacaagacataatattggattatctgcagcttcatcctgggaaaaatataggagactgaagggaaacaggaaaataagtaaacacccatagaaaaataaaatcaacatcctgaaataggaatttctgaggatatgcttcccatttgagagatgaaaacctcgaggcacagaaataccataaaattgtctaaattacacatgcaaattaatcttggggctagaacttgatggaatatctatgttcttagacaatgctaattgattataggaactgcctttaggaccagaacaagaatctaatgtctaaatggtaaga

SEQ ID NO: 246992 - DNA, 351 bp, Homo sapiens
tcatggtagaaggcgatgggggaagctggcacatcccacatggccagcaggagaaagagagagagaggggaatgctacacactttcaaacaaccagatcttgggagaactcactcaccatcacaagaacagcaagggggaaattagcccccacgatccagtcacctcccaccaggcccctcctccaacactgggaattacaagagggcgtgagatctgggtgggaacacagagccacactgtatcaaggcacctgcttggaacccagcaacagtcatttagaataaaattttgattaacaagctactaagatgtaatttttggtttaattttagccatattctctcccttt

SEQ ID NO: 246993 - DNA, 349 bp, Homo sapiens
gtgtgaagaaagcgaaagacagtcaaggctacatatggatatttttaaagtaaggctcatgtgcagcagctgaagaagtatgtcagtgttccttgcactcatgtgatgtgacacttatatggctcacttcaaagtcaaaaatgacattgtcaatactctgctttttttttttttaggaagggtctcaccctgtcacccatgctgaagtgcagtggcatgatcatagctcactgtggccttgaactcctgaggcaggagaatgacgtgaacccgggaggcggagcttgcagtgagccgagattgcaccactgccctccagcctgggtgacagagcaagactccgtctcag

SEQ ID NO: 246994 - DNA, 318 bp, Homo sapiens
catactcttttttggtctggcttttttgggtcagcataattttgagattcatgtgtgttattgtgtatatcatagacatatgtactttatttatttttttccccttgagtaaatatttagggatcccagtctgggcaacatggcaaaacctgtctctacaaaaaatacaaaaaattagccaagggtggtggtgcacacctgctacttgggaggttgagttggaaggatcacttgagcccaggaggttgaggctacagtaagctatgatcacgccattgtactccagcctgggcaacagagtgagactctgtctcaaaa

SEQ ID NO: 246995 - DNA, 549 bp, Homo sapiens
agataaaagcaaagaaacaatatttgtgacatatcagtgacacagtctaatcctcctgtatgtaaagaactcttgaaaaaaataacaaaaggaaaaaattaacaacctgatagaaaaatgagccaaagatataaactgatagttgaaagaaaaataagtaagactagtggatcctttaacaaaaaagataactgagcacacttctagctaataaaaaatatttcacattcaatctacagaaattcaatttctcacctaccagactggtaaaaaaccagaagtttaatgatacttttattttttaaggctctgggaagataagcactctcacatgtcattgatggtaacacaaaattgtagaaatcctagggaaaacctagaaatgtatactaatattagaagtgatttttggtttgaccaaactgcctagaatatatatgccgtacaaacgcctgtacaaatacaaagtggtatttgtgaaggttattaattgcagcattgtttgtaatagaaaaaaaccaacaatagttgaataaactacgttaatcc

SEQ ID NO: 246996 - DNA, 408 bp, Homo sapiens
ttataatcaccctctttgatgtgccgatcttatcaccttctttgttaattttctctgcctccgtgtttaactgtgctaccctcagccagatccatatttaccaaggctttcctctgacacgttcaggaagatccccaccaccattctccttgacttgataaaattcctgtttttggcagcaggtgtaattttactccgtaaacaattgtgtttacgttgtactgtagatgctcctagaaatgactgagcaccagagagaaagaagatgaaggtgtctggctgctagatgcacatcccagctttgagcccataacctctgtctcagttcttccatctgtaaaaggggactgccactaatgctacctagctcatatggtgttgtgaagataaaacaagataatgcacatg

SEQ ID NO: 246997 - DNA, 372 bp, Homo sapiens
ctcccctgccgtgccctcctggccctgctttctgaacccctcgtgagccctatgtgggaggggtaggcacttagtgggcaaagttgtgttggtgccgtggtcccgaggtgctcagtgcatctagtggggacatggctttacagctggccaggcctgagcaagcattgtggcctcaaggaccaggtcccagggagaaggttttctggatggggctgccaggaactgctgtgccccagctacagaagcagagggccaaagccagagccacagacagcaggaagagacaacgctggggggagaaagttcaatgttgcaattcagtggttcgcttaccatttaccattgcagggaaaataggagaacatggaggaa

SEQ ID NO: 246998 - DNA, 312 bp, Homo sapiens
  misc_feature (178)..(178): n is a, c, g, or t
  misc_feature (211)..(211): n is a, c, g, or t
  misc_feature (218)..(218): n is a, c, g, or t
  misc_feature (246)..(246): n is a, c, g, or t
  misc_feature (259)..(259): n is a, c, g, or t
  misc_feature (275)..(275): n is a, c, g, or t
  misc_feature (304)..(304): n is a, c, g, or t
tggctgggtgcagtggctcatgctcataatcccagcactttgggagaccagaggaagaggatcacttgatctgggagtttgagaccagcctgggcaacgtagcaaaaccccataactaaaaaaaaaaaacgctgttaatctaatcaagcctatattaatttacagcgttttttttttntaagtttactttacccgttggtaattccattanggaaatngataaatggtctggtgatgaccgtggtntgcagccattaanttcattagagggttgnaaagaagtggatatacccccagggtttgngcatccct

SEQ ID NO: 246999 - DNA, 327 bp, Homo sapiens
tcttcctaagtgaaccctaatcatgttctcctgtgcctaggcacgcatctagcatagcacctacaatgcagtagcatttgattaaggtaaaatcaattttgataagactacctggaacttcactgaaatgttacttcaatctagtatccttgatattaatgtcaccacgtttcgttaaaacacacccccccccaaaacacacacacacacacacacacacacacacacacacacacacatatgtagcttttatatttagtctggttacattagtgaccatggtatttactttcttcttaaggagcctttgaatttcttgtccagatc

SEQ ID NO: 247000 - DNA, 380 bp, Homo sapiens
gcctggccaacatggtgaaaccctgtctctagtaaaaatacaaaaattagctgggcctggtggtgggcacctgtaatcccagctactcgggaggctgaggcaagagaattgcttgaacccaggagatggaggttgcagtgagccaagatcgtgccattgcactccaggctaggcggtgagagtgaaacttcgtctcaaaaaaaaaaaaaaaaaaaaaattccatgaatttgccagttacctctatttagccattctacaaatgtatacatatttcaaaacatgttgtatatgacaaatatatacaatttttatttgtcaatttaaataaatgttaaaatttataattaaaaaactataaggtaatagagcatcaaaaaaa

SEQ ID NO: 247001 - DNA, 481 bp, Homo sapiens
ctgtgttgagcacttgaaatgtaggtggtctgaattgatctgtgtactgcaagtgtaaaatacatactgcctaactttttattatgcggtctggattttgaagacttacgaaaaaatacaaaatattgcattggtaccctggtttgtatagatagtatattgaaatgataagacttggatattctgacaggcgtggtggctcatgtctgtaatcccagcaccttgggcggctgaggcaaacgaatcacttaaggtcaggagttcgagaccagcctggccaatatggtgaaactctgtgaaaccctgtctatactaaaaatacaaaaattagccaggcctggtgtcaggtgcctgttgtcccagctacttgggaggctgagacagcaagatcacttgaacccggtaggcggaggttgcagtgagctgagatcatgccactgcactccagcctgagtgacagagtgagactctgtctcaaaag

SEQ ID NO: 247002 - DNA, 492 bp, Homo sapiens
aaataagacaagattgagatgaagagaggagataagtacaggcaggaatagaactcctgccttattttccccatttttttcaaattcaacattctttttatttacgtttttgacatataaaaactgtacataattaatgtgtacaacttgatgagtttggtccttaattttttcactttgtgtgatctcaggcattttacctttacttccagaatcttagttactccctttttaagatgaaggattttgaactaaatcatctctgaagtctattccagctctaacacctgtattctgatttatacctttaagaacaataaataggctatatttatagatgaatacatgagcattaatagggacaaaatcacattttactgttgtaacaagggcataattaatagttcataaattgaaattcactcaattctctagagtgctagcaggcacgtgtatacttttccaatttatgctaaccatgttaaaaaaaaa

SEQ ID NO: 247003 - DNA, 668 bp, Homo sapiens
gagttttaatcagatttattttatatgtagaaattgcctcttttgtcagcaggaaagaaatctagtcaaatggataatcttataaaaagtaacataagcatgtctagaaccaaatcacaccctataagactcagcctttctttcttttctcccacttgccccaaatttaccacacaaacttggaaatgagctgccttctcattgcttaaagcactgacgggatcccacagaagaggagaaaagttgttgtccaattaagctccacgtgtgcattcaactcttgttgaaaaatttaaagaagaaaaggcttcaggcggtagtacaacatttaacatgtcctcatagcctttcctactttacttcagggtcaaaatctgtagagtccagacggcattgatggagcatcctggagtttatagaaggttgtctgtctggagctgggaaaagtccacagactaggaaaaggatatatattattataaggaattggcttccatgattctaaaggctgagaagtctcaaggtctgtggtcagcaagctggagacccacccaggagagccaacggtgcagttccagtctgagtctgaaggcagggaaagctccactttggtttcagtcatcatctttggaagaaaaggaagttggatttttccattaacacctccc

SEQ ID NO: 247004 - DNA, 451 bp, Homo sapiens
tacttgcaggggactgggtgtagccggctgaaaactgcagaaggaaaattttctttataagctcctggagggcagcgacccactgagatctctgtaccgtgacatctgtcactcgctagaccctagtacagtgcgtgacacgggattaagcactttacaaaggttaatggaatgaattctaccacgtgctagagaaaataacttcttcagagagagctagagaggaatcttacgtttaaatacagactccaatcacagtttttacttttgcaccagagcgattgtgcgtttgtttccgtataagtgcagtttatcaagccgaagctaagctacccaacgtttgctaagaagtactgtgtatttctggaaatttattcacaagtctgtgggaaatatgtttaattcttcttggaaatctcataaactctgaattcagtaccaccaaaaaaaa

SEQ ID NO: 247005 - DNA, 596 bp, Homo sapiens
cctcctgagtagctgggactacagacgtatgccatcacacctggcaaatttttttatttttagtagagacggtttcgccgtgttggccagggtggtctcagactcctgggctcaggatctgcctgcctcaacctcccaaagttctgggattacaggcatgagccaccgtgcccaggcaggccggaatattctgatgggtgctatagaatataacctccagttctagactctgaatgtagttgcctctgaggtggtgggtggggacaaggccctcatggccggaggcctccgcaggtggcttgatgtgtggtcacctgggcgtatgtttcctgagggaacactcgcaggtcgggcactgccaagcttggctgccagccacttgctcagccctcccgtgtctcgggcagcacatcctaccctcagcttctggcactcaggagagacgacgggctacaatctgccgtaaagcacgtttcccagcctgcccctcagtgggtgcactgatcacccgcaccattcccgcagccacccacgccatcccgcggccacccgcaccgtccccgcggccacccgcaccatccccgtggggctgcttc

SEQ ID NO: 247006 - DNA, 498 bp, Homo sapiens
ttctgcttcacagcaaagtttaaagaaggcctggctcaacgctatgcccttctctgtaacaccattgctgtaaccgtttggatattgttcagcctttttttgccatctgttcatgtgtcttcagaacatttaaaaactgttagtgtgcatggaaacattactggacaaaactgatacaactagagcaattagtctaaatacttttgcccaggcttaagctgctgaaaactggagaaagaaaaaaaggactgggccggtaaacattttctgacacaggagacataaataacggatattcacaacagtttgtaattgcaaaaaagtggaaacaacctaaatttttatcaaaaggaggagggacacaattgtagtcgatacgtataatgatgtactctacctccatgaaaatgaattaagtaacgcgatgcatgctagctatctcttgaaataatgtaataaattagtccccaaataaattgctaattcaactttcattag

SEQ ID NO: 247007 - DNA, 454 bp, Homo sapiens
tttttttttttagtttacactggtaagaaagatacagactttttgttagattattttgcccaactgcagactaatgtaagtgttctgagtgcatttaaggtaggttagactaagctatgttgttcagtaggttaggtgtattacatgcataacaatgcatatcctgtcaacagacaagatattttcaatttaggatgggtttatcaggatataaccccattgtacataaatcaaggaacacctgtatgtgtccctaaaagccaggctgcgatctaccaagaccactggcagcccttgctggggatggtgtgcaatgcgttatcaccttcactccaaggcagtgatgagtgagctgagatttagaaaaacagatatgagttcatgatctgtactagcaactagctggaatgaccctattcaagtcttctgatttttttccatgtcatttcatagt

SEQ ID NO: 247008 - DNA, 366 bp, Homo sapiens
atagtgagaagtcactgaaacgtggagattgtttatggtgattatgtctactaacacagagggctagactctaatgatacacttctaaaatcaagctaaggaaattcttcgaggaactttttattaactccccagagaacatgccaaaagtttatttcctcagcttccaggtacacaatctattcctttctatgatagtttccatgcccccactaaaatgcatttcatcattctttttggattaaatgatttcatttttagttcaaagaaacctagaacaattatttccttctttttatcattttctcgggcctgtaggcaaataattcatttttaattagaaaattgttatgggatataaagatg

SEQ ID NO: 247009 - DNA, 606 bp, Homo sapiens
tcttggatgtgtgtctaattctatatacagaagattcttcatggtgcaagaaagtataggagtgggtgggaagtagaaagacaaggtgaaaggctatagattgagagctttcttttgtctcagatcctgcaaatattaggaagtggtgagatcctgagcttcagaatcagaatgtctgaggatggtgtgtgagaatcttgctagtgtcactaaattgatttaaacagaagtcttcaaccttggcttcatattagaatcacttgggtagcttttaaaatgcccaggcttttcccaccccttgaaatgaccatatcaagatctttggggctgagaccaaaacatcagtatttctcaaagctcccctgattccaatatttagcttaggttgagagtccttgtctcagaaggttagaaaggcaaataaagaagtgagatggatggttggcaaggtgtcagtgtagtggaggtgggacttatggtgaaggataaatcatgggctctcgaaagctagtggcctctactctgctccagtggacttttgtatggaccatgtatggaagcagacttgccctggccggatcttcccagacttcaagagacgcttca

SEQ ID NO: 247010 - DNA, 707 bp, Homo sapiens
tgtgagggatgttgtttctttaatttctctttcaagttttgaagaacccacttagtacatgttgctaagttaacctacaaagaggctactatttaagagaaatgaatacagttgtgtaggtaagccatttaagacaaggcgagtgttcacctctacccccaggaccatgataactgcaggggaaataacctcctccaggtggagaaaagtaaggctttcctggtttccagcaaacaacacacataagcaagtgaaaagagtggactatgacccaggacattctccagggaatggggcagtagagaatggtcccccaggctggaaaatgagaggggcctttaactggctcaaaacagccaagagagactcagaggattaagtgaaaggagaccacttctcaaggaattattccaggttttgaagcttgaagccatttgaaaataaaccactttggatgttttgacagcaggttcaatcagggtgaattataaaggttaatattttaatcagcacctatgttttagatgtaattaaagtgaacaggtataggaaggtttttgttgttgttgttgttgttgttgtttttgagatggagtctcgctctgtcacccaggctggagggcattggtacgatcttggctcactgcaacctccccaacccgggttcaaactattcacctgcctcagcctcccaagtagctgggatt

SEQ ID NO: 247011 - DNA, 468 bp, Homo sapiens
gtccgagacttcattcttgcagtcagctagatcgagaactcaccagcaggaataaattccggacccagtaggagagaggtaacttttggctatattaaaggacagagaacacagaagacgaaaaagatatgtatggggtactctgtttgacacaactgtgttgcagtcatacacatgtccctcagcataaatggggctttgacagtggttcctttctagttgagcagtggatacaactacacagctgaagcaataagctgatacattagcagagcatgcaactgaaacaaagtatcctggtctgaatgccccagtgaccaggtgtaagtggagtcaaaacttacaagcacatgtaatgttagagtttgtgataagggacttttattcctataggaatgtgtttttcttaagatatttcatgcttaagtgttagaacttcgtttgaataaattatttcattcaacccct

SEQ ID NO: 247012 - DNA, 1522 bp, Homo sapiens
gtttggctgccaccaaagttacttctagtccttgctgtccactcctgccctcagtctggacctgcccaaggacccctgcaattaggcctcccatgcagaggtcagtgagagcccaagccaattgctctaggccccgtggctggctacttatggggcactgtcctgaccagctctgctaagatgctcctggcccctccctccaccccgtccagaggacggacccccagcgccgtggagaggctggaagccgacaaagccaagtatgtcaagacgcaccaggtgatagctaggcgacaggagccagccctgcgtgggagtcctgggccgctcacgccgcacccctgcaacgagctggggccccctgcatcgcccaggacgcccaggccggtccgccggggaagcggcaggcggctgccgaggcctgattccctcatcttctaccgccagaagcgggactgcaaggcttcggtgaacaaagagaacgccaagggccagggtctggtgcggcgcctctttctgggtgccccgcgggacgctgccccgagcagcccggcctccacagagcgacctgcggcttcagggggttgggctgcgccccaggatgccccggaagcggcgggaaagcgggcgctgtgtcccacgtgctcgctgcccctgtcggagaaggagcgcttcttcaactactgcggcctggagcgcgcgctggtggaggtgctgggcgcagagcgcttctccccgcagagctggggagccgacgccagcccgcaggccggaacttcgccgccgcccggctccggggacgccagcgactggacatccagcgacaggggcgtggacagcccgggcggcgcgggcggcggcggcggctcggaggcagcgggctcggcgcgggaccggcgccccccggtgtcggtggtggagcgcaacgcgcgcgtcatccagtggctgtacggctgccagcgcgcccgcggaccgccgcgcgagtccgaggtgtgaccgccgcggctccggactggccccgggactggccccgggcacggaaaaggacacccctcttctggcgcgctgggtgcctttgcgtaagcccttccttctggaactcagtttagcgtctgaaccttggggaggtggaacaagttgctgccgaaggcccttccctgctcccgcggcgaagggggagggagaggcctcttggtccctgtggagacccggtctggggagtcacgattggggtgggagatgagcaaacctgctgaataaagttaaaacgttatttaaatggggagctgaggaaggagcaaacgggttttcgcggttaaacccgtgggttttggaatgtgtgttcccggctgtgtgatcctgggcaagaacttgacctccctggacgcagcggcacccctcggttattaaggagggaggagtaggggatagaagtatttcaaaatagttgtaatgcgcatggcaaagtgcccagcatatagaaagtgctcaataaacgataactgctgtgacttctaccgaa

SEQ ID NO: 247013 - DNA, 469 bp, Homo sapiens
gtctcgaacttctggcctcaagtgatcctccccccttggcttcccaaagtgctgggattataggcatgagcaatatttaatttgtgagcttcctataaaatatagacataccaatattcattattctgctctccttgtttatttttcgataatttataagattgtggaccaggtgtggtggctcacgcctgtaatcccagcactttgggggaccaatgtgggcggatcatctgagatcaggagttcgagaccagcctgaccaacatggagaaatcccatctctactaaaaatataaaattagctgggcatggtggtgcatgcctgtgatcccagctactcgggaggctgaggcaggagaatcgcttggacccgggaggcagaggttgcagtgagacaagatcgcaccactgcactccagcttgggcaacagagtgaaaccccatctcaaaaaaaaaataaaaaataaaa

SEQ ID NO: 247014 - DNA, 318 bp, Homo sapiens
gtgtgtgccacctcacccagctaatttttgtattttttgttagagatagggtttcgccatgtcggccaggctggtctcaaacccctgacctcaggtgatctgcccacctcggccccccaaagtactgggattataggcttgacccactgcgcctggcctctttttagggctgttttgaatatattttaattggagtggaaaatctctgtccatttggatgaggaaatatgaggaaaggtacacctgcacttgtgttatatttctatctgatgtagcattatctcattatcttttttttttttttctgagacagggtct

SEQ ID NO: 247015 - DNA, 722 bp, Homo sapiens
gcagaatcaacctgaaaagtcaggcttggggaccacccccttctcctgctgtaagcgcctggattctgcaccccaggtgccctgaagggatttcttccctgtgtgtccccgggtcctcttctgataaggacaccagtcattggacttaaggcctctgctaatccagtctggcctcgtctcaaattgaagaacatctgcacacaccccatttccaagtaagatcctattcacaggcaccaggggtgccttcaatgcatcttttggggggaacacaattcaacccacagcatcttctgtgttgttctgcccaaggacagccaccccccagcagccgcggtgagaagttcccccaggtttggggtttccaatcttgggtggcggcaggctgggagccagggaccgcttgagccttactgtgctctcctgctaggaggggcggcagctccttgcccctggagacagcgcggctccccagagcagctgagtgtcttgcagtcatcaacagccacctcatctcagaggcagcacctggaatcttacctgcctcacctcctttagtcctcaaaacacctgtgtcccaggattatgtcccttattctacagaggaggaagctgaagtgcaaactaagaggaagttccgaagcagcaggttggggtgccaggtgccagcctggtgaggagctcggggctctcgcgaggaccgtgacggggctttcacccca

SEQ ID NO: 247016 - DNA, 941 bp, Homo sapiens
actcgggatgcgtggctcagcctcttattatcttgaaaggcagcagaagtctgaccccttctgtgtgagcttcccatggctgttatagtcacttaccaccggctgtggcttaaaaccgcgggagcgtatttcctcacagttctagaggccagaagtccagcatcagggtgccagcagggccgtattccctctgaaggcgccagagaagggtccatctttgccctcccagcttccggcggtcaccagcaggccttagtgtttgctggcgcagctgcatggctctgatctctgcctctgtcttcacagggatttcttccctgtgtgtccccgggtcctcttctgataaggacaccagtcattggacttaaggcctctgctaatccagtctggcctcgtctcaaattgaagaacatctgcacacaccccatttccaagtaagatcctattcacaggcaccaggggtgccttcaatgcatcttttggggggaacacaattcaacccacagcatcttctgtgttgttctgcccaaggacagccaccccccagcagccgcggtgagaagttcccccaggtttggggtttccaatcttgggtggcggcaggctgggagccagggaccgcttgagccttactgtgctctcctgctaggaggggcggcagctccttgcccctggagacagcgcggctccccagagcagctgagtgtcttgcagtcatcaacagccacctcatctcagaggcagcacctggaatcttacctgcctcacctcctttagtcctcaaaacacctgtgtcccaggattatgtcccttattctacagaggaggaagctgaagtgcaaactaagaggaagttccgaagcagcaggttggggtgccaggtgccagcctggtgaggagctcggggctctcgcgaggaccgtgacggggctttcacccca

SEQ ID NO: 247017 - DNA, 276 bp, Homo sapiens
gccctgtgatcttggacaagcctctctcaggctcactttctgcctctttaaaggggtggggggcaacctgtcctgttggggccctaggaaggatgaaatgaggcaccctggcaaagcacacagtccagaacaggcttggaagtgggggctgtaatgtcctgagagggactatgtagctctcttgctcttgacaccccctgcctcgtgtgtgtgttcgtgtgtgtgtgtgtgtgtgtgtgtgagagagagagatgggtgaggcgggtggatggtgtg

SEQ ID NO: 247018 - DNA, 287 bp, Homo sapiens
catcttactgttgcttcaaagtctccctcaaattccactttctccatgagaactttcacagttttcctaaccagatgaaaactctctctcatttgatgccctactgcaatttaatcttacaaattgaaattcataactctcttacaatgttttatctttctgtagtcattttccactgatgtacaggattgtgtatttgttgaaaatgtgaattgtatttccttaaactttgtatcctctctctcaaaccaaatagatgcccaataaatgtttgtagaaatgaaatt

SEQ ID NO: 247019 - DNA, 887 bp, Homo sapiens
ggccacagcccagcgagggtgaggtgggggagcgtcctggctgagggctgggccgcctcccgcgtgctctggggaacaatgcttccgcaccacccccgccccttcctggcttctgtgaaactgaacatctccaagtaaatattttcactgctaagcacaggcagcacttcgaggcttcgtgacgaagacgtggaatgcttgaccctcacctctcacctctcacctctgcaggtcctgggcgcagacttcaccttctggaccttctcctatccggaaagtatgtggctcacacggtggtgcaaggagccttgggctgggcagctgctggcctggatccgagtcctgccctggtgaaagtgctgattactttacatacttctacatctgcagaaccaggtgattgatcctcaaagcccagccagctccagcaagctctggtacctgcaaccacgggccgccctgtgcccggcccaccttcctcgaaccgtgttccgctcacctgtggcgcggccgcccccggagcagcgcgtgccgtgtgccgaggacagaggcagacccggacagagatagatgtggaggggtagccagtatcaggggcacccccgcttgtgctcactgccccacccgcctgcttttgccgctaacgtccagacattcttctcttaaccccaaagcccctggggttcagttcctgctgttgcagcccaagggctccaccaagagctgggggcagtgtccacctcctgggggtctcgaggggctccataagagccccttgtcctgagcccccacccaggctgcgcactggcagctgttcagtcccggctggctttaattgttgtcgtttaatattcaatattgacataaactctattttggttgtgaaa

SEQ ID NO: 247020 - DNA, 590 bp, Homo sapiens
agggagcctggtggggggcagggcatggaggtacacagggctgggagacaacctcctctggctgtgatttggcatttcttccatctctaactcacctgggggactccttcctgccaagccagaggagcagggcacgaatagagcctgatcctgttggagatgggtatggggagagggactgagacagagcagccttggctgctgttagagagttgtccagtctcatacctgttaccctccagttgatcaggtctgtccaggtgctgtgactcaccttgccagctcagaggagacgctgagtggtacggctggggagcacaggcttagaggtgacctgcagccaaaagcatttggcttttgctctgccaatggtccagtggattagggggtcttcagcctgtttcctaatgctctgagattctgtgccagcccaggtccctctattctggaaacaaaggcctagatccccgtatttccttcttgctgttttgtttttgtttttgagaaagagtcttgctctttctcctggagtgcagtggagatctcgccactacactccagcctgggcgacagagtgagactcccatctc

SEQ ID NO: 247021 - DNA, 538 bp, Homo sapiens
ttccatctctaactcacctgggggactccttcctgccaagccagaggagcagggcacgaatagagcctgatcctgttggagatgggtatggggagagggactgagacagagcagccttggctgctgttagagagttgtccagtctcatacctgttaccctccagttgatcaggtctgtccaggtgctgtgactcaccttgccagctcagaggagacgctgagtggtacggctggggagcacaggcttagaggtgacctgcagccaaaagcatttggcttttgctctgccaatggtccagtggattagggggtcttcagcctgtttcctaatgctctgagattctgtgccagcccaggtccctctattctggaaacaaaggcctagatccccgtatttccttcttgctgttttgtttttgtttttgagaaagagtcttgctctttctcctggagtgcagtggtgtgatcttggctcactgcaacctccccctcccgggttcaagtgattttcatgcctcagcctcccaagtagctggga

SEQ ID NO: 247022 - DNA, 362 bp, Homo sapiens
atcactcttctttttattcagtaaagtgctaagggaattagtatcagggagatatggcagataattctttgcattttagtgagtttttaaaaatacaagatagaagtggattaatagcacgaataaaaaataagaatagtagatgtagcatggaaagagaataacattgcagcccccttgagaccaaattacaggtgggatctaagggagtgcaagtaaagtgggattttatgagtctaaatgatgtgatttagataaaagtgattcttaaaatgtggttattggtcacacaggaatctctgagtccttcccaagagtgaagcacatgaatatgctgatgatgaagtggggattagtaatag

SEQ ID NO: 247023 - DNA, 388 bp, Homo sapiens
tctcatgtggctgtcacccatctgacccctatcacagacctgagggtaagtggtgctcacgggcccacatctgtcagcctgcgcctggttggagacgcctccctctcatttgtccttgcttgctgcgtgactttggcaagtgcttgcctctttgagaccctcagttttcacacctgagaaatagaaaggtggtgcctgccccagctgccacgcagaagagtttaggtggcatgtgagaaaatgccttatgaactacgatgtgagcaactgcagcatgctgtgaacaccgctttcatgagctcctcaggggcagggtaacacccaagcattcttacacctcccaccgggcttgtcacgaccgtatgcaaatgaaggccatcaagcgtgt

SEQ ID NO: 247024 - DNA, 427 bp, Homo sapiens
cagcataggtcaagttctggtgggtatttaagttcattatcacaccactccagagccataataaaggactacttttaatttctgctctaattactgagaaataatttacttaaatcattatagttggcatttgacatggaacacagatactggtttttgttttgctttgatttacacccccccacttggagaaaggaatctgaagaaattaaaactcattttccatataccccttcttccttggtccaggaacatttgagattatccttaatgttgggccatttctaactcagccagtgcaattgttgaatttgtggttttcagcagatttgcaatttgccttttgatttgactaatgattgctttttaagcctttgtggcatattcgttttcctaatattttaaataaatagtgaaatgtcatgga

SEQ ID NO: 247025 - DNA, 582 bp, Homo sapiens
aagaatgcctaggcatgtactgtttaagtgactttaaatagcccccttttttcttcttttgagagaaaatttgtatgtcttatttaaattgtgtgctctattaatgtaggtgatagtttcatttataacatcttagtattgttctaccctctatcatgttggttcactgctatttgattttcaaacagtgaaaatatttttaaggaatagaattatacatccacaatctcttttccaaaaccatttggactagacagttatgttaatatttctgcagttaaacaagtgaataggccgggcgtggtggctcacgcctgtaatcccagcactttgggaggccgaggcaggtggatcacttgaggtcaggagttcaagaccagcctggccaacatggtgaaaccccgtttctactaaaaaaaaaaaaaaaaaattagcagggcatggtggcacatctgtaatcccagctactcgggatgctgaggcacgagaatcgcttgagcccaggagggagaggttgcagctagctgagatcgtgccactgcactccagcctgggcaacagagcgagactcagtctcaaata

SEQ ID NO: 247026 - DNA, 480 bp, Homo sapiens
agttccactgtagttcctcagttgataaaagactcatttgtttatgttgttagcattgatcaaagttcatatagcaaaataacacagtagtaactgaaagatagttaccatcatgttcactcattcatgaaatcttaccttgccatcttcactgtcttgagtaaatttaaggtgtttgtttaacatctgtaatatgtttaagtttctgactataatgtagtaagatataaagtatatctaattttgaacttctctgcaaaggtaaaggatctctattaaacatccatttgaatcctgttaaatagttttagaacataatctgctaaaagttctgaagctcctttccaatacctgcttctcctgttcagttacttaagatagaatataggcatttaggcattgcacggagtcctttggggaaggtgaggtgctggcagaatttaattatagacagatgcattagtttcctgttcctgctgt

SEQ ID NO: 247027 - DNA, 423 bp, Homo sapiens
aatctcatgtggttgcaaatgtttgttaaagatttgttttctgtaagtagacttagatattccagagatgaagcagacatctttctgatgatccgaattgccaacacatttccaaagtaaaaggcgacatcagtggcttcccatttctgaaatctctgaaaaactaaacacctcaagtttgtttcacatcattaatgaataactctggaataagggggagtagggtgtgcctgcagaagagacacaactttcacttgacctttcacacatccgtatttctaaagtgaggcattaatcctaaaaggcctctcatcggagtttgtctcctcagatggggcaaatggtgtgttaatatatctgtcatataagtgctaattaagtatttgttaaatgaataaatgtcttccattaagaagcagatga

SEQ ID NO: 247028 - DNA, 806 bp, Homo sapiens
cgactctaaggtcccctggtacgctcgggttagtgtcagctcaggaaccctcggcctcccaaaatgttgagattacaggcgtgagccaccatgcccctcttacattcttttcttctgttcactacagccgtggagagctccgggttgtcctgcacatgtgcactgccctctcttttatggaccttttaggctggctgcaccctccgtctgtgtcaccctcctgctcctcctccacctggctagttcctgttggccacttttggaaattcatgccagtccagtccaccctgagtacatcctctttctgtgtcactgagctcactatgctgggttttatctatgtctccctcgcaactagatcattcacgtcttgaagttaggcatcatgcgttcttcatttctgtacctcccaactcaatgcttagcacccagcaggggctcaagactgtgtgtggaatgaaggattcgtgtgaaaatgcagggagatggaaggctgagcgtttctgttccttgaccattcccgggtttgactaataactctcatacacactgctactcattgaaggcctactgtgtgcatgcattccatgtgtgctatacagtttatttattgttaacccacgtagaattcccagacacatagcgttactacaaacttcatcacaaaaataaagaaaccagggccctgtttctctttgtttctcagatgagaagtctcaccagagttgactgtggcttctgagcattatgaggcacatgtaggatttaaagctgaaaggctttatccctgagactcagggaaatat

SEQ ID NO: 247029 - DNA, 513 bp, Homo sapiens
ggaggggttggggggaggtctgtgtaggcaaattacttctttcccattaaagatgaaaagtattttatgggtagtcaggttctccatgttactctggggaaaaaagacaaagatcccatttgtcaagcattcatttgcttttgagtaattagaaaaacatacgtcagaaacttctcagaactggcaggttactcaatgccctttgcaaacaatctcaactacgcacagcctggtaaaatacggattgcaaaagccacaatgcagaactaattttgtaggactataatgagatgggagaaaagtaaggaaaaaacatattgggtcaatttaatgagtcatttttaaacaaacatttattgagtcctagcaggtgtatcatgcagtgcttagcagatgaagaaagtgtatctcgtacttttgtaaaatatgcttttgtcgagacacactgatatatgaaaggagtgtggcaacaagagaatgagaaaaaaaatttgtgtctaatattagtgatat

SEQ ID NO: 247030 - DNA, 456 bp, Homo sapiens
ttttcttttgagacagagtcttcctctgttgcccaggctggagtgcagtggcacgatcttggctcactgcaacctccatctcctgggttcaagcaattctccggcctcagcctcccgagtagctgggattacaggcgcccgccaccacacctggctaattttttgtatttttagtagagactgggtttcaccatgttggccaggctggtatcaaactcctcaactcaggtgatccacttgccttggcctcccaaagtgctaggtttacaggcacgagtcactgcacccagcctgaagcattattttcaacagtcaaaaactggaaacaatccaaatatgtgtattaacagaatggatagatggaaatggtgttatattcatatgatggaaaaactataacaaaccacaactttatgttgcatgaaagaagtcagaaacaaaaaaagtatatactat

SEQ ID NO: 247031 - DNA, 352 bp, Homo sapiens
agagtttttgaaacactgtttcttaaatttctgtatgccttaggacagttacctggggctgcaaatgattgcttgtttttaaaagtaattttcatcacttgcgtttggggagagagtgtgcagagctcctcactgtggcactcagaaactgtcttattatactttaataatttttagaattgtcttgagttctatataatttttattcactttaataatttatattcgtgtttcttattgtgttttaagcaatatttattttctttttattcatttaagtttgccttgtttatatgagttttgttttcttctacttcttgttgggctttatcagctcatcttttattttctc

SEQ ID NO: 247032 - DNA, 451 bp, Homo sapiens
gtactgaagaatttaacttgaagaagaaagggaggtgccagggttgtgaagggcacccccttctccttaagggtcgaagaagacctatttgttaattcactgctgagatacagcactcttaccctgtccgcccagaacccctggcctgcactgtttcccccagagcatggaccattgcaaccagacatggtgcacccagcagttacctcactcggcagggtttaccgagtatacacagaagacaatagaccgctttctcaaactcatatctatagaccaccattatcagagtcccctggggtctctttaattaaaaatacaagttctagctgggcacagtggctgatgcctgtaatctcagcactttgagatgccaaagtgggaggatcacatgaggccaggagtttgagaccaacttgggcacacaaacatagcaagactctgcctctac

SEQ ID NO: 247033 - DNA, 2057 bp, Homo sapiens
aagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaa

SEQ ID NO: 247034 - DNA, 1807 bp, Homo sapiens
  misc_feature (583)..(583): n is a, c, g, or t
tcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagccaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccaccncctcctcctcctcctcctcctcctcctcctcctcctgctcttgatgtgggagagacttcaaacttacaaccaccaccaccactaccacctccaccttattcctgtgatccaagcggcagtgatttgcctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaa

SEQ ID NO: 247035 - DNA, 2048 bp, Homo sapiens
  misc_feature (1029)..(1029): n is a, c, g, or t
aagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagagccagactatgaaacttcaggtgtttatagcacaactgcatctacagcaaacttgtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccaccncctcctcctcctcctcctcctcctcctcctcctcctgctcttgatgtgggagagacttcaaacttacaaccaccaccaccactaccacctccaccttattcctgtgatccaagcggcagtgatttgcctcaagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggcccgaatcgcggccgctttttttttggcaattttaaatgctaatttttatttactgctaactgtgcaaaagacaccaattcaatacagtgcagtaaaacacttacatacatccagtattaaacaatagcatatgggataaatctaaagcagagaaccatgtgccttcaaaactgatatcacagaatgcaactggcttcagataattctcaagaaacgtgaagagctctttaatttaatattaagtgagttatccagaagcaaaggctcttgggttttactttctagaaaaaagtggaagttactccatctgcatgggtttatatgatgtgtgatttgggccaagaaatactttatattcatttatcagggcacccagctaatattgctgcaatggctggcaggaaacaggtgatcaagagtgtcactgggtggggcacactcattcctggcgccaatatcccct

SEQ ID NO: 247036 - DNA, 2197 bp, Homo sapiens
  misc_feature (973)..(973): n is a, c, g, or t
aagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggaattcatctcggtttataaacaggcacaacatgccgggccctaaagttgatttttacccaggcccaggtaaaaggtgctgccagagctatgataacttctcttatagatctcgttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctaatcatggaggtccctctacaatggttcctgctacttcaggatactgtgttggaaggcggggacatagctcaggcaaacagactttgaatttagaggagggcaatggccagagtgaaaatgggcgatatcatgaagaatatctttatcgtgcagtctcttcaggacagaaagtcatgttctatgtctcctcaggacacagttacctcatacaactacccccagaagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccagtgattgcctcaccatcctatccatgccattctgctattcctcatgctggtgcctctctaccaccaccaccaccaccaccaccaccaccaccaccaccaccaccncctcctcctcctcctcctcctcctcctcctcctcctgctcttgatgtgggagagacttcaaacttacaaccaccaccaccactaccacctccaccttattcctgtgatccaagcggcagtgatttgcctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaa

SEQ ID NO: 247037 - DNA, 1176 bp, Homo sapiens
cttatgtcagtcaagtcactaatttttttgatttttaattttagatacaaaagttttgcagtactatttcaatctaggattgcagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaa

SEQ ID NO: 247038 - DNA, 1753 bp, Homo sapiens
  misc_feature (583)..(583): n is a, c, g, or t
tcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagccaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccaccncctcctcctcctcctcctcctcctcctcctcctcctgctcttgatgtgggagagacttcaaacttacaaccaccaccaccactaccacctccaccttattcctgtgatccaagcggcagtgatttgcctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaa

SEQ ID NO: 247039 - DNA, 1946 bp, Homo sapiens
  misc_feature (583)..(583): n is a, c, g, or t
tcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagccaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccaccncctcctcctcctcctcctcctcctcctcctcctcctgctcttgatgtgggagagacttcaaacttacaaccaccaccaccactaccacctccaccttattcctgtgatccaagcggcagtgatttgcctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaaaaaataaaatacaaaaaaaaaaaaaaaaaaaaaagcaaaaatcacataaagaatataatttaagattttcgatctaaggggggacgtgtgacaaatgtagaccctattcgtagagcatattgacattcttatgactgac

SEQ ID NO: 247040 - DNA, 1409 bp, Homo sapiens
  misc_feature (583)..(583): n is a, c, g, or t
tcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagccaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccaccncctcctcctcctcctcctcctcctcctcctcctcctgctcttgatgtgggagagacttcaaacttacaaccaccaccaccactaccacctccaccttattcctgtgatccaagcggcagtgatttgcctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatgatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcaggaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcaaaaa

SEQ ID NO: 247041 - DNA, 731 bp, Homo sapiens
gagacaacataaaaaggtgtctatgaagtagatatattatcctcacgttaaaggtgagaacgtaggcccagaaaggttatgaaatgtgtgcagagttcctcagctagtacaggcagagctgggatttaaaccttgtctgatttggccagcgcagtggctcacgcctgtaatcccagcactgtgggaggccgaggcgggtggatcatctgaggtcaggagttttcgagaacagcctggccagcatggcgaaaccccatctctactgaaaatacaaaaattagctgggtgtggtggcgggcgcctgtaatcccaactactcgggaggctgaggcaggagaagcacttgaacctgggaggtggggaggctgtagtgagccaagatggcaccactgcactccagcctgggcaacagaatgagactccatcttaaataaataaataaatcttgtctgactcaaaagctgggaaagccccaaacagacccagtgttcattcttcctccctctctgctcttctgtctccacaagtctctcactctatagacattcacgccttgccttggatttgatgacaagcaggtaagcttcaggcaagcacagttcccagatcctcccccagctgtgacccagactccatgctgggcaaggtctttgacacctccctttccaagccccttctgatgtctgccatccatccttggtcaaacaagaagtggaaagttggacatggta

SEQ ID NO: 247042 - DNA, 323 bp, Homo sapiens
aggtgttgtatagatattatttcctttaattcctatagcaatattgtaagttagatattaatttgctcctattgtaaggcataattattaatacttggtaagtggcagaacttagattcaaaaagccattctccagaagcccttgttctatcctcacatttctattttaagaacaaaattattatgcacaagtgcttcagagagactttgcaggtttttgttcataactatagtgcttgaaacaataaaaattgaagagacaaatagtataaactttaaaactctgcttaagaaataaaaatgcctcttaaacaattagttaa

SEQ ID NO: 247043 - DNA, 772 bp, Homo sapiens
ctgcaattagctttccaagccccctcccgtggccgtcccctcccaagacctctcacccatgtagcaatccctacatggctgcctgtcatgtccctactctctaagccctcctgcccactgttcctccctccccgacatgctgacaccaagtggtggaaaccacccctcagccccagcctgccctgtgcagagttcagctttgtgttgaatgagggggagagggacaagtgagggcggagagagagttcaggaggaggcaggatgcgcagggagcagagagtgagggagggagataccgaacagatagacagaaaacgttgtacggaaaagttgttttttcttattttttttccgggagaacccgcttacacagctctgtttgtaatttttttcttcatgctaaaatcacacggcctatttgttgatgtaagttgcctgaattccgtggtatgctatcttcttttttaaaaacaaaagcaaaaaaaaaaaaaaaaagcaaaaaaagagaaaaatctagaaaaaaaaccctaaaagatattgttgttaggtttgtttaaatgctgctgttgtatctgtttttaaagccttaaaccagtagagtttttttttctgtttcttttcaatttcctttcctttctgttccttttgatttcttaagacaaacaaaagaccaaaacccagagagtcacagagcccgtgcgtggggtgcccagggcatctgagccgctgcccgcttaaagcgcagtgctcggccggctggcgggcgggccca

SEQ ID NO: 247044 - DNA, 1407 bp, Homo sapiens
tgatcggtctttcgttagaggccaggcagtgctggatccatcttgacgcctggcagaaggggcagcgtcaccaaaccttgcagacaggctctctctggggcacaggtctcccgggtggcaggaggacaggcctggcctagcacatggtttgccacgctgtgtactgttgcccaaaaggagagtgcttgtcggtacagacgtgtgaggcccggattgtgtgtgctcgaggccaggaagaggaagggagctgctgcacctgcttgggtgacaaacagtgatgaatagcacctcacagcaattaggatgactgtcatcaaagacacagaaaatagcaagtgtgagcgaggatgcagaaaccctcatgcacagctgctgggagtatgaaagggtgcaaccactgtggaaaacacgttggtagttccccaacaagtggaacaccatcaccatgtgacccagcaattccgccctgcgcatgtatccgaaatagctgaacacagactcaagcggatgtgcgtattcccacgtctatagcagcgttgttcccagtgaccaaatgtggaaacaggctgtgtctgttgatgggtgatagacaaacaaagtgtccgtacatacaatggagtattactcagtctggaaaaggaaggaaattctgacacactctgcaatgtggatggcgcttgaggacatgatgcttagtgaaagtagccagacaccaaaaagggagactgttacacgatcccgctatctgaaatagctaggaaaggccagttcatcgaggtagaaagcagacgaaggctcgtcgcggctgggaaaggccagttcatcgcggtagaaagcagacggaggctcggtgtggtggctcacgcctggaatcccagcactttggatggctgaggtgggcggatcacctgaagtcaggtgttcgagatcagcctggccaacatggtgaaaccccatctctaataaaaatacaaaaattagccaggcctggtggcgcacacctctaatctcagctactttggaggctgaggcaggagaatcacttgaacccgggaggcggaggttgcagtgagccaagattgcgccactgcactccagcttgggtgacagggcgagactccatctcaaaaaaaaaaaaaaaaaagaaagcagactagacgttaccagggcctaaggcagggggagtggggcgtgagtgtatagtgaggacagagtttcagtttgggaagatgagaagttttggaggtggatggtggtcgtggttatacacggtgagaatgtcctgaatgctcctgaattgtacgcttaaacatgcttacactggcaaagattatggtatatattttttactatattaaaaagttaaaaaagggaagatacctacttcaacttggcagcttaaaaaac

SEQ ID NO: 247045 - DNA, 941 bp, Homo sapiens
agttaaaaatatgaagattaaggggaaattggagacaaggctttggaaaagctacattcctcaacttgatttttaaaagtagctgatgatccaaataaaagaatttgtcattttcaatcttttcctcattgttcatctgacagcggtaaaagctattactcagtctggaaaaggaaggaaattctgacacactctgcaatgtggatggcgcttgaggacatgatgcttagtgaaagtagccagacaccaaaaagggagactgttacacgatcccgctatctgaaatagctaggaaaggccagttcatcgaggtagaaagcagacgaaggctcgtcgcggctgggaaaggccagttcatcgcggtagaaagcagacggaggctcggtgtggtggctcacgcctggaatcccagcactttggatggctgaggtgggcggatcacctgaagtcaggtgttcgagatcagcctggccaacatggtgaaaccccatctctaataaaaatacaaaaattagccaggcctggtggcgcacacctctaatctcagctactttggaggctgaggcaggagaatcacttgaacccgggaggcggaggttgcagtgagccaagattgcgccactgcactccagcttgggtgacagggcgagactccatctcaaaaaaaaaaaaaaaaaagaaagcagactagacgttaccagggcctaaggcagggggagtggggcgtgagtgtatagtgaggacagagtttcagtttgggaagatgagaagttttggaggtggatggtggtcgtggttatacacggtgagaatgtcctgaatgctcctgaattgtacgcttaaacatgcttacactggcaaagattatggtatatattttttactatattaaaaagttaaaaaagggaagatacctacttcaacttggcagcttaaaaaac

SEQ ID NO: 247046 - DNA, 559 bp, Homo sapiens
agactaagtttttaatatttcatttggaaattgtttcaaactttgtgaaaagttgtaagaatagaacaaataatgctcatatattctactatttttatataaacagtgcagtcatgaaattcagggagtttaacctcgatacaacagtattacctaacgtacagaccctattcctgttcaggcagttgtcccagtaacgtcctttacagcattgtttttttaattcaggattcagtccaagatcatgcattcttttcactgagttgtcgtgtctctttagtcatctttaatctggaacgattcctctgtttttgtctttcatgacattgacattttttatgagaacagggccagttagttaagctgcataaactctcttattttgagtttgtctgatgcttcttcctgatgatattcaggttatgcatttttagtaggaagactatataagtgatactgtgtcctgccaggaggcatgtgatgttcctttgtcccattattggtgatgttaattttgatcatttggtgaatgcaagtgtaaaacatttgcaaggtaaaa

SEQ ID NO: 247047 - DNA, 197 bp, Homo sapiens
  misc_feature (2)..(2): n is a, c, g, or t
  misc_feature (10)..(10): n is a, c, g, or t
tntgaatccntttggcgcctcctactactttgctgcgagaagacgacagaatggcaggttatgcatttttagtaggaagactatataagtgatactgtgtcctgccaggaggcatgtgatgttcctttgtcccattattggtgatgttaattttgatcatttggtgaatgcaagtgtaaaacatttgcaaggtaaaa

SEQ ID NO: 247048 - DNA, 456 bp, Homo sapiens
tggtggtgatggctgcaaaacagtgtgaatgtccttaagaccactgaaatgttgactttgaaatggcaaaagcagtaaattttatgctatgtgtattgtaccacaatttttatttttagtttaaagaaaaaaaagtatccctttcaggataaaatgggaagaaatgtttagcacgttagattccctctggctattagaagcatgacttagtgcttacagtagaaaatgagagtataaattctcaagttttatattttggttatgcccatctcaaaaatgggccaaatgaggtttacttagcagagataatgggcatgtctgtaaagtgcttttatatccttggatgaaaggttctaggaacgtgccctgcattactttgaatgaattcttaataagaaatagttgtgtgcttgtgtacataaaagaactctaaataaagaagtaacattagatgat

SEQ ID NO: 247049 - DNA, 711 bp, Homo sapiens
cctacaatggctatctattaccttattctctggtttgtttaatgttcgaatctttccgaaagatccttcaacctttctggaagaatctaatctgataacaccatcaaaaacacattacttcttttggcataatttaaattgtaagacatcattcacatttatcaatgttacatatataagaactcacccaccatattcttccttgaggaattacagcatgtaattctataatcatttttataatcgtctaacaattttataatggattggttgcttactatcaattttttaaaagtcatggcttctccagtcatttcttgcttatcgaaattatttcatgagatgggtctctccttgtatatttgaaaatgaggtttgcttccttctacttaaaaaacaacttgaacatacctgtttggatcacatggtcttgtcctgataacttggaagaggttgcttcagcattgttcttattgttgtggtggttattattaatattgtttcatattctgtttaaaaaattaaaattttacacaagaccaatgtcttcttttcaattccagtacatttttcagaagtaactaatgctattggctttgtgcattgtaatttcagaccattttatatgtctttagttatatgtacagtatacacacatatgtgtcatattattccattttttctagcattaaacattgctatggaaaaaaa

SEQ ID NO: 247050 - DNA, 413 bp, Homo sapiens
aacttgagagcaaagctcaggttttctgttttcttcttactataagtaaataataagttcttcttgaccgatttcttgaattattcccaaatcatgtttctttctgcattggtatatattatggcaagtttgtatatacagatttaaaaggcaaatgcagccaggggcagtggtgcacacctgtaatcctagaatcttgggaggccaaggcaggtggatcacttgaggtcaggagtttgagaccagccgggccaacatagtgaaaccccatctctactaaaaatacaaaaattatctgggtatggtggaacatgcatgtaatcccagctactcaggtggctgaggcatgaggatcacttgaacccaggaggaggaggttgcaacagagtgagactctgtctcaaattaaataa

SEQ ID NO: 247051 - DNA, 353 bp, Homo sapiens
attttggctgaggtcacaagtgccgaggtggttcctttccaccacattccttgtggtttaaccgcaagggctcagtgtgaatgtagtgaagggaagtgggcaagcccagggctatatccagggcttcctgaggtctttgtgcagaggtataagagtgagccagctcatggagcttgccactaagtggaaataaggaagaatcatctgaggcagccatggacatttgaaaatattaaaactaagcagaactgaaggaaatagagacacaaaaaacccttcaaaaaatcaatgaatccaggagctggttttttgaaaggatcaacaaaattgatagaccgctagcaagactaata

SEQ ID NO: 247052 - DNA, 459 bp, Homo sapiens
gtgggatgcgctcgccgcgtccctgctcaggcggagggagcccggcccgccgccagggtctcgagtccgggtccaggcaggcgtggaggtggcgggaacggcgcaccgcccgggtgggcgttgttttaaggccgcagggcttgggaggcttgtgttgagttaaagggagtatgacaacttttcaacttgagtgcacacactgtccccggaatcccgcgttccagggaggaagcgcctttgacagcgcgcgccggttcgtggggcccgacggcgtgggcctgtggttgcggacctggcggagatgcgcgttcgcttcgattgtaggccattccttttaggagctgagaaaggatccgtttttacagcattctcgacctgtgattcttggtgggggaaactagttatgtggataaaaatacagttagcaaaataaaaatgccaattttacatttccttaaa

SEQ ID NO: 247053 - DNA, 563 bp, Homo sapiens
gtgggatgcgctcgccgcgtccctgctcaggcggagggagcccggcccgccgccagggtctcgagtccgggtccaggcaggcgtggaggtggcgggaacggcgcaccgcccgggtgggcgttgttttaaggccgcagggcttgggaggcttgtgttgagttaaaggtcggcccgtagatccccggaagcgcctttggttgccagcaggtgtcggcgagggtcttcagtggccaccctcctggtggtgatgtttccgtttctttccaacaggagtatgacaacttttcaacttgagtgcacacactgtccccggaatcccgcgttccagggaggaagcgcctttgacagcgcgcgccggttcgtggggcccgacggcgtgggcctgtggttgcggacctggcggagatgcgcgttcgcttcgattgtaggccattccttttaggagctgagaaaggatccgtttttacagcattctcgacctgtgattcttggtgggggaaactagttatgtggataaaaatacagttagcaaaataaaaatgccaattttacatttccttaaa

SEQ ID NO: 247054 - DNA, 395 bp, Homo sapiens
tcgcggttgaggaggcgcagggaccgggggccagtagtggccgtaaacacgggccccggccgtgtccggtcgcactcggtagcccgcatggctgcctagcgggagtatgacaacttttcaacttgagtgcacacactgtccccggaatcccgcgttccagggaggaagcgcctttgacagcgcgcgccggttcgtggggcccgacggcgtgggcctgtggttgcggacctggcggagatgcgcgttcgcttcgattgtaggccattccttttaggagctgagaaaggatccgtttttacagcattctcgacctgtgattcttggtgggggaaactagttatgtggataaaaatacagttagcaaaataaaaatgccaattttacatttccttaaa

SEQ ID NO: 247055 - DNA, 342 bp, Homo sapiens
ctgctcgaattcaagcttctaacgatgtacggggacatggctgcctagggagtatgacaacttttcaacttgagtgcacacactgtccccggaatcccgcgttccagggaggaagcgcctttgacagcgcgcgccggttcgtggggcccgacggcgtgggcctgtggttgcggacctggcggagatgcgcgttcgcttcgattgtaggccattccttttaggagctgagaaaggatccgtttttacagcattctcgacctgtgattcttggtgggggaaactagttatgtggataaaaatacagttagcaaaataaaaatgccaattttacatttccttaaa

SEQ ID NO: 247056 - DNA, 380 bp, Homo sapiens
ctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaagcgtgtcaccacaaatctatcaagacagaaagtaagttagcagttacctagtgctggggattttggggaaatggagtaactattaatgagcacaattttcttctcgaggtgatgaaaatattctaaaattggttatggtgatagttgcacaactctgaatataccaaaagccattgaataatatactttaaagcaactaattatatggtatacatatgatatatcaataaaactatttcaaac

SEQ ID NO: 247057 - DNA, 580 bp, Homo sapiens
agacactcattgaagtaacaggcaaaatctagaatcgtgtgtgacttttcacataattctaggccagttttcacactaattttaactaataaaatgaaaattcttaaaattccaacaatctattcattaaatcctgaatttggtacattagctaattgacacaggttaacactgaagttatttttgttaacctgaggtaattggttgttacagacattgagactggaaagaaaaagtgaaaaggaaatggggaggtgtaggtcaaaaaacacaaggtagcattatttaggatgaactgtccaaaaacccaacgtacaacacgaggactagagcggacaagagcgtgctgggctcagagtttttgccgcactgagtggacaagagcgtgctgggctcagggttttgccgcatcgagtaggttatggctgctcctgcatgggtgccaggggagagaatgggaaatcagtgagatgtgggtgtgttaatttgttgcactctaataacaatttcactataaaaatatgtatcttataacatcataatatatgcctcaaatatacacaatacaatttatttttaa

SEQ ID NO: 247058 - DNA, 422 bp, Homo sapiens
gcagagtgccaaaggggaagagatgcggagcaaagaactggaaacttctcaggcattcacattggcaactcctgttccaagaataattatttatgacagatttcaattttcggggcagggatggtgtcttactcatcctgggcttcaggacatctgtgtaacagacgctccaggtgaagcagtgatgtcaaccctggctgaacactggaatcacctgggaagatcaaaaagcaacacctcctgcatctaggtttggtctggatattggaattttttaatgtcctggtggttttaatgggcacgcaaggttgagaactacttatttatagttttcatcaaaagtctgtctggtaaactcttaagtctttttcagtctgaagtctttattttgaattcaatcttaataaaaatttggtggttta

SEQ ID NO: 247059 - DNA, 433 bp, Homo sapiens
agaataaactgatgtagcaggactcctcaaacactgtgcagggtctccatgtcctcgatggcccctgatgagccacagtaccctcaggtcctggtgaaggagctggtgctgcctcctgcctttccccacatggggtcctgcagctcatcccacacagcctcagattccctctacagaacctgcccacagatgtcttccgagaccggcaatactgggaggcctgtggcccagacccaggaggaaccagctgagaggctccgtggaggtatcgctgatggtgtaaccagaatgaaaatgcccacttctgttctgctccctgagaacaactgtcaagccagcatgagtttccagttggaactattccttttctccccatgtttgtcgctgttttaatggacattgcctggctattaaatcccccgatgaactcact

SEQ ID NO: 247060 - DNA, 462 bp, Homo sapiens
agtgggttaattctcacagaagtgggtgagttattgagagcagttcattacaaaagtgagtttggcttcctcggctttctcttgcttcctcggctttctcttgcttcctctcaccctacgatgcattctgctgtgttacaacacagcacgaggccctcaccagaagctgaccagatccagccaccctgtcttggacttcccagcctccagaactgtaaaaaacaaaccccttttctttgtcaattacccagtcccatgggttctatgacagcaacagaaagtggacaaattgtgtaacatgcacatgtccaggagggtgtgtgagaggtaatcctgttgttacggttgttctgtagggtgaccacaattgggaatttccctgggactgttttggttttagcactgaaaactctgtatttcaataaactactcagacctggtaaaccaggatggttggtcaaa

SEQ ID NO: 247061 - DNA, 428 bp, Homo sapiens
aaattagtacatgtagaaaagtttcctggaaagaagctcaaacaatgagctctaaggaattgcggataaaatactggcttctcagcttgggttctggctctagccctattgtcaacaagccaccgtgggagaatatgaagtgagatcatcagctaagagttgaggttccacagatgctactgggggagatgaagaagatatttctcttattgcaagaaatgagaaaaatttactagcaaaatatgatatgtgataccccttccaattctagaattcaatacacttatctcatttttcaaagaattccacaaacactaaatcatataaaagattaaacaaagggagataacagttgcagacaactaggaaacactttacgatagagtgaagatttgtcagttaataaatatgtgaccttggataattca

SEQ ID NO: 247062 - DNA, 260 bp, Homo sapiens
tctcctcacctttccctgcttcctaacccagggaggagcctctgcacagctgtgtgagctgaaagaagggctgcatggtgaatgagcctgccacatctggactgagcactgctgggctctctgcatgccatttggccatgaacagcttagaaatgaaaatggtgttttccactttacccatttgccgtttctctcctcatgtgtattcatgggtgatcctagctcactctttggcaaaggacacactgtttctgaaactg

SEQ ID NO: 247063 - DNA, 407 bp, Homo sapiens
cgaagattaagcacagcactcggctgttttttgcttacatcccttccgcagctatggcataggtcccactttcccttctacagtccttagaaagctcttccagcagtggttctttcctgagacgtggaactcaatattcattagataattaggaaacatcatggagctgcattaatcagtcagggatggaagatctggaagaaccattgtgatggttgacctaggagaaccctaagcttgttgtaaattcatatgggccagtaatgaaaactagaaggattatattaatactaatacaagcagctcttgactgatgaatttgagataaaagtatgttatcatcttgagtgtaaggtttatcacatatttaaaactgagacactctattaaattctgtgtgggatgca

SEQ ID NO: 247064 - DNA, 306 bp, Homo sapiens
tcaaaagaatggagtattctatttattaaaagtatctggaattctattgtgtgtgagtctgtgcaggaacacaatgagtctcaaagtgaaaaaaactttggattcctggttcctacagcacttttgttcagatactctctgttattttgctacgtgaaaagggagcttgaatttcatgtgaagtataaaaaccaaggagaggaatcctgcttggggccatcaagtattatagcattgtggtcatgaatgattaaatagataggagaagtataattctcaataaacaccaaatgaattgtttagatg

SEQ ID NO: 247065 - DNA, 543 bp, Homo sapiens
tcctgaatacctgcatcttcttcctgactgacatggctttaggaaacacagcacattcacaaacatctgaagccaactgcaaggcacccgtcactcagcgagaaaagcagaaaggtgccaattcagatggctgagctacttcgcctgggtcccgacctgtatcaccacagggtcacagaaatggaaccttctccgtcacacctcctgatggcagtcagctgtgacccgctgaatccaggacatcatgcattccagtttcatttgcgagaacatttccaggtccggctgaagcctagtggctccagcagaggtctcaacccctttgggatgctcagtgggagacagaatcaagggccaatgatccatgacctagtcctagtgcccatgtcagtttgtcaaaggccctcagagcagattgtgttttccctggcgggggcttgacttctttgctttaaaaaggattcttaagtatttattgcagtaaaattaaccaccttcaaatttctgccagatcccctggaggtatatagcttattaacacaa

SEQ ID NO: 247066 - DNA, 522 bp, Homo sapiens
ccaagagaacatagtctccccatcttacactcgctcggaatgggggctggccccactctgctctatttaatctgagcactgttgaatgaatctgcgatgaaactccacatttcctttaatcctcacaacaaagataaaccaatttttagattcgtaaactgaggcttagagaagttaaacgtattgtccgagactacagaactggaaaatggcaaagtcaagatccaactccgaagagcctccccctgcccactagcggggaggaaatggcaaatgacacagcaaaaaatgtttaaaaccaggattctcggtcgccgtcccgcccagcgccaacgctccgtcccgcctcgcatcaacgcctcgctcctccccgcccagcgccaatgccccgccccgcgcagccgcccaggtgccagttgcgtaaccacggcaaagctcgcggcagggggcggggcagacgctgactgtcgccgggcggcggtcacgtgagcgggagcgcagcaggccggcggtccgagtgcc

SEQ ID NO: 247067 - DNA, 404 bp, Homo sapiens
cttcatccagaagtcttgtgattggctttacttggttctcagggatttttatggatccttagtccagaactagatcttaaagtagcctggatacagaattacagctagatatgaggaataacttctagtgttccataccattgtaggcttactatggttaacttaggaaatacaaatgaatatcatttccattatcatagttcatttatatttcctaagataagttaatggctacttgctgcgggagaaattcactgtattttcttaatcttaagaggtggggtaacttaactccaaattactatcagttgataatagtgttacttaaactttaaaatgttatattctctgagcacctaaatttaattcaactatggatatttggtgagatgacatagtgaaaa

SEQ ID NO: 247068 - DNA, 634 bp, Homo sapiens
gccagatggtgcaggcagtgaggagagactcaggactgcaacctttcggctccttattcctgctcatcactcagaaaagggcagtactaacccctttcctaaccaagacatggcactccctaagagctcttgtctatagagtttggtccttagaggaaagcagataccttcagcgtgagaagggcttggttgacagttttggggtattatgggaagagtaggttggggtaaagcttgagtctaactcttgatccttacatggacctatgaggccctgccattcagtcaggcactgtccttgggtcctcaaattaactgctgagaacactccccactttccgaggacgctgatgggaaatgggctctgtccatgcagctggaaggatccagtgctggtgccactgtcagtggcaccatccttgccttgaatgatctttcttgcaggctcctgcagctgagtgtttcttgtaagatttttcagggggattgggcaagaagaagaggtgcaaattctgttcccttcctaccttgaagccttcccagaccaccacggtctctgcacaagggaggctcccattactgttctgttggcttctagacccaccatcccctctctttctgtggactctgcccg

SEQ ID NO: 247069 - DNA, 196 bp, Homo sapiens
cctcctagtctttctgtctcctagggaaagagaaaaattacaaagaagaaatctctgtgtgtgtgtagggtgtgtgtagtgtgtgtgtgtgtgtgtgtgtgtgtgtgtgtgtgtgtgtgtgtctttttcccctcttccctttcctctttttatctggtccagaagaatgatttgaaatatatagtgccttgtacca

SEQ ID NO: 247070 - DNA, 470 bp, Homo sapiens
gaaaaataagccctacccccactcccattccctttcagatgggagtgtggggggtgggggtggggtagagagagtgagagagagagataattagaatgaatatatgccagaagaggaggaggcctgggacaggaaaagggagtaaaaggggatgaaccgggtagggaaatcccacccgaactgcgtgagccctctgagcgtctcgtgtcatgggacatctgtacgctcttccgctaagggggtgacgaaggtgggtgggagaggttagggcgctgcaaggcacatcccattccgtgcggctccaggtgcgtactacctggcccacgccggccttgccttccgccggtgcttttgttgcaccctccccacatgtgagcggccgcatgcgcgggcgcaggggcttcggggaaagtgaagtgtcgcgacgctgcgggctgcgcagacctgggagaggtcacacctctttcgga

SEQ ID NO: 247071 - DNA, 595 bp, Homo sapiens
ctctgtctaccaggctgcagtgcagtagtacagtcatagctcactgcagccttcaactcccacactcaaatgaacctcctacctgagtttcctgagtagctgagactacaggtgcatgccaccatgcctggctaatttttaaattttttttttgtagagatgggttctcactatgttacccagactggtcttgaattcctgggctcaaatgatcctcctgcctcagcttcctgagtagctgaggcaggagaatcgcttgaacccgggcagcagaagttgcagtgagctgagatagtgccactgcactccagcctgggtgacagggtgagattccatctcaaaaaataaacaaacaaacaaaaactccatatacaagcaatcatatctctcactatctcagttactctacatacactgaaaacagcttacttttggttttacatatcacaagatcttattagagacacatcagcacgatttgaattctatcctctggtctgttctccagttgtgccactaagagccagttggcctcccaaatattatctggacatatacttacgttagccaactggctgctggtactggtgctggt

SEQ ID NO: 247072 - DNA, 471 bp, Homo sapiens
tcgaactgtcagccttatcagtgtaaccctgtccttctctatcaccacctccaccttaactaactctagacctgccctcagtcgcttctgtggtatggggattgacataaatggaaaagaccccctaggtattttttaaatacgcattattcccccatctcccccttcttcagtagcctcagttctagatctcacaccggttgcttctacatctaataataaaactagggtgtctattgtaaaaataagagatctaaaacagaccttagccatcgagagagtatcaagatgcaaatccctggctgaaatggattaaatattccgttcgcactttaaataaaagcgattgttacgcatcaggttataaatgagcctgtctcctttgttcggtgtactctcatggcaaagctgctggcgagtgtaccctttctgcaggaagtaaaaatggccttgctgaggaaattaaaaaaa

SEQ ID NO: 247073 - DNA, 639 bp, Homo sapiens
  misc_feature (629)..(629): n is a, c, g, or t
ctctctatatttggaattattcatgtccatctctaacagatcacaaactcaaaagccagaaatgcattacagcctcttagctttgaagagttctggattgggtgccttttagccaatgatgcaaggggatggggacacagcatggggaggaggtgccttgagtcctagcaaagggagttgtttgggaaaaactctcaaaccacttttcctctgctctcacactgccatgatcaacacagaagatttctgtgacagcaaaatacatggggaaattttccccgtcagcaagcaagcaatcagttctgcagcagacaccagctgggtgtcccccaattcagttccaacactctccaccccagaggtagcatcagacaccgcagagtgagggctcagtgccataagaccacccccttctgcccgctaatcacaagtctgggcctttggaacttctgaccaaatggtttcaaactggggttcccacaaccccctctttgggctcaattactctgctagagcagctcacagaactcagggaaacacttatgtctattggtttgttatgaaagatattttaaaggatgcagataaacagcctgggtgacaaagcgagactctgtctcaaaaaacancaacaaaaac

SEQ ID NO: 247074 - DNA, 582 bp, Homo sapiens
ataattctattttcatttacaaatatatttatgtacatttgtatagctaggcttagaacaaagactggaagcatatacatcatcaaatttattgatggttatctttaggtggtgacattaagtgggatttatctcattttatactttcatatacttttaaatgtcctataataattatccattatccttttaaaaagaaaaaaatatgcttttaaaaataaaagcaatgcagtcagatgtgtggtgctgaagacttcctaatatcttacagaattttagagaaagaaggaaacagaggacccatataaaccaaagcatctctctttagaggtgatgaaatgggtctagagaagggaagtggcctgcctgaggttacccagactcttagtggctgggctatgacagaccccaggtctccaggctttggggctagaagctttgaagtgttccagtgctagccagggacctgcctctattccttcctgccctgtaggggtgacaaaaagaccagaggaagtgcaatgattccgagggtggagaaggatgtaatagtctttgcagagaggactttgcagctctcat

SEQ ID NO: 247075 - DNA, 321 bp, Homo sapiens
tggttgctccagtcccaaccttcatgtctgtgttccatgtagcagaaaggagagaagaacctgtcacttacttaggaagactttgtggaagctgcactttacatcctgcttacatctctttgactagaatttaatcacatggtcaaaataagcttcaaaggatattaaaatatgttatcagttaaaatttgtggttctatagctaagcaagaagtggttttttttttgtttcagaagtcaatcacattgtctggacactgctggtatactggttttgcccatcctatagttgtataattgattcttttgaacttaaagcat

SEQ ID NO: 247076 - DNA, 486 bp, Homo sapiens
ggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcaga

SEQ ID NO: 247077 - DNA, 463 bp, Homo sapiens
tagctaggaccccagaggtctgcagcaagagcgggttgtccctctgtcccttccctcacccgttacccaggagctgttcaggactggaaactatccctagcatttgagtaccactcacagggctcccacctttctctctcttcagccttcatgtctatgtcacttctctatagactcttggtgtttcatctgcaaagatatgctcaaagtgtgttggttttcttagtattttggtctctgtctgtgtgagcggcatttcctggctgcatctagtcagccatcttgccccctctaacttgaatgcattctagtttgtattctattctgtaataagcatgataaacagccacagccatttttctgaaatgaagatggacctctttaattactttgataatattaataccaataaagtggtatttatattaaaatagtcaataaatagcatattttagtaaaaaaa

SEQ ID NO: 247078 - DNA, 492 bp, Homo sapiens
  misc_feature (7)..(7): n is a, c, g, or t
  misc_feature (155)..(155): n is a, c, g, or t
gaaatanaatgtgtgagatttatgagtttatgggtttctgtctgaaagcattctccaatcttggggcaaggatacaagcagaagctatcagagaactgagtgtgatgctaacagagcagccagaaaattaaaaggaaaatctagtttaaaaaaanttattatatatgtgaagaaacaggaaaatgtgataattacttgggggaaaaaaagtgtcactaaggctccaacttccagtaatggtagaatagcttgatcatcaacagataataatgataaaatctggataatttgaaagtattggagaataagcagaagcaggcagaaactgaataagagtctacccttgaaataaaatgtgtgagatttatgagtttatgggtttctgtctgaaagcattctccaatcttggggcaaggatacaagcagaagctatcagagaactgagtgtgatgctaacagagcagccagaaaattaaaaggaaaatctagttt

SEQ ID NO: 247079 - DNA, 334 bp, Homo sapiens
gattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgt

SEQ ID NO: 247080 - DNA, 908 bp, Homo sapiens
tggtctcaaactcctgagctcaagtggtcctccttccttggcctcccaaagtactgggattacaggtataagccactgtgcccagccataaattgcctggctcagccttccgagtagctgggactacaggcgcccaccaccacgcccggctacttttttgtatttttagtagagacggggtttcatcatgttagccaggatggtctcgatctcctgacctcgtgatctgcccgcctcagcctcccaaagtgctgggattacaggtgtgagccaccgcgcccggccgtaaccacaggtctataaattaccatttttaagattactctgtctgctatgtggagataatagattgaagtaggtatggatagtgatagtgaaaatgggaactggtatttattgtgtattttatgggaactagtacttactgtgtgtttactatgtaccaagcactgtcccgcaccttttacatagattatcttgttgaatcctcagaatggctcaatgaggtacacgctgttttttcactttactgatggggtagtgaggcacacaataacctgcacaaggtcattccattggtaattagagatgggaatcaaactcagccagtctgactcttgagctgctcttctcaactgggcttctgtgggagacttaatacctaatgccctaaggcctccattgtctataatgaattcttctttttcccctgcatctgtaacagtactagctatgtatcattcttgggagaactgagtaaagagccacacaaatcattttctgtaggtttagaactcttgcagagccctgcttcagaaaggctactcagtgctcttgctcataatcactggagtaactgcagggttctgaagagattaaggtgggtcagattcggaggatggcagcag

SEQ ID NO: 247081 - DNA, 778 bp, Homo sapiens
ggtcaatgattcattgatcccaataataaatgttttaataatgataaaacatcctactggggtttttcttgttaaaaactttaggacaggcgcagtggctcatgcctgtcctcccaaagtgctgggattacaggtgtgagccaccgcgcccggccgtaaccacaggtctataaattaccatttttaagattactctgtctgctatgtggagataatagattgaagtaggtatggatagtgatagtgaaaatgggaactggtatttattgtgtattttatgggaactagtacttactgtgtgtttactatgtaccaagcactgtcccgcaccttttacatagattatcttgttgaatcctcagaatggctcaatgaggtacacgctgttttttcactttactgatggggtagtgaggcacacaataacctgcacaaggtcattccattggtaattagagatgggaatcaaactcagccagtctgactcttgagctgctcttctcaactgggcttctgtgggagacttaatacctaatgccctaaggcctccattgtctataatgaattcttctttttcccctgcatctgtaacagtactagctatgtatcattcttgggagaactgagtaaagagccacacaaatcattttctgtaggtttagaactcttgcagagccctgcttcagaaaggctactcagtgctcttgctcataatcactggagtaactgcagggttctgaagagattaaggtgggtcagattcggaggatggcagcag

SEQ ID NO: 247082 - DNA, 387 bp, Homo sapiens
tggttttttagagagaccacatcagctctatgttaaaaaaaaaaaaacactaatggcaaacacacctctacaagtctttcaaataagcctgtaggcttttggaaaaatacccttcttgtaatgtaataaaagtgaattctatcattcactccaattatagtcagtaagatacagaaaaggccacacatttaaaatattgaagaaacaaaaaataacagaccctcatgtctgattaatgggaaaaatattattttgtgtgtgattttgttcatctcagatatgaaaaaaaaaacctttgtttttataacttttctcaaaaggacgtaaacacctctcagtactccaacaaacatgtttaaaacaaacatggctaacaccttaatcttc

SEQ ID NO: 247083 - DNA, 299 bp, Homo sapiens
ttgcatacatttgtaaaagtctattaaaaaataagtctcagccgggcacatcccagcacttggggaggctgaggcaggcagatcatgaggttaggagtttgagaccagtctgaccaatgtggtgaaaccccgtctttactaaaaatacaaaaaaaaattaggtgtggtggcgtgcacctataatcacagctactcaggctgaggcaggagaaccgcttcaacccgggaggcagaggttgcagtgagctgagactgcgccactgcactccagcttggaagacagagcaagactccatatc

SEQ ID NO: 247084 - DNA, 729 bp, Homo sapiens
tctgggaacttgcccttatcattgcttacatccctcccacctcccccactccaacacctcccctccagccaccagcagttcccagctgaccatccagccctcatcccaaacttcaccccacccaacaaagctcagtacagaccatcaggatggtgtatgggctttattttcctggtaaacacatttctgaccaatcattaccatttgctcttttgtgctaaacttcaaagtgacggaaccaaatgtaggtattcagcttgcccaagcttgggctggtttttctcagtcgtcttcacccctgtgtttgaaagggttcctggggtagttctcccagccacagctgcacaggggctcactggataactgcagattcaccttcactacctcctgggtggatgagcttgggtgagttagtggatgtcttggaagctcagttttctcgtcgaaaacagcggcctcaaggagctgcagtgaagatgcaggcagtggaggagcggagggcacgcagcatacacagcctcctagtaggtgcccaaggaatgcagccgctagcgtccaaggactgcagtgactaatcttggcatttagcctccagacaactggggaaatagcttttggcaaagtcacctgtgctgtccctttacagcaagtgtttcacatatcttgtggtggttcctcaacatcccttgagaattatttaccacagattaggttaaaatttggagagtt

SEQ ID NO: 247085 - DNA, 555 bp, Homo sapiens
gttttcatagaataaggagggatcactttggaatggtgggagatacaggtagagccagattatggaggccgtggatccagaaggctaattgacatcagtctagcaaataaaacctttagtaactcctttaggaaaagagtgacaaatcaaagtgctatagtatttaatgcttgagtgttaaatatttaacatcctgagtatgttttgtaggcaaagaggagagttacttgaagtgaactttggtttttttgagacagggtctggaatgtagtggcacaatcttggctcactgcagcctcaacctcctgggctcaagcagtcctaccacctcaggccctctcctccaccccagtagctgggactacataagattactacataagactaccatagattctgtcaccatgcccagctaatttttgtatttttagtagagatggggtttcaccacgtcgcccaggctggtcttgaactcctggactcaagggatccacctgcctcgccttcccaaggtgctgggataataggcatgagccaccacgcccagctataatt

SEQ ID NO: 247086 - DNA, 843 bp, Homo sapiens
agagagactgcctgtctccattgaatctttcagctaattcacctgcccaagcttaaagaaaactcctaattccttttgtagctttgtgagcatggggaatggtaagggaggctagtgacatctatactatcactaggccttcactgactcctggaaaatcactccataaagggtaattgatcataatcctaaggagtatagggggtaccgttgtgctgaacaatggggactttctattgctagttgacaaataattgttttcccacatctagccaccctgagaagacattaccatgctttcctgaggagcaataaatgctgagggtttttcttaaatctgccactttctaaagcaggggtgtccaatctcttggcttccctgggccacattggtagaaaaagaattgtcttgggccacacataaaatacactaacgataactgatgagctaaaaaacacacacacacacgcacacatacacacacacacacacaaaatctcataacgttcttaagaaagttgacgaactttgtgttggactgcattcagagccgtcctgggccacatgctgcctacgggccccaggttagacaagcttgttctaaagcatctgcagttcaacgtgtgtaaattgttccctaattagacatttgcctgttgataaacttagcaggcatggctaggcctgtcctaccccattcatgcttgttatctaggtctgtcctgctctgcattcatgcttgttacttatgttcaggtagctttatgtttcatttgtaaagatgaggggcttggggcacagtcttttgctggactaataatttgacagtgcttcagggctta

SEQ ID NO: 247087 - DNA, 374 bp, Homo sapiens
aaagtctggcagggagtgtccagcatggcccgtgtggctccccagggaatctttgatcttaacaaggtttgggtggtctcagcagggtggggaggagaagaaagcccactcagggtgctggtccaggggtcgcttctctgacagttccccccgctgttccctgggacgggggccttctggagtttgcagcaccctccctcggttagagacagccctgctctcaaagcctcagagccgggacaagcaacccaaattttatgggtggggaggctgggctaagatgggtgggaggacttgcccagggtcctgaacctggagggggcagaatcaggcctaggcctggatctcctgactcgaggtcccgtggctcacac

SEQ ID NO: 247088 - DNA, 420 bp, Homo sapiens
tctagggtcaacacatatatggggaaactgatggtagatatgggcttcttagtcttgaaagacttatgtagattcttttttggtgccatctcatcttgtgataaaatcattatcccccggccaggtgcggtggctcatgcctgtaatcccagaactttgggaggccgaggcaggtgtttgaggtcaggagtttgaggtcaccaggtcaggagttttgagatcggcctggccagcatgatgaaacctcatctctactaaaaatacaaaaattagccaagcatggtggtgcgcacctgtaatcccagctactcaggaggctcaggcaggagaattgcttgaacccagggggtggaggttgcagtgagccaagattgcgccactgcactccaacctaggcaacggagcaagactccgtctgaa

SEQ ID NO: 247089 - DNA, 533 bp, Homo sapiens
taggttgaacctaactaaatttgtcatcttggcaaatttatgcctaaccttatttcccatgttagcattattgcttctgtttagagatgcccctcattcataggactgttatgaacattaaatcaacaaaagtatgtgcagtgtttgcatggtgagctctgtatatcatatgctcaatgaaaggcaagcattactacccttagagttatttttatgattgttattgacctaattcaattgaattcaataatttttactgaatcccttccatggatggtgctggactagattacaagggtaacagggcagaattatctacccattacactgtaaacaattccaggggttctctaatatgaatgtcatgagtacttagcacagtccctgacacaataaacattcagcacactttggttgaattgaattaaacttaaggcacccatagtctaacatgggatatagtaacagttaacaatgaagaatgtgagaaatatcttaagagcttcgcaaagtgccatgagaataaaaaaaaa

SEQ ID NO: 247090 - DNA, 429 bp, Homo sapiens
cagtatctatctagtcctaccatgactgttggttacaaggaagctggtcaaagtgcggcctgattaatgcttaatcataaccatatttctgttcagaattcttgttaaccctgtgaagacagcttcaatgtcacagagctgcctgtaggaatgaacgccttacacttcagacctggccctcttcacctgccctttccatgctgccaacagggccttccagtggcagcggtgaccagtcactgggaaagcccagctgagtcaatgtttgctggctaactgcagaaggaatgatgaactggtccccatgaatggagaggtccaacacaaagctatgctaatttttcataagctctgcctgccgccttttatatatcaacctgaaatgtaattatctttatggctggtggagtaaatcaccagtatgtgtca

SEQ ID NO: 247091 - DNA, 483 bp, Homo sapiens
tatctctgtttctgtcttcatctcttattattatatctctcgtgatttctgcctttgcctttctgtctcctttttttcccccagttttcccaaatggtaaaaaccaggagttactaaacaacaaagggtaatcaatcccttaccatagagtagaaagcttttggggtttttgtttgttttacttttgaggtctacttatagatatgtaatttaaatataatcaaaagagaattttattaacagatgaatatcaatagcaatgaagtttatttgtagactcaccaaacaaaagtaacctccaaatggtatattgtacatgtaatgtttattcattaaattacaatttcatttttttcttcttttgaaactttctaataaaatcagcagtttattagtgatcattccctctttgctaaaagtctcatcttttttgttccatctgttccattataataaaattctgtttataatccttaaaaaaaa

SEQ ID NO: 247092 - DNA, 296 bp, Homo sapiens
ttgccaggagatgtggtatgttaaaatacaggagtccctggggaaagagctactaaagaatagtatgaatgttcctcttcgtcctaatcatcctatctccatcacatttgctgtatactcaccatgcaggccttatttaacaaagaccaattcctccatgtggctctagctctaaaacagccccggtattctgtctccattgatacaacagtgagaggagaatattggactatgatggtctctatattttcagctcttaatttctatgattttaataaagtgcataattacttaat

SEQ ID NO: 247093 - DNA, 382 bp, Homo sapiens
cacttcctcattaaactttcctcttcaagatgtagcgtctgttgatgattcttgcctaaataaagtttttactgtgttggttgtaaatacacgaaggtttttcttttcttttgcttaattaaaaaaactaattttcttcttttctttacttgggtacatacatacacatatacaccagggtttttaactgatttgtttctggatagttgggattgtgggagtttcgttttcttgttttttcttttccagtttttctgtaaggcatatgggctgctttttaaatcacaacaaataaaataaattttaaggaagaaaagtatagataagatagacagtagtatatgtataatattcctgtacagttttccaccgaaatgggatt

SEQ ID NO: 247094 - DNA, 372 bp, Homo sapiens
gtataactctttggaaaaggtgtggtttttgagactgaggtgtcaaggaggacatcctatttcctgaggattaatgaacttacatctttctttaacctttaaatataattatgtttgtcaattgttagacttttttaaggcttggtttccagtaattatggtatgtagtctccagtccaaacaacaggctctgtacagagaagttttattctatgttattttatctgaatcaagatcacactcaaccatctcaagagtccctactatagaagaggggtgtccaatcttttggcttcccagggccacattggaagaagacttgtcttgggccgcacataagatacgctaatactaacgattgctcatgagttt

SEQ ID NO: 247095 - DNA, 688 bp, Homo sapiens
tcaggacattctttcctttaccctaatccttgatcttcagtcttatttagaaaagcttaatgttaaagatctagtttattcaaaactaaagataacaaggagtatgagaatttctatttcggagtgtaaaggaggagatgtttccttggcttctctgagcctacaggccttccttgctctttaaggaagtagagagagggaggaaagtaaagtatgcttttgttttttaaggttactttgctgggagtagtttgcatcccttttggttttcttgggtggaattaactgacttaagttttaagtagttgggactatttagaaacaatgcctatccaatgtttgccataaaggcagagggtattggctttagaagttaattcttctccaggagtgaaaattagcttctaaaccagaagcagcagagctaaataaagtaattttccacctggccagtgcatgatgtgaaaggtagattaaaaaaatcagaggacccattttctgatgaaagactaagccatgttgaaacagccctgttgaggattttattttaaatctatacattcacaaaggagctttgtgtatgtctttccctatttgttgtttggactaggaagccccacccagtgcttgttgaaggcagaaagttgtggaaagcaagccgggatttgaacagtggattgaggtttcg

SEQ ID NO: 247096 - DNA, 591 bp, Homo sapiens
tgtcagagagaaaaattaaatgtatacaatttgagacttaacatattagtggtcaaatttattggtgatgaagaaacaaaatggaattgcatctccttgcttgctgagtgataatatgaatttcattcatgactatttacaatgcagaataggagaggtaactagtgaaagtaaagagagtaattattgtttggttcaagtgattcctacaatgcctttaactatggtaggcagaaaacatgaactgaattgaagttaaaactaatctaatcataaagtctgactcttaggaacagactcaagacattcatatgacaacagcagcctggacatttaaagaactcttgtttctatactcctcatccatgacctcattataacatctctctgacctggaatgtgtctgggctggtattttcatctctttatgttgggagacagaaaactagcaatgcttagaggatcagtaccttatagaatcacaatctcctgtgtgtaggaccaaggtttatgaggaagatggtgtcacttgataacatctgtgaaccacagattatacgctaagatttactcaacgtcattcagtccatc

SEQ ID NO: 247097 - DNA, 286 bp, Homo sapiens
atgtaaccaaatagaaagtatcaatagagcaatagaaattatgaaacagaagtaaaaattctgcactagaaaagtataataatggagtgaaaaaatgtagaaagacagctcagcagtagagttgaactggcagaagaaataattagcaaatttggagttagactgatagagattattcaatctgaataacgaagagaaaaatgaagaaagaaatgaacagagggcgtctgggaaatgtggacattattcatcacattagcataagcatagtgggagtactagaagg

SEQ ID NO: 247098 - DNA, 440 bp, Homo sapiens
agataaccaagaaaagaatgttgaatttatagacagcaattgtcctttttgtagaaaaatattgagctcctgtatttcaggttaaaatgcatgtcaatttttcagatgaagtaactgaacatatcaagtagtatctttaagtcatatagctggtagaagacttgaaactagaaaccagagctgaaatgaagtcaaaagttctcactttggtatggtttcatgtttctgaaaaaaaaaatcaagtcatacagtgcattaaaaaatttttctgatatctaagactatgatagaaatttcatatgtatatatgtgtgtgtgtataataaatcacttttttaatacctttgatatattaaatgcaaagcagaaattatttggaagatgaaatatataggaataaattataaaaagtaaaagcataaataaaaatgctgagatta

SEQ ID NO: 247099 - DNA, 782 bp, Homo sapiens
  misc_feature (636)..(636): n is a, c, g, or t
  misc_feature (743)..(743): n is a, c, g, or t
tgtggtggctcatgcctgtaatctcagcactttgggaagctgaggcgggcagatcaccaggtcaagagattgagaccatcctggtcaacacggtgaaaccccatctctaccaaaaatacaaaaaaaaaaaaaaaagtatttttttttactcttgaaacttttttgttaaagacacaaacacacacgctagcttaggcctaaagagtcaggatcatcaagatcattgttttccatctccatatcttgccacactggaaggtcttcaagggcaataacatatatggagctgtcatctcctatgataacaatgccttcttttagaatacttcctgaaggacctgcctgaggcagctttacagttaatattttcttcaaagtagagagtacactgtaggccaggcgcagtggctcatgcctgtaatcccagcactctgggaggccgaggcgggtggatcacctgaggtccagagttcgagaccagcctgatcaacatagtgaaaccccatctctactaaaaatacaaaagtagccaggtgtggtggtgcatgcctctaatcccagctacttgggaggctgagattacaggcacaagctactgcgcatggctatacctttattccataagcttttctattnttaaaatgtatttttttggcccggtgggggtggctcattgcctgtaatctcagcactttggggaagctgaggcgggcagatcaccaggtcaagagattgagaacatnctggtcaacaacgggaaaccccatcttttccaaaattcc

SEQ ID NO: 247100 - DNA, 647 bp, Homo sapiens
gattgcactgactgttgtaaactgaaataagcacaaaaatacttacatgaagtcagcatgtgctcaggtgaataccttatggattataatttgggtttcttctgcttttccaaaaaaaaaagcaggtcataaatgaatctttctctcctaggggaaaagtccagcatctaggggaaaagtccagcatctatgtctccttcctgattattcatatccaccagcatagagtaggaaaatgtgagtttacttgttaaattgatagtttgagagtgactgccaagttacaattatttactagacagggagcattctttaaggaagcaacactttccccagggaagccagatccttcccaaagctgttcattgttggactaccctgttacaaaagaatcacatatttcttctttctgtgttattaacaaattgataaatgaactcaaaagtcagagagtgataagacagaaatttcattaaaactggattagagcatttccttggacccaagaagaaaaatgtgcctctcattcttcctcctcttactcctcacttttcacccagtgaagggcaaagtcattgggcaaccagtgacacaagcgtttcacatcttaatctgcctattgcaagccaatagttttcattcttttg

SEQ ID NO: 247101 - DNA, 482 bp, Homo sapiens
gagtcagtctttgagtcactgaaagtgatacaagcagacagcagctggcttactgtgtgatgagagaggaaggtcccagcaccaccacgatggcatccctgccctcgaaaatggagactgagtagagccggtctagctccaatgatccgattataataactgcagggctgaaaacacgagttggtacactacacagcaaagcaaaccaccaaatccagagtgtgagaccttctacatggaaaatgatgcatttctccaataaagcagcaacaaagaaaaaaacagagaggagtcagggaccgtctcagagggagagagattgaagaggtagatggtcaaatgcagttggtgggctttgggcgctgctaagaaaccaactgcagaaaggcacctctgagacaatcagggaaatttgaacaggggctggtatcagattatatatttataattaaaatgttcatttaggaattaaagttgataat

SEQ ID NO: 247102 - DNA, 372 bp, Homo sapiens
aaaatccagatgagctcctgagttcacaggtcccgagtactataccctcccaccttgcctactccggtcaccacaccttgatcaccctgggctcctttcactttctcaaattggaagagcttttctcacctcggggccacacatgctgttccctgggcctgcaacgctcttcctccactgtgcgtggctggattcctatatactttggtctcagctcttctgtcatctctttgcagaaaccttctctggtggtctcattgggagcagccaccaagcacccgaagcccattttcctttttgccctttattaacaaccattaaaattgtgtatttatttattgcccattattcattaaatgtctttttgcctca

SEQ ID NO: 247103 - DNA, 483 bp, Homo sapiens
tgatttcccttcctgtgcaaggaagacataagtggcagaaccacatctcccgagtgtcacccagtgcagccttccacttccacctgcctagagccagggtaataatgagattctctgagagtcagaggaacattagtacaaagtatatcaataagatatattttagaggtgaggactctgaattatcacaaatgcatacagttttgtgtggtttgacccccagtttacagtgcaccccatagtcacttggatggcaaaattcaaacagtttcaaagtttatccttctcttttttttctctctctctttatataaagtaggtgaaacatctcgttaaatgatgttaaatctaagttccagtgccgtaagtccaaaggcagacctctgtgacccctagcagcctatagtttggccactctccgtgctccagtagtgtatttggggggtttcctttttttttcgagatagactctagctctgtcac

SEQ ID NO: 247104 - DNA, 880 bp, Homo sapiens
acaacaggtgttaagaggaagagaggagcaagcatatatatatggcactccaggaagatgaaggtgggattatagaagtgctgttagtaccagggacactggacaagaaagataagcaagccactgctgtctgattcctacatagcaggttaaagtgttggattcataattctcacttcaggaagactgaaaaccagactttattctgctagatcccaagatatcaaggaagaggaaaagggaagagccccaggcactattaaaccacagctacaatcactgccatttgaaacttcccaccaaacaactttactattctgatttaatttcaactcccagggagagttagtattaagaggaagtacctatcatccatgataatccaccagctctgggggtttagaagggaaaggatggaggtctcagtgcttgaggctaggctgacagctgagcagggctccagctcaccttaatctcactcctgtggatgcctgcactaggggcctgagcattctcccagatctctgcataggaggctgcccttaggcattattaaggtgtgaaagcagcaagaaagagcagaattaaactgcttttctctaatgtatccttttacagcccagtgtattttgccctaggctagccttttcttctcctttcaccctccacatgccagtccgagacagcctttcttctcacaggaattattgtattatttcttaaattctttttttcttctccatggcttttctagaggaaacctaacagtgtgggtttatcaatcattttgacaagactctgaattccactgaacagatttttgaataaaaattatgaacaaagaaagtgtagtaaatctgctaatagaaaaactgactat

SEQ ID NO: 247105 - DNA, 533 bp, Homo sapiens
cagataaaagaagtatcctgtgaaaggcacactgtaaacccccacactcagctcccctttatttcctgttagggcagggttgttggctgctctggtactagaacaccagtttaactgggggctctcagaaaaatactactcaggaataaaatggaacaaactaaggaaacacgcaaaaacatggatgagtctcaaaaacctgctgagtaaaagaagatagacatgatcaagtacataccgtatgattctatttatatgaggttctagaacagacaaagctaacctatagtgatggaaatccgatcaaataacaatgcctgtgatggtggtggcagagggattgattggctttaaaggagcatgaggaactttctagggtgatgaaaatgttctaaatatcattggggtggtgatgacacaggtgtgtacattagtcaaaattcactgaactgtacacttaaaatgtatacattttgttgtatgtaaatcatgtcttaataaaatttatttttaaaatttattattattattat

SEQ ID NO: 247106 - DNA, 466 bp, Homo sapiens
tatttatttatttatttatttatttatttatttttgagatggagtttcaatcttgttgcccaggctggaagtcagattccgtctcaataatcatcatcatcatcatcatcatcatgatgtcagagacaaggtcttgctttgtcatccagcctacagtgcagtggcaagatcatagctcactgcagcctggaactcctgggttcaagccatcctcccaccttagcctcctgagtagctgggactataggtgcacaccaccatgcctggctaattattttttgtagagacagggtccactatgttgcccaactgatctcgaactcctggtctcaagtgatcctcccacctcggccccccaaagcactgggattacaggtgcatgtgaccacaccccacctacctctgagactttccatccactttttctttctggcggaaatgaatgcccgggggcaaacttgccgac

SEQ ID NO: 247107 - DNA, 623 bp, Homo sapiens
gggagagaatgccacggcaatgtgaaggcagagactgggttgatgcatatataagccaaggaatgccagattgccagcaaacctccagaagccaggagagaaacatggaacagactctcgcacagccctcacaaggaatcaaccttgcagacaccttgattttggacttccaacctccagaaatacattgctgtttaagcctctcagtttgtgatactttgttatggcagccccaggacactgatcatacttttttttaggttgccaggacaccattgatctgctcctcctcctcctctaaatgttggcctcaatccacccacatgcctctctaacctgggtgatctcatctcattccatggaattaaatgccatctgaatgctatgacttccatatctaaacttccagactgacttcccttgggcttcagattccattctattatttctccacttagatttctatcacacgtctcaaacttatcacaatcagtagtcttgattcagctctactgaacctacctccccactcccagtaattcctccagaggactctttgcctacattctgaggctccacactgaggagtcaacctcaactcccctttccctcgattccatatg

SEQ ID NO: 247108 - DNA, 353 bp, Homo sapiens
gagccagtggttgaaatgtagctttcttgacaatgatcttgaatcttaatatagtaatgttttctttatctgatagtcagaatatgaactattccatgcaagccaattctctcaataactgaagcttgtatctccatgatattcaaaaacataattttactggatttgatacaaatgtcttatgaatatatatatatgattaaagaaaaatgttcaatctgacctttccctgatgactctcgatcattattataagtattattgctttattttgctttaatatcaaatgccgtcagagacttactgaaatttatgacgttgtttcactctaaataaaaatgaaataatattta

SEQ ID NO: 247109 - DNA, 382 bp, Homo sapiens
cactttctcctccttgaaataatacattattcatttggcttcttttttcttccccccaaatgttggcttttaattttgcttgttttgtttcatgtctgtaacagtgggtacctgggatttgattttgcccattctttactcccctatcactttcttttcatccaagaaagcctgatttggataatcagtgtaagtcaaagtgttcaaactgagtgtatagtttgtcaagtaaatttcaactcttacagtctgaaatgttacaaagttaggctgtagtacatgtttggcatctcatttttcatcatacttaatttgtcactgcattcgatagaggaaagcagaacaaataagttttcactaaccaaccacatgacagagattt

SEQ ID NO: 247110 - DNA, 465 bp, Homo sapiens
tagtgtacacttatagtatagctggaaattgggtagtatgacgcctctctggctttattatttttgctcagaattgctttggccattctggcttttgggggtgttccatataaatttagaatagttttttctaattctgtgaagaatgatgttggtagtttcatggagatagccttgaatctacaagttgctttgggcagtgtggccattttaacaatattgattcttttaatctgtaaacatggaatgttattccatttatttgtgttatcaaaatctccttcctcccttccatccttccttccttttcttatttccttccttttttgagacagagtctcaccctttcacccaggctggaatgcagtggagtcattatagctcactgcaggcttgaactcctggcctcaagccgtcagggtagttaggactacaggcatgtgccaccatgcctcgctatttaaa

SEQ ID NO: 247111 - DNA, 483 bp, Homo sapiens
ctctgttgtccagcctggagtgcagtgacttcatctgagctcactctagccttgacctcctgggctcaagccatcctcccacctcagctgggactcttgccatcacacctggccagcttttaaaaaacaattttatgtagagatagggtcttgctgtgttgccaggttggtcttgaactcttgggttcaaggaatcctcctacctcagctattgtaatttttaaatttaggaattttcagtcattttattgcctttgaaactgtataggaagttatttttcagacatcagcatttttgtagcaaacaaaattattttgttatatcacaatgtttaagaatatttattatcatcttaggttagaattaaaatagcatatttttaggaaagttctttttgtctgacagtttagagcagatccaaatatgaaatgtgagtaataatataattcttatacagttattttggagtaaatatatttgtg

SEQ ID NO: 247112 - DNA, 425 bp, Homo sapiens
gtcgtttttctgcccctgccccgtggccggagccgcaggcctgccgctacccccacccgggccacgccttccttcctcgcggccggaccgcgccagagtcccgggccctggctggaaactcgcaggccccgggcagccggggccgcaagtgcgatgaagaagcggggcccggcgcgcacatgtggttccgggcaggagccccggccgcctcgtgcccttcttctcgcccacgacggtggccggcggcggcctctgcttcccggacccatgaacaaagctggagatgcggctttggagtcggccctgggacctgcttcttctcttggcttcggggaccgcagcccagggcgttccctccggatcggtggccagggcttgcggggcgtgtgcgactcgggacccccagccgggcagcagcggccgcc

SEQ ID NO: 247113 - DNA, 318 bp, Homo sapiens
cacacttctgcaagcagagactaattataagctgcaccactcagacctgggcaagcagaaaccaaggagaaaacatttgatatcagcaaattctttattattattattattattattattattctcattccatttttgctccttcctttcctactcaagatatttgaggcatgagcaatctgtgactctaattaagggggtgacagccccaaccaggccaccatgcaggcttataatccactcatacacccagctttctccataatggctttattcttttcctccaaggttcaaaatcaccatgacttctcccccaca

SEQ ID NO: 247114 - DNA, 744 bp, Homo sapiens
ttgaacattctgtacatgtgttcatagagtatatactttctgctgtctagcttctttagctttacgtagaatgtgagggataggtatgattacattagtcgctcattttcttttattgccgatagtattccattgtataaatgtacagagtttgctcatcttttgtactgttgataaacatttgggggctaccaacttttttgttcacaagtctttaactgaatgtctttctcgtgggtaaacacttaggagtaggaatactaggacctagagtgttaactatattggaaattattcaaagggtttagcattttgcagtcctgccaacaatgtatgaaggttccagttgctctgcctcctcctcattatgccatattgtcattcttctcatttttatccattttcctgagaattaatgatgctgagcatctctctatggttagcaccctatggttagcatatcttgattgtgaagtgtacttttcatgatagttttctctcatgtttaattagagtgtctgattttatttattgatttgtgtagattgtttttattctgatattagtccctttttggatatatgtattgcaagtaattttctcccaatctgtagcatgtgctttcactttcttaataggctctttgggtttgttttgatgttgatgagagttttattatggataggttttgtttgtcaaattttgtttctctacttattaaaataaatatttgcttatgaccta

SEQ ID NO: 247115 - DNA, 376 bp, Homo sapiens
atggctgaattgaatagatattaaatttaaatgataaagatgtcttctggctttgattccttgtggttgataaatggctcaaagtgcaatggaaaatgaggtaaaaaagggagtaaaaaaagaatgagatccagtcatttgcaacatgaatggaactgaagattattatgttaagtgaaataagcctgtcacagaatggcaaacatcacatattcttccacttatttgtgggatctaaaaatcgaaacagtagaactcatggacatagatagtagaaggatggttaccagaggctgttaagtgtcatggggggctgtgagggagaggtgaggatggttaatggttacaaaaatagacagaatgaataagatccact

SEQ ID NO: 247116 - DNA, 454 bp, Homo sapiens
agcagtgtgttttaacaagcactccagacattttgatgcattctacagtttgagaacgtctacactgtaagagccccagccatcaccacctaccagaaggcttctatagctaatcatttgtcccctctcccacctccacccacaacacacataccatacatgctcacacagctaggttgttggtgtccttccaaacttgcatccaccagagtgtgcaccacattttttgtgttattatttctttatgtatgtacctcttctataaccgtataaactcatccaaaacatcaatgatggggtaccctttttttccatttcttgaatttagcatagtgacaggcaaaaacaggtactcagtaaacaccaaatgaattagagatacattgacatttgtgtatctgatgtatttatttgtatcataccttcttcaaataaatgaagtcttacataagta

SEQ ID NO: 247117 - DNA, 464 bp, Homo sapiens
caggcttttcgttattttcttattttctgggcacattcaagttcacttatcagatggaggtcattcagtcaacaaataattgtggagcccctgtgccatgccaggcttgggggacttgctgatgagctggattggggttggggagacagagtgacagaaagagaagaaccaggggtgactcctgcatttgacttgggcaactgggtaaataggtggtgtgtttcccaagatggggtgacttggagaggacatttatcaagcaacaatgaatttcctgtctactttactcatcactaacatagatgactgccaggcagtgcctttgatcagtgtgacggcactgagctgatgggactccagagaaaagcgaagatactggcattttgttgcagccctgttgtggctggctgcataataatttccaggaggctttcggaaatgttaaaaatagttcatgaccaaaa

SEQ ID NO: 247118 - DNA, 342 bp, Homo sapiens
aattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttc

SEQ ID NO: 247119 - DNA, 521 bp, Homo sapiens
atttgacaactagggagcaatgccagcattattttctcttttgtagtatgccaaatatatttaaaaatataagccataattttaatacctaaagtaactgttagactgtgcattttcttattttagtaatagtaatttctgtttgtggtgaatatgagttttatttttaagtgtcctaaatgtttaataagagtcaagcctgagggagaaatcagtctggtagtttgtaattattaagatacagcagttataggccaggcacggggctcgcatctataatcccagcactttgggaggccagagcgggtggatcacagggtcaggagatcaagaccatcctggccaacatggtgaaaccccgtctctactgaaaatacaaaaattagctgggcgtggtggcacacacctctactcgggaggctgaggcaagaggatggcttgaacctgggagacagaggttgcagtgagccgagatcacaccattgcacttcagcctggtgacaagagcgagactccatctc

SEQ ID NO: 247120 - DNA, 1977 bp, Homo sapiens
agtttcctcttggcctgaacttggctgacctccgcagcttccgcccgactctggctaaagtcttggaggctactgccttgaagatgacctctagggaccagcccagacccaagggcccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggc

SEQ ID NO: 247121 - DNA, 1891 bp, Homo sapiens
ggcacgagggaacttggctgacctccgcagcttccgcccggtgagggacccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggc

SEQ ID NO: 247122 - DNA, 648 bp, Homo sapiens
gactccgtcttaaacaaacaaacaaactagccaggcacggtgccacatgcctgtagtcccagctactcaggaggctgagacaggaggattgcttgaacccgggacgcagaggttgtagtgatccaagatcgcgccactgcactctagcctgggcaacagagcaggactccgtctcaaacaaacaaactagccaggcacggtgccacatgcctgtagtcccagctacttgggaggctgagacaggaggattgcttgagcccagaagatggaggctgcagtgagccatgatcacaccactacactctagcctgggagacagagtgagaccctgtcttttaaaacagaaaggaaaccttaaacctcagaatccctctgatctatcagagtggcctgcaccatcaaatccacagatcaagaggaggccgggaggaagacgagccgcgcatatgggggtaacaggccaagagttggggaatgacattctccctcagttacctgaagctaaacccctttgtctgccccattgtcagccttgctgagacggcatcatacccagggcgtcgtggctagacaccaggcctgtgaggtgcacggccagctccacccacgggcttactgcagtgtgtcccggctccatcccgatggcca

SEQ ID NO: 247123 - DNA, 1048 bp, Homo sapiens
gcttgacagtttaagaagccaaatgcagaagcagctgtcggctgattggtgtagctaagataactcaaaaatcatatcccaaaagcgctttgtggtgtgagcaggacagatgtgctgcctaccttcgggagtccttcagtccttcagggacttggacaagaagcaaagcaatgagtgtcagatctgtgacagaatcccactgaacaaggggaaaggggactggaggaggtgacccctctctcaaaaggtgacctttgagcagagacctgagttccgtgacggaagccatggcgcgtgttgaggcagaggacagagccagtgggtgggggagagcggagtgggggctctgtggtggaccgcgtccgttccagcccacgttgggaggagtgtgagcttgttgcaaccttcttaaaatgtgggctactggagatcatgccactgcactccagcctgggcgacgagcgagactccgtctaaaaaaaaaaaaaaatgtgggccactcagacggtctagggcgacggcctaggtgttagtcggaaaggaattttaaatgtatgtgactattttcaatttcttcctgagactgcagtggaggaaaatgtgttgtgggatgagccttcctccctgctggagtcaaaaccacaccagcgcagcgtccttgccttgactgctctgtaagaggcttcttgcccttcagaacacgccgctcgcttaggtgtcactgagagcgatttttctcttctctactgaggaatgctttgcataataactgaaagtattttattagaatcctaaagtgtagcagcagcaatgattgaaatctacatttcaattatttttcttaagtgtaactaaaaaatctgatgtttaagtgaaagtaaattatttgtctaatttccatcagggactttttgaaagtcacagaaaatgtggttagtagaattcatgaatctccacttcatcaaggcagtttcctagaagataaaaggggttgaaagccattcccaaggccatatcccagatagtactcatcggggatcctctaacg

SEQ ID NO: 247124 - DNA, 263 bp, Homo sapiens
tagcagcagaaactttaatgtagggttaatatatttgagaggtcattcttaagaaaagtctaggcaataggccctcaggtagtgaattattctgtaggattcattgttttttgtttcattttgttttgttttgttcttttttcatttttctatttttctccataggattcttgataggtttcaatcacacaccttcccatgggtatttccatgggcaacccaccccttctcttcagcagtaaactaacaactacataccagtg

SEQ ID NO: 247125 - DNA, 647 bp, Homo sapiens
caatcttcccccatattatacatgcacagagacatacacccacttttaaaaaagtcagttgcaggcatcattaccctttacccctaaatacttcggcatgtctcttcaacgtaactgcatggcatatcacacccaggaatttaggtctatgcactgatgctatctaaatactgtccaggtacaggttttcccagttgtccccaaaatatctttcagagctactcccccaaatgccatccaggatccagcctgaaatcacaggcagcctttggttttcatgtctcttaagtctccttttaatctagaataatccctttgcttttttgttttcttcatgatattgactttgttgacaagtccaagccagcgtctcatagaagttccacagtctggaattgcctggttatttcctcccaatgagctgccagtgttcggccaggtgctgtggggctgggggtcaggggagccctacacctcccacagcagtcctcggggaggaagaagagcagctggccccgtcctgatcacttggttagggtagcgtcggctggatctctccttctaaaggtgctggtttccctttgtgattactcagtcacctttgggtgattcttggagactgtgtgaatatccagttcctccacaaa

SEQ ID NO: 247126 - DNA, 207 bp, Homo sapiens
gccattaattttatgattgttcctgagttcccaagtcagattctaagtcaccagtttccatttatttctgccactctaaaactaaagaaataggccaggcgcggtggctcatgcctgtaatccaagcactttcagaggccgaggtgggcggatcatgaggttaggagactgacaccagcctggccagcatggtgaaagcccgtctct

SEQ ID NO: 247127 - DNA, 737 bp, Homo sapiens
cccccgccgggctcgctgcctcgggagccccgggagctccggtgagccccgcggaggagggaggggaaagggagggaagaggaggtggtggaggccgcgcccggccggcgggcagctccgggtcctctgtgcgcaggagaagcggcggctgcaggaggagatccgcgccgcgcgccgggaggtggaggaggagaaactccgcgtggagcgtctcaagaggaagtctctccgggaacgttggctaatggatggggcagctgcagtgccagagccatccgaagaccccacctcgaaggacccccagtcacccgagggccaggctcaggcccgaatccggaacctggaagacagtttgttcacactccagtcccagctgcaactgttgcaaagtgcttccacaggtgcccagcacaagccctcaggcaggcccagctggcgcagacagggtcaccgtcctctctcccagtccattgtcgaggcaggttctgtaggccagactgatctgaacaagagagcctccctgccggctggactagtgggcacgcctccagagtccccctctgagcccagggaggatgtcttggggtttctgccaggcccgaggcaggtccccggggcagcaggagactcctcagaagccaatggcccatgccccagccccatccccactccagagcaggggctaagtcagagggcagtgccatccgaagggcgggtgggtgaggccaaaggagggg

SEQ ID NO: 247128 - DNA, 623 bp, Homo sapiens
aggtggtgataagatacctgcccagcctgcagaggtcgggaggggactttacatggaccggggtagtctgtatgcccagccccaactcccttcccctgcccagaggaagtctctccgggaacgttggctaatggatggggcagctgcagtgccagagccatccgaagaccccacctcgaaggacccccagtcacccgagggccaggctcaggcccgaatccggaacctggaagacagtttgttcacactccagtcccagctgcaactgttgcaaagtgcttccacaggtgcccagcacaagccctcaggcaggcccagctggcgcagacagggtcaccgtcctctctcccagtccattgtcgaggcaggttctgtaggccagactgatctgaacaagagagcctccctgccggctggactagtgggcacgcctccagagtccccctctgagcccagggaggatgtcttggggtttctgccaggcccgaggcaggtccccggggcagcaggagactcctcagaagccaatggcccatgccccagccccatccccactccagagcaggggctaagtcagagggcagtgccatccgaagggcgggtgggtgaggccaaaggagggg

SEQ ID NO: 247129 - DNA, 340 bp, Homo sapiens
gagtgagctctcaatccattcatgattgcaagagctggtttttaaaaagagcctggcatcccctctcccctttgattcttctctcaccaggtgatctctgcacatccctgctcccctttgccttctgccatgaagccctcaccagatgcagatgcccaatcttcctgaacttttcagccatcagaatcataagtcaaataaagattttttttttttttgaatataggccgggtgcagtggctcacttctgtaatcctagcactttgggagcctgaggtgggtggatcacgaggtcaggagatccagaccatcctggctaacacggtgaaaccctatctct

SEQ ID NO: 247130 - DNA, 492 bp, Homo sapiens
atggtggataacttataagcaaataattaaagatctacaaaagtaaattcattgattgattgaattgggttgtgcacaaaaaaggaaaataaaagaatttaagggtgttttcctgactttcctgatggatgaccttgctaaaaattccaggcgacgctggtatccagagagggttctgtgtgaaaagagattccatgagacaaatggaagaacaaggagaggcgaaaggaacaatagaggtctttcagaagcaggtcaacaaacattgatgcagcattttctttgtgcgtgttgaagtaacaatgagcctcagaacttctaataagcagcataattgccatgtggagaaggctacattatacaacaccaatttctctctgaagatccaccacctccggatgaatgttactgattcctactgtctatttcatagatcttcaactcttgttcttttgtttaaagatatgagtctaagcttagacataaaaaaaa

SEQ ID NO: 247131 - DNA, 532 bp, Homo sapiens
tctctgaaatttcctccactcacacttagttttcacctggcacagaggagctggggaaatctattagctgactggaggaacgcctgcagcattctaattatcaggggagccagcgcacttcacacagtcctctcttccacttgactggctttcatctgatccaccaactcacgagtaatactaaaccaaatttccctccagattgcacaagctctaatgtgaaaatgagcactccacctggcctacaattatggaatgggtttgcaattttattattatcctctttaaaaaaaaaaaaaaaacactccaaaaggcagaaaaaaactaagcctgacgttcagtaatgacatctgctttaataagagaattgagtaagatatatgttctctgactcatgaaccctcactagcctctctcttgagttttttactgcttcacttattatttttggcgtttcacgggttcaagaccatgccacaatcacaataatgccatcagtggagaaattatttgtcacctctcttcattcaag

SEQ ID NO: 247132 - DNA, 488 bp, Homo sapiens
cacattatcacccgaaatccatagtttatacggttggtgctgtacatctatggatttgcacaaatgtataatttatccaccattataataacatagattcactgccctaaaattcctctgtgctctgcttattcatcctttcctccccactaagccactataaaggttaatgacaatcactaacctttttactgtctccatattttgccttttctagaatgtcatgaagttggaatcataccgtatgtagccttttcagactggcttctttcacttagaaatatgcatttaagtttcctctgtttttttttttttcttttgagtgctgaataatcttttttcatgatgtactaccattaatttattcacctattgaaagacatcttggttgttgccaaactttggcaattgtgaataaagctgctataaatatccatgtgcggtttacatatggccattagttttcaactcctttggataaataccaa

SEQ ID NO: 247133 - DNA, 560 bp, Homo sapiens
atgggtgagtgtgtttctcacaaatgcaccactgcacccctgcctaggtgacagagacagactgtgtctcaaaaaaatgaaaatatcagggaactcaatgcaaaagactgcggcgctttagacttgagagtaacctgcccatgacccttggggctccgtgaggaagacaaaagacccccaaaaggagggtgtatggcacctttttctggtttctcaaggggtctcaggactgctagaagttccctctcgatttcttcgtgtgttattgaaggtggcagaaaggaagaagggccaacagtaaatgggaaaacaattcttagagggctcaatttgggaagattttaaacttcccaaaaaggccaaggatgttttacatttttctcagtaaaaatcatgccgacaacaacaacaacaaaaaagtgaacagatggaaggaacataaaattgctttttaacaaaatttcagttgactgaaaagaattcccagggtaggaacaggatccaaagagaaaaagcattgctctatatatctgccagggaaaaatcccccaaaaactaaa

SEQ ID NO: 247134 - DNA, 329 bp, Homo sapiens
tgtttcctaaaaatgaaaagtttgagtttcatgtagtgagagaactaagtccattggccagtcagatgtttctcacccttcttactctggactttgagttgttccaggatcacttttgaataaggagcttacttttgttaaaacttgctgccttactaaagattataagttatagtttaaatttgtaattaattctgccatcttgcaataaagtgacaattgaaacaaggttttccaagttgcataattttatgaagtactattcaacttttgtcatgtgggtgaaagttaaagatgccattgaactacaaaacaaacaaacaaacaaa

SEQ ID NO: 247135 - DNA, 718 bp, Homo sapiens
cagtgatacaatcatggcttactgcagccttgaactcctgggctcaagcaatccttctgccttagtccctccagagtagccgagactacaggtgcaggccaccatacctggctaatgttttttttttaattttagtacagacgaggtcttgctatgttgcccggactggtcttgaactcctgggctcaaacagtccttctgcctcggcctcccaacaagaaagctttcagtccagtatttccagtccttagtcatctgtggattccctccatgtttttgaccatttccattttttatacttttgattttaaaataatgttagattcacaggaagttaaaaaatagtatggatttctggtctcccctcccacattgcccccgtgataacatctaacataactgtagcacattgtcaaaaccaggaaactggcattggtacaataggattacctgaactgtaggccttgtttggatttcctccatttttacctgcattgatgtttttgttgtgcatacagttctgtgcagttgtatcacatgtacagatttgcataaccgctactgcacctccatttaaactaatcacttgtttaaatcaactcaccttttaaaaaattaaatagccgcttttgcctcatcctaagtgatatccttgaaattattgatttgatgtacttatatttctaatacacattaaatacacaatgatttaaacatg

SEQ ID NO: 247136 - DNA, 420 bp, Homo sapiens
aagagttaatttcagagtacatgataagagggagttatacagcttatctgtaacatgcagatcaagaaaaggcattgactatttaaagcaagacatattaatgtatttgtctctttataaccaggcaaagatgtggcatggcatcacttaagcatacgggtatttgagaaccatgaatccaaaccccatcccacctcattccacctgcacgctagagcagcattgccatgatgagaacattgctgggggaaaatgtaagtgatgggggaaatccattaagcaaggccactcatggaacgtttactggggattcttctgaaaaacatgtttacatcaaatctgaaggtgaagagagaggaacaagaaaaggggagagcaacgtgaagatggaataagccagagcgtatgtagacatgttcg

SEQ ID NO: 247137 - DNA, 684 bp, Homo sapiens
tttcattcactgttatgggaagaacagatggtgaaagggttagattaaagtaatacagcatgtccattaaaataacccccacttctcgggatgcttccctcaaacaggagtactgtttactataaagaatggctttggcttacacacattggaaattgccaggagttttctcaaggataaacacaggagtaagagaaaaactaatgtcagaatcaaatgtatttttaaatgacaataatgcaacttattttgctaatctgagaggctgatggaaactatgtgcctgtgataacgtagctgaacagcagtcaaataataaagttcatttctaacttgaaaaattttagtacctagaaaatacaactaaataaagctgcaaagagaatatcaagtagaaattattttctacattcctgcactcctacaaataatagaaatttttgctgccatttcatttctaatttatcttattaataaacagcaaaaataaatctatataatacatattaataaaaactaagtataatatgatttctagacaagtctcacaaatttttagcattggaaaagaaccctcctgagatatgtttatgaaatttaattcaattacatacagttcctaaagaattaagctttaaaaaaaacttcaagaaaagttggagaatatattctaaaagaaaaatt

SEQ ID NO: 247138 - DNA, 287 bp, Homo sapiens
ccttattttaatccttaggagaaaaactataatttttctctaatatatccataaagtgaaagaagaagtacttatttgatattcttaattgttacatatttaagagcaagagtaattagttcatacttatgttcacctaagtccacccatacattgctgaggatagcggccttcagaaggtggctgtttccggaggagtaacagggaggaacaggtgggctgagatatacatgaggcccaggacattccagcctgggcaacaagaacgaaacgccatctcaattaaa

SEQ ID NO: 247139 - DNA, 521 bp, Homo sapiens
ggcggggctgtccaggaccctcgctccgcacccattttgatcccaggaagggcggtcgggcagggacggagacggccgcgaccagacaatgtcctgcattcaccgcggcctcggccaatcacaggccggcgcctcccggccccgtgcggcgccaccggccactgctccggccggaggaaaacctggctctagtcggccatctgcggctaatccagtcagagcgcgcggcgctcccacggcgcccggcccggggaaggggtctgggcagcaggcgccgcggcgtaccccgggggcagggtcgcgaactgagggcaggacgcgccgccccctccgcccgaacgcggcgctgtccctttaagatgatcctcctcccggggccaagcagcgcgttggcggccccgccgcagggggcagcgacatccgggctaccggactggcgacggcggcggcccctcgggcagctcccagtccccgcgggatgcccggctcaccgccgccggagaagaggagccctccaggcc

SEQ ID NO: 247140 - DNA, 471 bp, Homo sapiens
gatggaaaaataagaatgggttattagctggcagaaatgatgacagatttgagtgcttactgtaggtcagctgctttacatatgttacctgattttaatctgaggtaggaactattactcttcttcaggtgggaaaactcaggaccatagaggttaaatacctcatgcacagtaactactaagaagtggaagaaccagattaaaatccagtctatttatgcttagagcctgcccgcttaactactatgcggtgttgtctcagatgtagaacacatctttgttttctctgaggacttagaaaaaacacgcgtgattcttctccactgaatataggaatagtttctaccctgtttagaacatgcatagtctttatcaataagtgttaactgacatgtgaaatcactttctactctttggaagccgatgttttaagtccaagtagtctgtatggtggaaattcctaacttatgt

SEQ ID NO: 247141 - DNA, 107 bp, Homo sapiens
ttttttttttaacttcttagaataacccattcatttttggtgtgctatcaccaggtggcaggaagataatcatagaaaagtgaggctaaggtaaaaagcatacattc

SEQ ID NO: 247142 - DNA, 345 bp, Homo sapiens
cattgttttatactctgctttttttttcactgaatggaaatttttgcataaatattttgctatgtttttgaataccctgccacacatcattttaatggccacatctgaaagtggctgcactatgggttaatttcactagtctctgattttcagacatttgtttccagttttttgttgctattcatatacacagctctaccatgaactccgtggcaacagaatctttgcacatatctctgattgtttctttagaataaacccccacaagggagaactgtagggccacatggtatgtacattcttaagactcctcccgcctgtccttccagaaccgttgaattaatt

SEQ ID NO: 247143 - DNA, 261 bp, Homo sapiens
cctggctttaagagatcctcccgtgttgtcctcctaaagtgttgggatttcaggcgtgagccaccatgcctggcctattttttatttagtgagcatttgttctgaattactgcaggctgcagtgacttattagaaatttatctacttacataattttgatgagatacagaagaatttttaaaaattaaatttaattaattttttttgagatcatgccattgcactccaaagtgggtgccagagcaagtctctcaggaaagg

SEQ ID NO: 247144 - DNA, 310 bp, Homo sapiens
tttgtatacaaaatttggggtgtacacttttctagggggaaactacagctttcatgagtttctccaaggggtcaaggatcctaaaattttttgaagatctgctcattagagctcttgctgcaaaatattgtttaggaaattcgcttggactatcatggctgtgtctctgtgtgtgaaaacagaaaccttaccaagtgattgttctttcttgaagatttttataccatgatcttgaatgctaaaacactcagattcaaggggtattatttgttttcttataaagaaatcagcaggaagctgctaccagaca

SEQ ID NO: 247145 - DNA, 312 bp, Homo sapiens
tcaaaatatcagattttaaatgcaatctataaaaccgataaagactttggaataaggcgaggaataaatatatttaaaacaagtgggtacagtgaacacagtaagaagagacaaatgataataaggaaatagacaactgtgaaaatgtatgtaaggtataatagagacaggcatagtagcttgcacctgtggtcccagctactccagaggctgaggtgggaggattgcttgagcccaggagtccgaggctacagtgagctatgtcgtgtcattgcactctagcctgggtgactgagcgagaccccatctcta

SEQ ID NO: 247146 - DNA, 424 bp, Homo sapiens
gaatctgggtatgtaacagtctgaataattgaagcagaaggaaagtaaatttgtttggagtcttcagccttgtaattggcaggaattttcatttttatcagtgccatttcaaactaaaacagttccgtctttctccctaaaatttataatgtgttcttcagtatttcttttgtgctgttcaaatatttgcttattctttttctagagtgttgtccagtagaactttctgctatggtggaaatgttcatactctttaccatctacatggtacccattggccacacgtggctaccaagcacttgaaatatggcttatgagtcttcaggaacagaatttttcatttaatttttaatagccagatgtgactagtggctaccatattggaaaacacagatgtagagcattctcattgaaactcaccttt

SEQ ID NO: 247147 - DNA, 284 bp, Homo sapiens
gtggaggttgcagtgagccgagactgcaccactgtactccagcctgggcgacagggcaagactccatctcaaaaaaaaaagattacaataccatatttttctgtacctacctttttctatatttagatagataaatattatttgttacaatcacctacagtactcagtacacactgtacaggtttgtagctgagaagcaacagcctcaacctaccatattgcctaggtgtgcagtaggttacaccatcttggtttgggtaagtacctacgtctatgatgttcac

SEQ ID NO: 247148 - DNA, 372 bp, Homo sapiens
gaaatacttagattttgcacaagttcttattagataattttctattcatgtttatgcctaattcaagaattggctatcggctgggtgcaatgggtcacacctctaatccaagcacgttgtgggggctgaggtgggaggatggcttgagcccaggagtacaagaccagtatgggcaacatagtgagaaccttttctacaaaaaattaaaaagcaattagctgggcatagtggtacatgtctgcagtcccagctacttaggaggctgaggcaggaggatggcttgaacctaggaggtccatgctgcagtgagctgtgatggtgttactgtacttgagcctgggagacaaagtaagaccctgtctcaaaaaaaaa

SEQ ID NO: 247149 - DNA, 451 bp, Homo sapiens
tttcaatctgtcaaagagtggcacagaatacacacacaaacacacacacacacacacacacacagagcaatagaaatttgctctgtaatttgggagttgcattgcttgttgccttttgtgaaattttcataacagtgttttggtaattaatgacagcttttggcagtttaattctatcattttactaatttagatttatctattacattgaaaaaattcaatataacttttgaatgataaacattcaaagcaaatcttagatgactgtttatgtcatgagtttatgcttccaatatggacccaagcccctctttaagcagacttctaggtcttaagtgaggaaagatgtcattgtgttctactgccttgtcatttctatataatgtagtatcttgagatctaatttcaggcatattggcaagaagatacagacataatggaaagttggagc

SEQ ID NO: 247150 - DNA, 498 bp, Homo sapiens
atatgtatgtatacacatatataactattatctgtatctatattgaggtaaacatgagttcatactgatgactttgactatcagtactatatagttcattctggctttactctgctatctattacctccctctccaaaagtgagaaatctggctcacgccatctgacatctattaacttatttgttcagtcccatcgtccatgtacagcacttttagaattgttaacctgtatctccatgagaaatgcctttaccaaaaaagaacagtgcttatatacagttctttttgttgttagagtttccagtttcaagtttcccaaagttacttaaatcaaaccttttcccctgacatctgtattttaattttatttttaataaattgatctaaattacatggtaattatatataaagcttataaaaaatttcccttgcccaactaaagatctttagctttagatgtgtttttttttcctcctgacttttgtgaccaaaaaaaa

SEQ ID NO: 247151 - DNA, 349 bp, Homo sapiens
gcaagatgcatgtagtgattttatttcaacagcaccaacagtggtggaaggcaggctggggagaggaggagatgaggcatcttgagctgctgagaggttcacagaggctgtcagccttctgtcctaggccacgctgaaagggctgggcgtgacagccaagctgacctgctcatctggagttcccatgggcaagtctgaaagcatttccaacccacagctatgggcagcaggaccactgctcataggcaggaaaaaaaaacaacaaaaaccagcaatgaaaggatttttaagaagcccaagttctgatgctaggtgtattcatgtaaataaattcatttaatctccccat

SEQ ID NO: 247152 - DNA, 530 bp, Homo sapiens
agcactaatagtggtaatagctacagtggattacaactcaccaaacttctttaaatccctggattcataatgatggctgtttacttttgagggtttttaaaaaaaatccggcagagatttttaaatagtatatggtagtgatctaattttattttccattagaataaccattcattcagcattacttattgagtaattaatcattttctcattaatacataatgccagtatatcaaattcccaaatacatagatatgggtctcttcttggggctctgtatctccttcctttaattgtccatcttagggcgtttaataatacaagactgtctcaattactatggctttattgtaactcattacctggtaggacaagaccttccaatcttacttttcttcttcaaaattgttttaaatactgtaaattttttttctacataaatgtgaaaaacgttagaagggcaactgcagcagacatacatagcttatttttttaagattaacagcaactttatactagcaaaaaaaaaa

SEQ ID NO: 247153 - DNA, 388 bp, Homo sapiens
tatccacttcacactttctcccagaactgtgctgcacccatgtctaccctaaatcattacataaactgagttcttccaaatttgaggagaaagaaaggttcctggagttctgtagagaaaacaattctcctgacccatttgtgccagaattctcaagccattcagacatgtggagagtctctggctgtgggatctagactttgttcaaacttttgcccattacttgatctatgttaagctgctttctgctcctcagggctattctaactgcctctgtacttctgctgattgccccaagccacacccactttctgaaacaccagagatcagcaggtgttaaagaaaagtgttaaagacacattatcacctgctttaagttctctaattg

SEQ ID NO: 247154 - DNA, 197 bp, Homo sapiens
ccctaactagccaagtgtggtggctggtgcctatagtcccagctactcggggggtgctgaggtgggagaattgcttgagcccaggacgtcgaggctgcagtgagccatgtttgcgccactgcatggcagcctaggcaacaaagtgagaccctgtcaacactggtataaacggacataaatggggtatagcacattga

SEQ ID NO: 247155 - DNA, 454 bp, Homo sapiens
aataaatctagcaatcatttcattaagtctaataaaaattaatgaccctccttgcttgcagactttgaggaaataaaaaatgttttacagtggccaatgtaagcaggtgaaaataaatgatggaaaagaacagccagtaaggccaccagcatggcactcattgaaggttgcttttctgtcagtcaagactgaagattaaaggagaagagaaactgagactcagaaatggactgtgacttgctctcacagagctcatgatggggctggatgtgtctatatttaattaatatcagttataaaaacttctgggtatttgaacttcctaatttgcttggattttgaataaaaggttttttgtataatcgttatcaactgtgaaaggcataaaataatgttaatgcttctgttttcctttacgataaaccaataaaatggaataaaatattcaaatcat

SEQ ID NO: 247156 - DNA, 340 bp, Homo sapiens
tagctgaagagcattcatgagctccagtgaaaaacagcatgagaaaatttgggagaaagtttatagaattatgattagtagtatttgttgttgatttacagcttgaaatcacgtccccttatatactgtgacagttttttcggaaaagtcttttatagttttcgttattacttgatttggtttatgtaacaaattagtgagtggtctaaatttggaagggcttaagtaggaagcttaattcttaccacagcacaatccttaggtactctaggatctctctctctcataccatccttgaagacatctttgcagataccataccttttctggttagtcgagg

SEQ ID NO: 247157 - DNA, 434 bp, Homo sapiens
actgcaccagctgagttctctagagatacttctatagaattatgcatttactcaccatttttcaagtaaaaaattttaaacccatacactaattcttatttaacctagaacaacagcaatgcttcctctatattattgggtctattatttcttttttgtttttcttttttttttttttttgagacggagtctctctccgtcgcccagggtggagtgcagtggcgtggtctcggctcactgcaatctccgcctccattgggtcaattatttctaaatgctgtttttgaccaggagcacattatgttcatttttttcccccacttccaccagcttccatttccttagctttgtgttttagatttcattatttgactcttcagccactactgtaccaacaggttaaactccacagtctctgtgagatcaaaatctca

SEQ ID NO: 247158 - DNA, 288 bp, Homo sapiens
tcaccctcatcctattagcgagaaggtacatagtgaactttggccttttccaagagcttgacaatttctccaagcaggttatgctggaggattgggaggagcagaagatgccagaagcaagagtcagccttaggagggaacaactggtcccatgatgtatttcacatttgcccaaagtgtcttcctattaaataagaatcatttatttgtgcgatgttgtagttattctctgataaatacaaatatcctttaaaaggtcattcagtgttcctcctgcctgattaatga

SEQ ID NO: 247159 - DNA, 347 bp, Homo sapiens
tctctatatagagtccagtataatggacattactccaatctcccagccctttaactaaggctttacccctctgtgatatccaacaggtcactctcttcacaggaacagtccaaagggtgaaatataattgatacaagtaaagaaaaacactaaaatcatttcatcagggactactgattccaatatctgataagggacattatatccccaacacatttgccttccaacaattaaaaaagataacacccaaacttctcaagggttaatgttatgatcatactcgtacacaatttgaaaaggtgtaaattggcacaacctttctgaaagcaatgaagtaatgtgtatca

SEQ ID NO: 247160 - DNA, 574 bp, Homo sapiens
acataaggctcattagtttatcattgcctaaatattttcaaaggcagatattttatcttgaaatgtacctttaatagtgaggttcataattttgtattgttgacagtttgaatagcagatgcccagttaccctgtagattaacagaaattgccagtcttttggtttggaattctcagttacgcttttcttgttcgttcagtattctgttgggtagtttagactttttaacttgttaccatggtcctgaaaaacaccaagttcagtcaggttacttcctgtctctctcagatttgcttaccttccttcatccccattgcctttacctacttcaaaccatgcttgtatcagaaccccacaactggtattccttcttctggggcctctcaaacccatctttactttgcagtctattgttacctttccctgcttaaagattttttagtggtgccttcttactctgagaaaagaatacaaaactccttagcatggcctacaaatttcttcatgatttgccatagcttacctttcaggtttcatttttttactttttgctatacctaaagcacacagtca

SEQ ID NO: 247161 - DNA, 418 bp, Homo sapiens
tatgctaagctaatgtagtagtcctagataacctctaggtgagtttggaatttgaaaaaaaaaaaagaggaatacagtaaaatttacataattggatttacacacatccatatttgctttattttgatttttttctttttggtcactaccatggctaaaatagcatatagatacatacatgtgaatttatgtggttaatttattaaaattaattttatcaaatacatagttaataatcaaatggagcatatcatgaaaccaacagttcactgccgtactcagaagtaaccatgtttaactccttacttatttgttttttgtgttttctgttgttgttgttttgagacagagtctcgctctgtcacccagactggagtgcagtggtgcaatctcggctcactgcaaccttctcctcccg

SEQ ID NO: 247162 - DNA, 436 bp, Homo sapiens
ggtgaggcacacccacatcatgaagggtagttcccttgactcgaaatctactcatttaaatggtaattgcatctaaaaaattcctttacagcaacatctagactagtatttgaccaaacaccaggacactgtagcctgttgacacataaaattaaccatgaagctaggcatggtggctcatgcctataatcccagcgctttgggaggccaaggcagaactatcgcttgagaccaggaattcgagagcaacctaagcaaaatggtgagaccctgtctctacaaagtaaatggatcaatcaataaaacgtggtggtgctatttgacaagctgaggcaggaggattgcttgagcccaggagtttgaggctgcagtgagctatgattgtactactgcactcttgacctgaatgacagagcaagaccctatatcttaaaaa

SEQ ID NO: 247163 - DNA, 437 bp, Homo sapiens
actctgtttcagtcgtgtgctggtaaatgtttaacaataggctctccaaaaaaggaaacctcgatttgtagtgtttgccattttctgtggtgtaaatactcccaccatgttcgttttcaagctatcaacatgacgtcaagtggctcacaaaattcctgaaaatttaatagtagtctgtcgtgaggaaatacaaaccagcttcagcacaccactcaaggcatgtgcaaagaaaagatgtgaaaaaataaacatgtgaataaatgaatgatgaaattaatgattcttatcatggattctcaatgttaagaaagccacagcatgctaccatttatagggtcttttaatactcttgtttatctctgttaaaggagtctctgaccaggaggactatttaccaaggatttctatgcaacactggttgtttgtgttgtcccaaa

SEQ ID NO: 247164 - DNA, 376 bp, Homo sapiens
agagataaacgattatggtgctctttattaatctacatttatagcgagcaccaaagggggagatgaagaaagaattcatgaattttacaagtataatcaaagacaagacatttttactttttccttcaaaagctaagtgtagtgtagcaacctcacccacctcccccgaccccgccccggtagaatactaactgcctgtttttccttctgtgctcagcgagccttatctgtacttgctagtttcacattccttgaggctcagtgagttcctgcttcacctctctagggcagctgcaaagttacaaggttgatacagaaacatggtttcccaggtatgtgtaacatgtagtataaataaatgtaaaagactgatcaa

SEQ ID NO: 247165 - DNA, 439 bp, Homo sapiens
cagctcttgccaactcgtcacaaggcttaaaattcttaactgttaaggcactgacaatttgtatcaaaagttaaagcattaaaggtctccataaatgataaatgagaaagataaccaataatataataacaagaactatttacttaacattgactaggagctagccactgaatatacttgtccttaaaacccaacatcacctgcaagatgttattattgtccccagtttacagatgaggaaagtgagacgtctggaaagattaaggaatttttcctagacgacacatctggcaagtgacagggtaagattcaaacccagggctgggtgtggtggctcatgcctgtaatcccagcactttgggaggccgaggcgggcggatcacctgaggtcaggagctcgagaccagcctgaccaacatggtgaaaccccgtctctact

SEQ ID NO: 247166 - DNA, 287 bp, Homo sapiens
atcgcaccactgcactccagcctgagctacagagcaagaccctgtcttgaaaaacaaaacagtataagtagattcctttttcagcagccttccttaactattgtgaccttgagatacaggtatgctaattagctgggaaaaatgagtgtcattagcaaattcaacataggccgggtgcagtggctcatacctataatcccagagctttgggaggccagggccagaggatcacttgaagccaggagtttgagaccagcttggatgacacagtgagacgctgtctctta

SEQ ID NO: 247167 - DNA, 291 bp, Homo sapiens
attgtatttaaagtggaaagagggagaagtggtagatgaggttgaacatgtaggcagtggcatatattgaaaggcctgggagtctcgctaaaaatttaaaatgtacctgtaggatatagaaggtcattgaagaatttgagcaagaagtagcatgaagagatgtgctgtttagatcactctggtgtaatgagtcgatagagtggaaatataacaaaaagtttcccatttaaaataaatgcactttccttgtttgaatttcgtttcttgggaataaagttttgatccgtctta

SEQ ID NO: 247168 - DNA, 899 bp, Homo sapiens
agtaaattgtttttccactcaatggctctgagtgttttgatttctgttgcctcaagaatgtgaaatttggctgagaactgttccttcacactgtaccttttcctgatggttgaggaatgcctggaattttccttggattgaggtaatggatactaaactataaccacacccaaatggttattttctctgaaattattaacttaaatttaaaaatccttgagtaaactcactgggttaaattctattacctttcaatatagaaatttttttctgttagatttctaacaaattgaaattctgcagggcttaaaattttgatacataactgtatagatacacatatatatttatatatgtatgtaaataattttctaaaagcaagcacttttctctggtatgacattatctggaatgagacatttattaaagctccttggagagaaattcttgccttttttttttttttaaacaattatgacatgttcttctgattatcagaggactggtttgaccaatgttgtaatgtcaggtcacaaaggcagcctctactagtctagacatcttcagaggatgctggagacccaaacgctgagattagtatgtcaaagaatcactaaccaaatcaaacaggctccattcctcaatccagtctggaaaagagcaaccatttccactggacacatgtcacaaggactcttttagaaatacccaagttgaaatcaacccacatgggaacactcctctgctgaaatatgctcttttcttagtcctttgacaaaggaaacatggagtatgagcaagggacaaagggacacaagggaagagccaatgaacaatctcctaggaaggatgaattataaaaattgtggagagtcacattctctcacagctcctgcata

SEQ ID NO: 247169 - DNA, 354 bp, Homo sapiens
acttggccatattgccaaggaaatagtatgttacagctgtaggtgaggcccccacatagcctccctgaaacccttcccctctatccttctccagaggtagccagtaagctgactgttgtgttcatgacttccatgcatgtcttatattgtctctacatagacacgtagctccacgctgtatatcattactgtatggctttttttactcaacattacatttttgagatttactcatgttgatgcatggagctctacctatttcacggtccagatactccagaattctctccatttctgttgatggacatttaggtgtcttaagtttttaaccattacagcattgcaccgaacatt

SEQ ID NO: 247170 - DNA, 2481 bp, Homo sapiens
cctcccaatgtgctgggattacagttgtcacgtaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcacagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccaaagtta

SEQ ID NO: 247171 - DNA, 1228 bp, Homo sapiens
gttcgtggagtcttcccctcctgtgtcactccttccacagcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcacagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccaaagtta

SEQ ID NO: 247172 - DNA, 2281 bp, Homo sapiens
aaccggtaaacgccggccgtttgaggagcaccggagccgcgaccgtggattggacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcacagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccaaagtta

SEQ ID NO: 247173 - DNA, 2159 bp, Homo sapiens
aaccggtaaacgccggccgtttgaggagcaccggagccgcgaccgtggattggacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcacagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgccaaagtta

SEQ ID NO: 247174 - DNA, 235 bp, Homo sapiens
gagaggaagcagcgggggaagaaggggatgaagaagtggaagaagacttagcctagaagtcagccttcgactgcggcgctatccctgtgtgccttcctttcccacctcttggtattgccccgctctcacaagtgggaggctgagctccgccttaaagcagcactgggtggtgggctgggagcatcgggccctgactccccagcccctacaaatcactagcccccactgactcact

SEQ ID NO: 247175 - DNA, 236 bp, Homo sapiens
gaaggtgaatctctatgtctctcgatttatttgcaatggtgtgaacctgttaagtagtctctgaaaggctactgtttgcatggtgatgttggagattgtggtctgagggcaggccgttgggaagattgctgtaaggtaaggaagattcaagaacaagctggaatcccagcattttgggaggctgaggtgggcggatcacaaggtcaggagtttgagaacagcctggccaatatggt

SEQ ID NO: 247176 - DNA, 592 bp, Homo sapiens
tgcatagaacatattaggatgtctagcccagaatacaacactcaacagatattagtttcttccatctatattttcttagttaacataattttttaaatctatgaaatcttacctgactgcagattcatcagaaattccaacatctattaaagaaaaaggtaaaatgcattttaaatcaataataaatgtacagaatattaaaatcataagaatgcacagtgatgcatgcctctaatccaaactacttgggaggatgaggcaggaggatcacttgaggagcccagaagtttgagaccagcttgggaaacatagtaagactctaccttcataaaaaaattgtgcacacttgtgtgtatgctttagatcctgttttttgttgttgttgttgttgttgttttggtttggtttggttttttaaagcataagactgacgctttgttacaaagcattcctttgggagcatgcctgggacgttattagaattaacattcattatatgtattggtaggtaattaatgcagtaagaactcttccctctgtatttattagatgcaaagaagaatacatttattaaaatttggtatctacaagt

SEQ ID NO: 247177 - DNA, 417 bp, Homo sapiens
atataaaatgttggcacatagtgggtgctgctgttatatgaatgggcacaaaatctgtctacattttgccttttaccaaatttagaatctatttagttaaaaccttcttagggcgggtggggtgcagttgctcattcctgtaatctcagcacactgggaggccaaggcaggaggactgcttgagcccaggtgtttgagaccagcctgggcacatagtgagacccccatctctccaaaaaacaaacaaacaaacaaaaacaaaacaaaactagctgggcgttgtggtgcccctgtattcccagctactcaagaggctggggtgggagaatggcttgagcccaggagttcaaggttgcagtgagctatgatcacagtactgcactccagcttgggcagccgactgagaccctgtctcga

SEQ ID NO: 247178 - DNA, 382 bp, Homo sapiens
tgtctgtgtggctctggcctctgctgtgctctgccttacacattatatcaccttggcctccccttgtgtttctcaaccccggctctgcttgccctttccgtaactgctgcagcctggacattctctcagggcagtgagctggagggatcatttgttttccatccgtcagggatcacagtatgttgctatatggtggccgttgttttgtgtggatttttagttctttcagacaggcaagaggtataaatcctgtctagcttcactaaaagcggaagttctttctgttctttgaatgttgaatgagagtgtgagagagacacgtaccatcaggaaatggaactagccacggtcatagcttttcatttagttttgttagtcttta

SEQ ID NO: 247179 - DNA, 367 bp, Homo sapiens
gtttgggaggctgaggtgagtggatcacgaggtcaggagatcaagaccatcctggctaacacagtgaaaccctgtctctattaaaaatacaaaaaattagccaggcgtggtggtgggcgcctatagctccagctgctcgggaggctgaggcaggagaatggtgtgaacccgggaggtggaggttgcagtgagccgagatcgtgccactgcactccagcctgggtgacagagcaagactccgtctcaaaaaaaactcagatgaactatagctaagtcagtgctcttgacacttttttagcaatagtagctttgtttctcacagaaaaaacaaaattttctgtggaaccacactatttaaaacataagc

SEQ ID NO: 247180 - DNA, 653 bp, Homo sapiens
gttataaaagaagcctgtttagttaggcacaaaataaaaactgacctattagcctggtgccaacactgaaatgaggttggctctaatgagaaatgtaacatacctacttcctcattttcatccctgtttatactttggtgggcatagattgagaacagagtgcttgccttttataaagagaggaggaattgttgagtagaagaattgctcagctagtgttcagaaattgagatcacatctgagctcgaccgtttatttactggctgtcactctttgggcaagttattttatctctacacatttagttcctcatctatcaaatggaactttaacgtgtatcttgctggcttccttaccgaaaacatatatttgaaaatgcttggcaaagtttagaatgctgaatagttgtaagatattaatgtgacatgaaattgagaaaaaaagtattggtgacaactggctacgtgaggatctgatgatatttgcaaagtatgaaaattccaagtattatttgaatttttatatttgttcatttagcaaaattcttttatggcactaaattcacatgtactattcttcttaaataagtcttaaaataattggttaatgtaggaataatatattttttataagtaagaagtaactagaattgt

SEQ ID NO: 247181 - DNA, 805 bp, Homo sapiens
  misc_feature (601)..(601): n is a, c, g, or t
  misc_feature (635)..(635): n is a, c, g, or t
  misc_feature (652)..(652): n is a, c, g, or t
  misc_feature (682)..(682): n is a, c, g, or t
  misc_feature (732)..(732): n is a, c, g, or t
tagaggagggaatggaggtccattagttcatctttcttctagctgaccaatagcacggcaccagcttccagtgaggacctcaggctgcttccactcctggcagaagatgaaatgaagccagtgtgtgcagaggtcacatggtgagagaaagcaagagagaggaggggaggaggtgccaggttctttttaacaaccagctctcatagaaattaacagagtgaaaactcatccaccgctttgagaatgacaccaaatcattcatgagggatcctcacccatgacccaaacactttccactggcaccacttccaacatcagggatcaaatgtcaacatgagatgtggaagacaaacatccaaactataacagaaggaatcggaaagcatactgttggatggtttgtgaagagatgtggattttcctcccctttctgtattaacaaaggaagagaaagaccttaccatttgaaatgggttggactctttacttttatatgatgtatactatgacagtttactatttctcaactctcaactaaaatggtaataataattatatcaataaatgatattaatttttaaaaaaagagagagatgagtgnaagaaggtaggtagagggaaaggtaggaaagagntaatagagaagtagaanagagtagagaggtagcatgatgagagagtnagtggagattttggtaagatagatcaggtaggatgctttactgtcggagnagcgttgtgctccccctttttaccgatttaggatcaccaccctgtaatgatctgcttcttcacacggtgggcg

SEQ ID NO: 247182 - DNA, 332 bp, Homo sapiens
ttatcatggaagtcgacgttagttattgtgggagtgggttagttatcatggaagtgggttagttattgtgggagtgggtgtgtgattgcgacagtgggtttgttataacagcaagcccagccttctcttgcttgtgttctctcgccctctcctgcccttccactgtccaccatgggatgacacaagaaggtcctcaccagatatgggccccttgactgtcggcttcccagccttcaaaatgggaattctcccacctgttcaacacatcacccagaaggacactcacctttggtccaggaggcccgggtaagccctgtggaagcaaaaaaaaa

SEQ ID NO: 247183 - DNA, 364 bp, Homo sapiens
ttttattaccattctgatgatgttgaaaggtgtgatgtttaagaggtcatgagggctctgtcttcgagaatggactaatgccattatcatgggagtaggtttgccccctcttgctctctgtctgttgtcctctttttgcctttctgtgttatgatgcttccatcatgttacaatgcaataagaaggccctcgccagattctggctccttgatcttggatatccaagcctctacaactgtgagccaatttcttgtcgttatgaattacccagtctttggtattgcattatagcagcacaaaacagactaaaacagttagtttatggttaccaaattttgaaaatttttggaagttttttattttt

SEQ ID NO: 247184 - DNA, 485 bp, Homo sapiens
agctgctgatgggcaggtgacggcctatcctgcagcagttagagggcagctagggagacgtgggctcctacctttctctccctgcaccccttctccagcattgttcccagcaggcttgggactccactgaacttggatctctttggttttgttccttgtcctctccctctgctcacacactgggctccaaggagcccgttcaaccccagattcttggattcagaatcctgggatcatcaaatcccagagatgtcaaagctcatttggtctgccccttccttagagctacaccatccggccttgacccttggagatgggatgtccacttggctgggtttattgcacccttgctgtatgcaaggctctttgcttatcaggcttggagaaattgagttaggtggtgcaaaagaggatacagagggaaatagtgcccggcctgccttaggaagcccccagtccaataaaaaagacacaagaaaaaaaaa

SEQ ID NO: 247185 - DNA, 1745 bp, Homo sapiens
ggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtccactgaggcccggaccccggactgcgtctccccagcccccctcggcgtcctctctcgcggccgctctgtccgggagccatccccacccgccgggtgtacatacgcgtctctgccactccccacccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcccgggttctctcttttttaaatgtcgaaataaacttcttacaaatgaccaggcgcctgtccctcgc

SEQ ID NO: 247186 - DNA, 465 bp, Homo sapiens
aggctggagtgcagtagtgggatctcagctcactgcaatctctgcctcctgggttcaagcaattctcctgtctcagctcccagctactcaggcggctgaagcgggaggatcgcttgaaacaggacggttgaggctgcagtgagctgtgatcatgtcactacactccaacctgggtgacagagcaagaccctatctcaaaaagaaagaaagaaagaaagaagaattggaagaaagcagagaaaagaaaggaatatgaaagctccattcactagaaagattttggttcatccttctagaccaccttctctggagcaaaatcctattctcaaatgactcagaaaatacctaataatgtatatacatagaataataaaacaaatatggcaaaatgttaaaactgaattaagggcattcagaagttctctgtgttattcttgcactttttctgtaagtttggaattatca

SEQ ID NO: 247187 - DNA, 497 bp, Homo sapiens
ttaatagtatattggttcttatgcactgactgaacagtaaacaaacatgtcattcttatgttgaagtcctaattctcagtgtgattgcagttggagacaggatgtttaaagaggtaattaaagttaagtgagctcataagtgtggggttctaatccaataggatcgtgtccttataagaagagaaagagacactggggatgcacacttcagatgtccatgtgtgggcaaagcaagaagaaaagccttgcaggccaaggagaaaggtttcaggagaagttaagcctgcaaacatattgatctcaaactttcagactccagaactgtgacaaatgaacttctgttttttaagccatcctatctgtggtattttgttatggcagctcttacagactaatactgttcttcacatcgtattttctcatcatgctagcaaattcacttaaatgttatttagtacaattgaaattcaataataaatcgcatgattctatcactt

SEQ ID NO: 247188 - DNA, 634 bp, Homo sapiens
cccaatatgaaaggaaaagccatgctggataggcatggggggcttagagaaggcagtggtcatctcaggcactttttgccctgtgccccatctccattgcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacatggcacaggtgtttttggatgagacaatgatagggattctgaatgagaataataaggacctgcacattcctgaactcagggactgccgatacctgaggatcctggtggagaatcaaggacgagtcaatttttcatggcaaatacagaatgagcagaaaggaataactggatctgtcagcatcaataactcttccctggagggctttaccatctattccctggagatgaaaatgagcttctttgagaggctccgctctgccacctggaagcctgtcccagacagccaccaggg

SEQ ID NO: 247189 - DNA, 355 bp, Homo sapiens
aatttattcctattctcattagtttttttgaaggcagattcgagtctactatcaaaagtgaaacaaacagctacctcctccttaaattttggacttgttacgttctctctgtcatgacatgcaataacttgtcttgcgtcaaggagcttaaagaccacagtgctctaaaatatcatttgcaaatgttggctgctgagaattggtctggatggacagagaattttgcagaggtgctgtatttcctaattggttttcataggaattagtttctctaaatccagttacatgttgcagctctctgtgtattaccctggaaaactgaaataaacaataaaaatcgatgttttcctttgta

SEQ ID NO: 247190 - DNA, 444 bp, Homo sapiens
tgttaccagggattgccaaatgctcccctggaggcgaaatcacccaattgagaaccacttgtctagacctatatattaaaagtctggaagtaagagtaggtaaacactggcattgtatttagaaaagtttggacttcctactaggccacagtgactacagagacaaggtgggaattagtttgttctgtgaccataggtatgtattatatcaagacctgaatttggccgggcgcagaggctcatacctgtaatcccggcactttgggaggccaaggcgggtggatcgcgtgaggacaggagtttgagaccagcctgaccaacatggtgaaacccctctctactaaaactacaaaattagccaggcgtcgtggtgcatacctgtagtctcaaatacttgggaggctgaggcaggagaatcgcttgaacctgggaggcggaacttgc

SEQ ID NO: 247191 - DNA, 314 bp, Homo sapiens
aataaagaaatgatgaatgattggatggggcaaaacgggaggcaatggggtcatgtgggagtgatgtactctttgttatctgtggcactgaacaaccgccactcgatccacccatgggaacgagttccccgtgaagtgggaaattcctaatggaagttttaggttatgcagtacagctcccaactccttacctggaaaaagaccagtgctggatgctggtcactcatatagaccctggattccttgctcccaggaggggaaggaggaaccgatgacagcaggatgaatgtagcaaggatagggtggctgaggtc

SEQ ID NO: 247192 - DNA, 377 bp, Homo sapiens
ttccccctaggaatgatgaacatagttcatgtctttactaatcgtctgtgacccaagcatcatactgagcacaacgtgtaaatatcaagaagacagtgttcaagggcaaggcttcagtatatgaggggcagcagaagtgatgggggggaggaggagtggaagaccaaggctgagcagctgtgtaaagagcagattggagcaagatagaagcctgttgtgaaaactggggcccaagatcagggctggacaacatcaagcatctttgctgctagagtgcctaagcgttgagtcacagcaacttaatccctcctattaatacctggtttgattctagagactggggtgaggctgagtcccctattggctgccagaatttc

SEQ ID NO: 247193 - DNA, 303 bp, Homo sapiens
gggctttttttttttaaaggaagaggaaaagttaaatgcttcctgaagctgagaggaaccctaaaattctgtcccactaaagacatccacatcctgataatgtttttaaaatctaatttaatgctaagaaataattatgtcaataatgtaaggccagagcttatagttccggtgtaaggttctgagtctcactttctcaaaaaaaaaagtggaaaaataaaataattttgcaattgtatttttttaattttcaatttttttaaagttttgttttctgcaattgtaattataatggtgtaagtt

SEQ ID NO: 247194 - DNA, 677 bp, Homo sapiens
tttacatcacatccactaattctttgacatacctcccatccagagctggaatctgtcccttctcctggaatctgaattgacattagcggctcattgattaggtaatttctgagactaaatcttcataggtgatttaaccttaattgtatttgtaggttcaaatcacctagtaaaagtctgaggccactgtgctgtgaggaagtcctggccacatgcaggtgcctcttgtaggtgttccagccaacagccccagctgaaaccccatgagtgaagcttccttccactcatcccagatagaatacttcagcttgagttactataacaaaatatcatagattggaagacttcaaccccagacatgtatttctcacagttctggaggctgggaagtgcaagattaaggtgctggctgattaatttcctggtgagggttctcttcctggcatgcaaacatctgccttcacactgtgagctgtcctcagcataccctttggattccctcctgtccagagggggccaaggtggcagggggctggtgggtcagcagtgccccagcctgtccacacctagccaggctgtgacagtgccagggctcagccccaaccatgcttggatatcaaagtgagcaccaggagtggggagaggccaggcagcaggagtagacatccccaaacctg

SEQ ID NO: 247195 - DNA, 432 bp, Homo sapiens
gatagataaagaaaatacatagctgttccagaaaacagaaatggataacttcatgaaccaaaagcagagtaatatactttagaaaggaagcgggccggaaaacccacagttgcaaaacaaatagaatttccaactgcctcttgtagccccttcctggaagtagtcacagcccagggtgttcgacttcttcctctgttttttgtttgtttgttgtttgcttttctgtggggtttttgttgttgttgtttgcttttaaaaaaaaattccctttccctgcttttttgtcacagcagcctttgtcacttcaaacaccgcaagtgttctttaaaaaaaattatatcaacctttcaattaaaatgcaacatgtctgaaacttggtatctggagaggtgagttggacaaaggagcccttgttactgcacgttttcattc

SEQ ID NO: 247196 - DNA, 899 bp, Homo sapiens
cacgctataatggcagagttgagtagttgccaaagagaccacatggtatggacatcctaaagtatttactatctggccttttacagaaaaggtttgccaacccctgctctgtacaatgcctgtcaccaatacagaggttggggctctaaccaggtgggtctccctggcttccactggcgacctcttaacctggcttatgggtgcacattttcaggctggtgcttctgggagatatgagagacacagtcagcttgtttccagctccaagatgtgagatggactgtgtctcttatgtctgcatttgaatcttctctcctttccatccaacttcctgcccccagctctgactcataggtctctgtctttgccttttcccaagaagagcaagaaatgactaaggcccaggggaggctgcatttccctgatagctaatgatgtagaacatcttgccatgtgcttatttgtcatctacatgtcctttatggtgaaatgtctcttcacattctttgctcatttaccaaatggattgcttaaaaaaaaaaaaacttgagttttgagagttccttacatattctaggtatgagttctttgtcagatatgtggtttgcaaatatttcctcccaggctgtagtttgtctttttgtcctcttaacaaggtctttgttagagcaaacacatttaattttgaagtctagtttattgatttaaaaacattttttggatcatgcttttgttgttgtgtctaagaactcttcacaagccgtagctcccaaagacgttctcctgtgttttatttttaaagttttttaattttatgtttgacatttaaatctgtgatctgtttttaaaaaacagctttattgagatgtaattcacatacaataaaacccacacatttg

SEQ ID NO: 247197 - DNA, 156 bp, Homo sapiens
tcacgtggccaaccgtgaagcctgcccagcctccctagagcccctcctgtctcaatagcggccatgtacattttacttgttttgttgttgttttgtttttgagatggagttttactctttttgcccaggcgggagtgcagtggtgcgatctcagct

SEQ ID NO: 247198 - DNA, 535 bp, Homo sapiens
gtgacataactgtaatttacctactggtaaatgctctgttcatgtcagttagtagaatagaaagtgctggccctgctgacacagcagccatctcctggtttgcgatggacactatctcaggaggaggctgccgtgtgcctgctgcgaggggtgctccctgtttgctagggaggcccagagactgccccggcacctcgctgcacacagagaggccgtgtgtgtctcttgacccttcagctccacactgggaatgagggagaccaggggttagagatgcctcgggacctgagccgggcaccagctcccatctgtccatctgtcctgggctgctgggggagccggctctggccaggactgatgattcctggcacccaccaggagatgcacatcctgcttgaaagctgtgaactgctatccagagtgtctgggcttatcctgttggagcaaaacccctgggctaatatgtaatcccattgtgaaatgtatttcaaggagggcttctacaaggattctaattttacagcagctttaacca

SEQ ID NO: 247199 - DNA, 282 bp, Homo sapiens
agaattaattgagtggaccagatggttttgcccatttgaagcaaatggggtggattacaaagtaaatcttatttgttgtgttaagaggatcattaatagcaaaataataaaatcaagtataatacttttagaggaaaatgacctttttcagaaaagggttcacacagatgcaagtttcttattgatgtcttgatgttagctagcggtttctgagtgattaagtcattgaatattgtcaaagggaagctaagttaataaggtttataatgggatattttacca

SEQ ID NO: 247200 - DNA, 442 bp, Homo sapiens
ggattacaggagtgagccactgtacccagcatacagtttttttatagaggaaaaaaaacatgtatatggtgactttccttttcctagctttcctgaatctttcctctaacaagtaatatttaagaattagtaatgtaactctagtgtagtcccattgacacagatatgggttgttgtatccattctttatgtaaaatgtctgatatgcctaatttattcccatgttaagagaatttattgtctacacctcattcagtctagctttggagtgaaacattccactaccactggcaatttgttacttaaacagaaaagagtattgaaccccttgtctttcatgaattgctttaaaatggtgattaattgttatgatggaattaactttacagtgctatccttaattattccctaatgtttacagaataaaaaaataatgcaaaat

SEQ ID NO: 247201 - DNA, 861 bp, Homo sapiens
  misc_feature (61)..(61): n is a, c, g, or t
  misc_feature (75)..(75): n is a, c, g, or t
atatacataatcgtataggaaagaatataaaataatagaaaacaaacagccttgttagagnaacatttactggangcttgacaagaatgacattttaatggaacaatctgatccacaacatcactataatgtggcaagactgtaccagagtgagaaacagaacaagacatctgtccaactcagcacccctagcacccatcaaagtaccaatatatacaacccaatcattattatttaaagaataaactaatcaacgcatgtatcaatatatgaattagtaaataaaatggaaaacaaaggaaacaacaccactcacaaaactcacccatacaacaacaaaaaaaaacaacctctaaacttcataatatattaacccccaatagccccctcacccaacataccccacacttccctttcattcttcacgaagcgaattatttagtgcacccccccctcaccaggcgcaacaaccaacaccctcccaacgccccatccccccccggtctactcgcagccccgtaaacctcgtactcttccccacccccgcgccccctctcatccctcccaacccctgtgtctctcatcacgatacatcattttcctatatctccccacatgtacagaaccgcaagaacggcgaccctcgcgtcctactcacacttgcacaccaccaaccgtcactacaaaacaagaacctaccatcaaaaaaggtacaaaatcctcgcaacctatctatattccaaacgcgctcccgatgatgatgttactcttaaacaatcatcgatacaacacggtcacaaccgaactctttctcgcttcttttcacacccaccatcctccccccgaccacccatctcccct

SEQ ID NO: 247202 - DNA, 1072 bp, Homo sapiens
caatcaattttatactttcttaatatttaaacaccatttcaaggtatttcttatatttgtctataatattctctgtatttgtgttaaatactttatttaaagagaaatttggaggccacccaaggtatctaaatatgaaaacacctctgatttcttaacatgttaaaaaacagaattcctgttttctttttccagctaaagttacaaaatatatgtaagatataaaaatacatgctttatacttattatctaaatccttcttccattcagaaaagaacatttctggtaaaagcaagaatgacattttaatggaacaatctgatccacaacatcactataatgtggcaagactgtaccagagtgagaaacagaacaagacatctgtccaactcagcacccctagcacccatcaaagtaccaatatatacaacccaatcattattatttaaagaataaactaatcaacgcatgtatcaatatatgaattagtaaataaaatggaaaacaaaggaaacaacaccactcacaaaactcacccatacaacaacaaaaaaaaacaacctctaaacttcataatatattaacccccaatagccccctcacccaacataccccacacttccctttcattcttcacgaagcgaattatttagtgcacccccccctcaccaggcgcaacaaccaacaccctcccaacgccccatccccccccggtctactcgcagccccgtaaacctcgtactcttccccacccccgcgccccctctcatccctcccaacccctgtgtctctcatcacgatacatcattttcctatatctccccacatgtacagaaccgcaagaacggcgaccctcgcgtcctactcacacttgcacaccaccaaccgtcactacaaaacaagaacctaccatcaaaaaaggtacaaaatcctcgcaacctatctatattccaaacgcgctcccgatgatgatgttactcttaaacaatcatcgatacaacacggtcacaaccgaactctttctcgcttcttttcacacccaccatcctccccccgaccacccatctcccct

SEQ ID NO: 247203 - DNA, 580 bp, Homo sapiens
ggacatatttatattaaaatttgttttcattgttcatctgaaattcaaatttatccgggcatcctgtatttgtatctgttaggtctaaagagacaagccatatacaactgttttttgtaactctcatcccacaaaaaaaataggaaagtaattttttgagttttagagaaccttaaaattaatgctaagaccctaggaaatttcttatgtgctcatatgtttggtgaaataataggaaggcagcacagcaaagtgtttcagattgcaggttttcagtctgatggtcccaagttgaaatttcaagctctttgaccttggtcaagttacagatccccagactgcagataaactgatactgacagaatttattgatgcctgcttcatacctcatacttttattgtaatgaaattagataaaatagagtgcttagcatagtgcttgacatagtataaatgccctatatatgccaacagttgttacaattgttactataaaaaatgtggatgatgatcagattaaaagaaaccttatttgagaatattccttagaaccttatgtttatggttttcttttacttaa

SEQ ID NO: 247204 - DNA, 4223 bp, Homo sapiens
ctcgggtcgcgggcgttggcagccgggcgggtgggaggggccggagcaaaagttccgggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagcccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaat

SEQ ID NO: 247205 - DNA, 852 bp, Homo sapiens
gggactctagagcatccccacctcctaccccacgaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatggtaaggagctcagcgtctggattcagtgacagggccacatgttccaggaccagctgggagccatagcccaccagccctggccaacgtcatcttcctggagcttcctgggtactggcctggaggagctcacaagtaacctgctctgcttgtgtcatgaaactaaaaagacttatcagggcggagttccttgaaaccctgttatttcttcctcgctcttcttttttttagagacagggtcttgctgtatcacccaggctggagtacagtgggtgattatagctcagtgtaacctcaaactcatgggctcaagtgatcctctctccttagcctcctgagtagctgggactacaggcacgagccaccatgcccaactaatttttttcattttttaccagtcaggtaggggtgaggggggtctcactatgttgcccaagctggtct

SEQ ID NO: 247206 - DNA, 3790 bp, Homo sapiens
gggactctagagcatccccacctcctaccccacgaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagcccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaat

SEQ ID NO: 247207 - DNA, 4335 bp, Homo sapiens
ctcgggtcgcgggcgttggcagccgggcgggtgggaggggccggagcaaaagttccgggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggtgaggagcctgatagccgaagagagaaggaactttttaccaactcaccagtggatagtgacaaagacaaggctccaaaccagctctcctaaccttcagtccaggaggcaaggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagcccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaat

SEQ ID NO: 247208 - DNA, 2930 bp, Homo sapiens
gggactctagagcatccccacctcctaccccacgaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagcccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaatta

SEQ ID NO: 247209 - DNA, 1892 bp, Homo sapiens
gggactctagagcatccccacctcctaccccacgaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagcccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaat

SEQ ID NO: 247210 - DNA, 1032 bp, Homo sapiens
gggactctagagcatccccacctcctaccccacgaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagcccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaatta

SEQ ID NO: 247211 - DNA, 515 bp, Homo sapiens
aaacatttcatgcatattgttaaccagagttcaatagttgttaaagattttttttcttttgaggtgaagtttacatgcagtgaaatgcacaaatcttaagtgttggatgcagtgaggtttgacaaatcacatacttgtgaaacccaagccctgatcaagataacattatcatccccaggaagtctcttcatgcttcttcccagtcaaatctttctatcccattcccctgggtaaccactcttggttctgagttttccccaatagattagttttctgtttttctaactacataaatgaaagtatatgctctcttgtgtaaggcttctttcagcataaggtatttgggatttatctatgttgtatgtatcaaaaatttattgctgaatattatttcattgtatgaatatgccatagtttatccttttgatggacacctgggccgtttccagttttttttacatattataaataaagcttctatggatatttttctgtaaatctttttatgagcacgt

SEQ ID NO: 247212 - DNA, 562 bp, Homo sapiens
ccactgtgcccggccagtatttttaatcttttatactgtatttttattgtaccttttctatgtttagatgtttagatacacgaattccattgtgttacaactgcctacagtactcagtacagtaacatgctatacaggtttgtagcttagaagcaacaggctataccacataacctaggtgtgtagtaggctgtaccatctaggtctgtgtaagtactctgggatgttcacaggatgaaatcatctaacagtgagtttcttagaacacattcctatcattaaccaatgcatgattataccatattttgaaactgtataaggcctatattagagaagggataactaaatgcttactactacatacatcacttaatctagtcattaaatttttcattaacctaattgtgcaaaaaagcaattgtcccaaggtcatggagctaacaaaaaagtaaattccacctattacagtaagaagtgaattatctcaagtttgttacctgcttacagatctttccatttataattatatccttccatttccattatctaaatactttttatt

SEQ ID NO: 247213 - DNA, 374 bp, Homo sapiens
tgttgtttacctttagtggaagggctggtgtttaagaatagatactgctctgttaaaaatacaaccatttgtaacatctttccctatgttacagtacaggtaaaagaagcacagaactaccaaaggggcaccttacattcaaggactcctacatatgaaaattccagtatccaaaacatactagtggtgattatttgctcaattattagtagtggttacttggataatgaaactgaaaacaagactaatttggagaaaagatatcacaactttctttttctgcactgttgaaatcttttggctaagtgctggtattttttttttttctttagggacgatgtctcactatgttgtctaggctggtctcaaactcc

SEQ ID NO: 247214 - DNA, 293 bp, Homo sapiens
ctctcatctgccactattttaaaaatagcccataattgttcaatttcttaataactaacaaaaatttgtaacaaaatggacaattctgcaatctttaaaatgctcactgtggcaattttctcacatgtctaatgtgtgcccataatgtccaaagattaatattttgtaccacaaaagatggataagaaaaagaatagatttaagtatgcaacacatatattttaatattaaacttttcctttttgttaatgaaaaaaggtaagccaaaagtgttctaaatgttatataaatac

SEQ ID NO: 247215 - DNA, 132 bp, Homo sapiens
tttttttaaaacctggacaggagatagaataaatgacattttacaatcaaaattacttcacttatttcatatataaagaaaactaaaaatatgcaaaaagccagattttaagttgtgttggtgagactttct

SEQ ID NO: 247216 - DNA, 325 bp, Homo sapiens
tatagattatcacaaacagctgtggggtcttaaaattggaaaagcaactaaaattttaacaataagggaatgtttaaatcatttttagtatgtttactaaatagaatattgtgcagccttcaatatgtggccccccaaaatgtatataatattgtattaagtaaagaaagcacagccagacaccatggctcacacctgtaatcacagtgctttgggaggccaaggtaagaggatcgattgaacccaggaggttgaggctgcagtgagccatgatcacaccactgcacttcagcctgggtaacagaggtaaaccccatttctttat

SEQ ID NO: 247217 - DNA, 407 bp, Homo sapiens
ggtaggacctgtgacttcctcttgccaacagaatacagcaaaggtgatggataggatgtcactggcttgattgaattatattgtatggcaaaggtgatgggatatcatggccctcactatcttactacatatatgactctgagaacactcattttcattatcctgttggcctcgaagaagcaagccaccatgagatctacagccacaagaaaatgaattctgccagcaatccgaatgaacctggaggctgatttttctctactcaaacctctagatgagaacacagcccaactgatgcctcattgacagcctcataggactctgagcagaagaggcagctaagcctgtctagactcctgatctgtgaaaacttgagataataaatatatgtcgttttaagctgctaa

SEQ ID NO: 247218 - DNA, 539 bp, Homo sapiens
tatctgtgccctataaatatcaccaaaagcaatcgttaagtctgagccagatgaaccctgcaggggtgccataacttaccatagactggatggatcaaacaccagaaatgtatttcctcacatttcaggaggctggaagtctgaaatcgaggtgttggctgagttggttacttctgaggcctctctccttggcttgcagatggccaccttctccctgtattctcacatggtcttccctctgtgtcttactgtgccctaatctcctcttgttataaggacagcagatattgggttaggatccatgctaatgacctcatttaaccttaattacatctttgaccctatctccaaatatggtcacattttgagacactgtcgggttaggacttcaacatatgaatttgggggtgggggtacataatatgtccttctttagaacagctaagacttattctataatcctgtcactcatctttggcctttatttccagtgacctttctttcattttcagtctgaagatcattcaactcaacagaaa

SEQ ID NO: 247219 - DNA, 455 bp, Homo sapiens
taaagtcaattatcctcttaatttatcatgtcttctacttcagtaatgaagacacatactttcttcaaataatggccccttgctaggctaacacactattttgggaaggaaacaaagcttatgattgaaatgtttttaaagaaattttaaattttggatcctttcacactacattctcattaatgagtttctatttatggaactatcctttcagtttatgcaaatataatttattaaatgattaacaaggaaaataagccagctggtagtatagtgctttgaatctattaatagcttgcaatttggcaatcaagattttgcatgggagaacctacactacaattaagaatgtatgctcacagacacaagcagcttataatgcaatctatatttaaatcagtaattgctgaatttatttttgtagtgattgtgctgaatataataatgatgaccat

SEQ ID NO: 247220 - DNA, 899 bp, Homo sapiens
catttgggtgactatgtgaacatattcctacaacttttttcctcacatcagtcatttgttaaatcgaagatgaagaaacagactttgtatttattacatcctccaacataattggcagctctgtgagggaagacactatatcctattcaattttacacccggtagtaacagtatgtgtgtgtactgtatatatacatatatatatacatacacatatataaatttaagtagtaactatatatgtatatatgtatagttactacttactatatatgtatacagtatataagtatatatgtatagttactacttacaatatatgcataaagttacagcttacatttacctcgtaatatatgtatatatatatattaggagttaaatgtattaggaggtaaatgtaaactctgtggtttatcatttattcacaattgctcttaattcttggggtatagtttgcctcctacatgatgcaattcagtgaaattcccaggagacaaaacaagattttgacctgaataaaccacttattgttgtaattcacaagtgagtttattcttcctggcacacttccaggtaatatccattaggctaaggattttgtttgttcactgttctatccccaagcctagagcactgcccagtgcggaatagctaataaatattgttgaatggatagatgaatggcaattttgttggtatgctctacatagtcagcagtcaataaaggaaacatatattcgttcctgataataagatgattcactttattgcccataaattgggctttttcaggccatcatgcacgttgattgatccagagatccctcaagcatgaaaaagcagagacataggtggtatagttattatcaatagagataagaaatgtagctggcaaa

SEQ ID NO: 247221 - DNA, 319 bp, Homo sapiens
cttaaccaactaaactaaatggccatgcatgaagcccttcctacgcacatacactcatatacaactgtacacaaaagacagatatacttttattatgcaaatcacagaggaccattgtaggtccccaaaccaatttttgagactattctaaattaacctccaaaaagaaaatgaaggaacaggtcggtttaaccacttgaaatcttcctgtggaacgtactctaactaaagatattatatttttaaatgaaggaacaggtcggtttaaccacttgaaatcttcctgtggaacatactctaactaaagatattatatttt

SEQ ID NO: 247222 - DNA, 326 bp, Homo sapiens
ctgcacccagcgtgcgggctcccgctcgctccatcgcctctcagcgaccgccagcctggctgcctatctggcccctccagccggcctgcctccctatctgccctcccggtgccggttccagtgcccgtgcgcccgcgggacccgggaagccgcgcgggagagtcctggcgcactcagcctctctttgtccgcgctctggccgcggctttgggaagggactgcgagcgagccgggagttctctgggggttgctaccctgggaagaatccgtgccctccccaccccaaccctcattaccggcacacctagggcggggccgggcggccg

SEQ ID NO: 247223 - DNA, 685 bp, Homo sapiens
gtcaaatgggggaagcctcaagtgatgaacacacagaaaaaatgtggtatatacatacaaggaatattattcaaccataaaaacagtaatatggaattacaaaacactaagagatgttagtcataaaatctgctatgaaacattgatgtaccattaaaaaagaatttgcctagataactacagtattcaactgtgactgtgtagtcatgaaaactaggtattttgagtcactggcatgcagtggacagcagtaacatttcacagaaaatgcactacaatcattatgaaaagactctactgagaacattttaatgactaagagatactaaaggtaatttttattatatgtttactataccgatgctattcttatgcaaatttaaaatgctgccatccaacttttagaagcaaggaatagccttatatttctaaataaagagaaaaatataaattatgtaaaatatggtgagagtcactgatatataaaataaacatctgggaataaatcatattattatttatatacaggttgaagaaataggataatttaatcaatgtggagtgcttgccgggtgcagtggttcacgcctgtaatcctgacactttgggaggccaaggcaggcagatcacctgaggtcgggagttcgaggccagcctgaccaacatggacaaaccccatctctac

SEQ ID NO: 247224 - DNA, 714 bp, Homo sapiens
ggaggagggggtggtgagaggagaaagcagccttccaattgaagatcagccctcaggtaaaggtcagcttcgggcaggctggcctcaggcggagtcagggtcagaggaaggagcagcagcagggtgggactggggcattctacatctcattcaggtcaagcagagtctggtccagcatcctttgtgtacagaggtgttcctctttggtgcatttcagtttatcttccaagtcatcaattgtcttttccagcttggctactgatctctcagccaactcagcatgggtctctgcctcctcgagattatcagtaagaatcttcatctcttcctcacatttgtcttctttttgagggtacttttcttcagctgcactcagacacttcaggttctggtccatcagtctgatctgctcatccatctctcagcaacgggactctgccagctcagctcattcttctgtgcattccatgtctctttcaatgatcaccaacttacgagccacctcttcatacttcccatctgcctcatctgcaatgtgcttagcttctttgagttggatttcctggagttccatcttcttcatcttttaaggcccagatttcaataacctttgtatctctctcactctcatcagcagcttttcccgcttcttccagcttttgcagggcagtggccaggcgctcctgagcacagtccagctcctcttcaaccagc

SEQ ID NO: 247225 - DNA, 576 bp, Homo sapiens
gaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaatgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttccttttcaaaccctgggagtaatgaatgaagctgctgatgaaatagcaactggagctcaggtggtagatctactagtatccatgtgtaggtctgcg

SEQ ID NO: 247226 - DNA, 512 bp, Homo sapiens
ctcatgacagaggaaaacagcaagagcagaactgaaacacaagcactcaaaaacttctgtgcagacaagtcagatgtcacatcctctcagtcaacacaaattctgaggccaaacctgactgcaggacatggacatatctccgcctgcggagaggtacagacagttgcatagtcataagcaggaatatagaatcttcttgcaggaaaggaagtgaatagttgggaacaataatatgatcccccaggcagctgaatccctgagtgaatagaggctgtgtagcaaacccaggtggaagggaaatggctgtgctttagtcaggggtaggttgaggtggccttctggtacagcatgaatcagcaggtttggagcactggtgcacagccccgcatgttatgtaaccatgctacgtgaggcgcattaggtgattacccatgtgagctcgtgcttggctcagagccgctattgtctgtaaaatatctaactacactgctaacgctgtacatacagctcac

SEQ ID NO: 247227 - DNA, 268 bp, Homo sapiens
tcaggtattttttgtgaagctagacaagttaattagaaagtttatttggaaaaacaagccaccaacgacagccaggaaaatcctagaagcaagaacagtggggaaagggtgccctagcactaccatacattaaaacatattataaaatctctgttagtaaaatacttttgtattagttcatgaacaaagcatgccacaaaatgcacagacaaaactgcatatgaatatttagtatacaattaaggcaacatctcaaatcagcagagga

SEQ ID NO: 247228 - DNA, 724 bp, Homo sapiens
tctctactaaacatacaaaaattagctgggtatggggtcacacccttataatcccagctactcagaaggctgaggcaggaggatcgctggagcctgggaagtggaggctgcagtgagctgagattgcaccattgcactccagcctcggtgacccaccttaaataaataaatacaatttttaaatgatagcatatatatatatacacacacatatacatacacaccaaataggtacatcgatgagagaacactatatttacaaaagtgcaagggaaatttgaatataagacttcagatgctggttacggtacctgaggtaggagggggaaacaggctggagtatacactacagaaatagacatgctttatcaattgtctgatttccctggagcatgttgacttcacgttgatttttttttacatgttctgttaaaaaaatttctttaaattggcctttggaaatttaccagcagtgtgctggtaaagtcttgacaatcagctctctgaaaaaaaaagcaaaaagaaaaacaaaaaacaaccccgacgtgtagcatttgccgatttctctggtgtaaatactcacagcatggctttgacatgagttttacatttggtaaaagcaaattgtgcctactttgaatagaaggattgggacagagatatggttcttgtcaggcactaattagggagtaaggcttgtctaatattgccttggctctcaagc

SEQ ID NO: 247229 - DNA, 319 bp, Homo sapiens
  misc_feature (283)..(283): n is a, c, g, or t
  misc_feature (314)..(314): n is a, c, g, or t
aacaaaaaaacacacaaatgaaaatgcaatcatagagtgcaatgttatctttcatagaatttgaatactttaaaaattttaaaactcttataacttaatcataaaaagacaactcattaataatgagcaagagacttgaacagatagtttacaaaaaaagagtgtataaaaatacgcaaatggcaagcatgaaaagatgtttaatgtcattatccatcaggaaaactcaaggtaaaaccagcgtgagccaccatgtcctgatctcatactttcaacttccagnactgtgagaaaataaatctctgttgttgaanccaaa

SEQ ID NO: 247230 - DNA, 2032 bp, Homo sapiens
gagaggattcagagctaagtctccgggctcctttcacatctgcaggagcagccagcctgggaccgcgcggcgcggggcgcgctctcgcctctcctgcaccctcagccggcgcgcttctcttatgggcgtctgctgcagtctggctgcggtcgaactgaaagcggcggcgggagaccaaacttagaccccgctgtggactagagaactcagagaaggcagagggagagggagagagagagagagaagggacccgaggaggaggcttccatcacgtcattgcaggatgttctggaagctttccctgtccttgttcctggtggcggtgctggtgaaggtggcggaagcccggaagaaccggccggcgggcgccatcccctcgccttacaaggacggcagcagcaacaactcggagagatggcagcaccagatcaaggaggtgctggcctccagccaggaggccctggtggtcaccgagcgcaagtacctcaagagtgactggtgcaagacgcagccgctgcggcagacggtgagcgaggagggctgccggagccgcaccatcctcaaccgcttctgctacggccagtgcaactccttctacatcccgcggcacgtgaagaaggaggaggagtccttccagtcctgcgccttctgcaagccccagcgcgtcacctccgtcctcgtggagctcgagtgccccggcctggacccacccttccgactcaagaaaatccagaaggtgaagcagtgccggtgcatgtccgtgaacctgagcgactcggacaagcagtgagcgccgggccggacgcagctcagccccgcgcgcgcccggccgctgggtggcgccgccgccgcctctgtccctgccctccgagcccactgtcacgctgcctggtgttccccctcagcagcaagcacttctcttagggctgacggtgtccttgtcacagacgtggatcgcaagtggagcttttgctgatgtgttcctgaccgaccccgggtcccacctgtgccccctaaaccaggcggtggatcaggcccgaaggaaaatgctggaaaaccaccaccgccacccagcagtcagagaggacctttcgaggtgatgcactgtaaatccggcattgatgtttccaccatgtggaaaagcaaggatttccctggccccgccctgcactccagctcgcccctttcccgcgcgaagtgaaggatgcgtcacttttctgagcggcccctcagacctctcctgctggtccctggacctctggctgggagcgctcattcttgtgactggcaggctgccctcggtcgctgctgtgatgaggatatgtgcaacctccataaatatgtcggtggacggggcgtctcctaataaacctgataccaagaagacaacttgagccacttggatcccgaagtgggcttcccgggaaacctcgagcagagcaggctacacaatcccccatcctcaagtccccaccgcctcttcttcctcactgtccccgccccctatttgtggactaaagatgaactctggtgtgcatgctattattgctgcaattagaatattatcacacacaaaggtctctatattaacgctggttttataagtgaccgtatattgtaaagagctgttaaaaagtattatagacctattcatgtattatttcacatgttttgactctggcttgcagcaccattcggagtaaggatgacagcaggcccagaaggtgttttactcagaaaaaaaaatgcctggtcagcaattcactgtcatgcacctatttttagattgggcagggagatgggaggagtcgtgatttttactttgaatactatttcactgacgttactaagcattgcagcacaatgtagaaattggcttgggatggataggtatagggaagggcattcgttgggaaattgatgaccggaaactagaaagcccctataatgtggaatatgcatatgtggggtgaaaccgtatactactttcactgccatgacactaggcaaaaaatatttcctgttaaaagaa

SEQ ID NO: 247231 - DNA, 391 bp, Homo sapiens
ttctttttttagtctgttctttctttatctctcaatttttcaacaatgaagttttttcatcagaaaaatacatatctttacattttagcatgctttcatacattttataaaaatcacaaatatgtaaaagaaagaccaacttcaaagaaaataccctcaaatgcttcaatctgcttttctacatttccaaatttctacagtgaataggttacttctgtcaagagaaagaaagacactttgtataaaagttgcaatatccactcactcttttaaccttaaacctaagctaatttgcatctgattttcttagaactcctgaagcttttatctcttatattagactgaatagtaggtactttagatttttacttctatcttgagtctaatacac

SEQ ID NO: 247232 - DNA, 430 bp, Homo sapiens
tacaattctgagaatgtaactataagtgttcctgatgaggccaagaaaagtacctaagaaaccaatgtggttttgtagggagatacagagataattagaaaatcggaaactggtcagtaaccagattcgaaggaaatgattaatgaatctgttgtgaggctgtatcctggatgcacatttgagtcaatcaatgatctgaatgaagatccaaactgcaaatataaaaagtaatgagattgaatgaatatttaacagagtaagatataggctgaatttaacaagacaaagtcaaagttacctatgaggcccaaagttgtccatgagcaattggataaaagagaggcatagggacaagacaggtggagttaatgctattcttttttttttttttttgagacagagtcttgctctgtcacccagactggagtgc

SEQ ID NO: 247233 - DNA, 547 bp, Homo sapiens
caggagaggacattcagaataatgctggggaagggaagttccagaacagctgtgtagcaggcctcaagaagaaacaatccagtctgcagtaggagaggtacagggctccatggggaaggaaaacaaaataatagatggatcatcagatacatatgaatatgtggaaaactgtatcaagaggctgttagagaataggggaagaagtaatcttagaaacaaagaagctaaacatgaaaatacaagaggacagaggactgcactgaagcatctagtcatgaaaaaaaatgagctgataggttcctgatgtgtttgactgtattgagaggagtgttatgtgagaatttggggaatgaaattgagatgaagaaagataagcaattattaaatcctggaaaaacagaaagttgtgtaagaaaggaaatgtaatcattgcacaccatatgactcagcggcaaataatattctatattaaaaataatgtaaagaataatataaatttaaacaaaaatggaaatataactatattgggaagattagtgcaggaaaa

SEQ ID NO: 247234 - DNA, 584 bp, Homo sapiens
cactatttagcccacaacattaaggaatgggaattcctgaccaaggacactgaaggtggtctatcctgtgtttcatttcttctcctttggtccctggccatcccttcccagttctgtctttttattgctggcttatagcagttgtttctgtatcctatgtatcctttgacagatgcaggccaatatttgcaaatatttttctcctagtcatggtttgcctgttttcctaatgtttaacaaactgagttaatctttaattttgatgaaattcaatttatcattttttacttgaaaagtaattgagttctctaagacaattttgcctaatgctaagttacaaaggatatctgtacattttaaacctagatttttttagttcttctgaaacaaaactttaaaagaagacagcgagcaagcgagagacaatcagaatgtaaagagaaaacaatgtaacacaaaggaatgtagctcttatgatcctttgtacttgtatgttatcagttgtcgtgtctcctctcatttctgattttgagtcttctctgtatttttcttagttattttagctaaagtttggaattgtatca

SEQ ID NO: 247235 - DNA, 337 bp, Homo sapiens
tgacagagcgatgcaggatctccctggaatcagatgtgagcctctttttcttacgcagctttccccttggagatcttttcatttcttatgcattctgctcccacctccatggttggtttctatttcagacctgaatccacatcagatcacatctttcttcttgactgttctatcacaacttacacctaatgtgactacaatcaagctcaagacaattctccccaaaccaggtctcaccctaaaactccccttgcttatcagtggcaccatgttcaaaaggcttacaaccttgaactactgttttttttcttttgtttccacatccactcccttacca

SEQ ID NO: 247236 - DNA, 299 bp, Homo sapiens
cagaacatcactttctcattaccttttcccttaaagagtatctgcatcatgtggaatgtataaccagttcaactggtattttaatgcaaaaattcttaacttggtctgtctggtatgagtgtgtctgcctaaagatcataactgagatgatcatctgatactacttttgtgatatgaaccctccatttaatttctatttgaacattacaggagacttgagtttttacaatgtttagttgatgaattggtattgttatatggttgaattacaataaattaagtttctgcttgaacaatca

SEQ ID NO: 247237 - DNA, 833 bp, Homo sapiens
cagtgttgtgaagggagcagaagaggagaaacctaatctccgaacccaacaacacctagcaacagtagaaaaaacttttaaacaaaagtctgggtgggagatatacaacaacttccaatttctgctgatcgggatttcagggagaagaagctgctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtaagaccaaaataaataaatacttactctcttaagaaatatctgtttccacaagaagagagttctctcccattctgttttgtctgtttcctttgattcttcctgttctatgatgtgataacacatttagaagttacgataaccattgtgaattatttttaaaaagtcagaaacatcatctcttcctcaaaattataccaattcctttttaaacacataattttatggtgttttagtagacatcaaaatatttctcccaagttagtgctcttcggcaggtaacagaactatgacaaaggacaatttcacatctcctttcacaattgggatggctaagcaatgaaaaggatatctcccctagaagtaaaataactttcatttactgaaactagctaagcagcttgtgtttggtaaatgagaggaaagtcccgcatggtgtttgtattgctgtactttttaaacctg

SEQ ID NO: 247238 - DNA, 481 bp, Homo sapiens
cagtgttgtgaagggagcagaagaggagaaacctaatctccgaacccaacaacacctagcaacagtagaaaaaacttttaaacaaaagtctgggtgggagatatacaacaacttccaatttctgctgatcgggatttcagggagaagaagctgctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtgggaatgagatctcgaaaccaaggtggtgaaagtgcatctgatgggcatatctcctgtcccaagccctccatcatcggcaatgctggtgaaaaaagtctctcagaagatgc

SEQ ID NO: 247239 - DNA, 303 bp, Homo sapiens
aggttaaaatcttactttcattttttctgaagaccatcaaaggggtttcctgaaaattttaatgacatgttaatttgatttttccttattggcgatgtggtaaagctgctataagtttctaagtatttaggcaaaaataattttgatggtggtaaagaacatcttatctttttttatgtatgtgttgtaggtgggaatgagatctcgaaaccaaggtggtgaaagtgcatctgatgggcatatctcctgtcccaagccctccatcatcggcaatgctggtgaaaaaagtctctcagaagatgc

SEQ ID NO: 247240 - DNA, 270 bp, Homo sapiens
agccctgcagagttttggaccaggatgggccatatcagagtagtgtttttggaagggctgccttgtcatgttcagcaggaagggggaaggaagagagatgctgagatgctggaggcaggaaccctattgttttgttttgttcttgagactagtcaagcgcggtagtgagaaacagggaagagtagaacaaggacttccatctgtaactgacgtgagcaatccattgagataactcactacttttagcccagccaagggaactctgtttaa

SEQ ID NO: 247241 - DNA, 265 bp, Homo sapiens
tgtatcaagatactgaagaatcttaattagtaatcaggaggtagcacaagcagcagtcccccaaacctgggtcccatctgactcctggggctagctgaatgaccctggctacttggccgcattatgcatcactttcttcatctttctccatgggaataacaatagttattgtctcacaaagacatgtctcacaaagacatggggaaatgtaattcagataggtatataaaacaataatattgaacctggcacataatataactca

SEQ ID NO: 247242 - DNA, 375 bp, Homo sapiens
ttcccggaccctatccggagtttaaactacacgctcccagctgtgggatagtaaagagaacgcagcggtgaggggattcggaaaatcggttcatccagttgacaactaaaagctaaaaaaactccaaggctccgggctaggtctataataatgacctctctaatgttccctttccaagggaactctactcgtcatctgtagtgggtggtttgtgtttttgttttttaatcctctaaagtgtatggcaacattttggaaactgtcagctcatttgagccttggcaactatattgtagaaaatgtaagaagacaaataagaggacgtttttacatgcatttcttacgttcttaaattaatttccccaaaaaacgatg

SEQ ID NO: 247243 - DNA, 414 bp, Homo sapiens
agatgtttcaagatagtggttttcagaaaaactggtcttggaactcatttttcaagattcatcctcaagtagtaaatcctgtgcaacagccaggacacaggtataatcacttattttaatactgggatactattagcttagttttttttacttttttagaaactgagctacaattcccatattgtaaaattcatcattttaaaatgtactattcagtgtttgttagtatatttataaggttgtgaaactattagcactaattccagaacgtttttatcaccccagaaagaaatcttttatctgttagcactcagcattatagattttattttttaaaatatttaagtacgtttcaaaacatcatgttaaatatgtcatgttatacgtgataaatgtatacacttttagtttgcc

SEQ ID NO: 247244 - DNA, 343 bp, Homo sapiens
caaggttatttgactttctagaggggtgtgattttgtttgacatgctattattctgttagggcccagactctgggaaggtggataatgctgagtagaatatcagtaagttgcaaatgatttctgccctatagtagagacagctccaaaaattacagttttattgccctatttattaccaggcgttaatctaactgcaatcttattccagtagacttccttttcctgaaatggacatacagaaaaatgtacatatataactcagtccactgtatcctcctttgaactagttttacctgcttgttttctcatgaatgagttacataaatctttgacatatatttt

SEQ ID NO: 247245 - DNA, 299 bp, Homo sapiens
tgattcttccactctgctagtatttcttgaactggcacagttctagatgctgaggatacattagtgaacaaaacagacaagaatccctgtttttgtggtgcttacgctctagtggaagatagaggaggcaaagatttaacaataaacataataaataaggaaagtataaggtgtgttaagtggttaagagaaaaatatagcaaggtaaagaggaaggacggtgctgggggagaggtttctattttacatggagtggtcactgtcacctcattaagaacgtaatatttaaacaaagtctt

SEQ ID NO: 247246 - DNA, 325 bp, Homo sapiens
ggaaagatgggaactcagacttaatttaactccttgcttttccccgatgcagacaccgaaaccttgcgactgagcatcaacaggtgccttcctcctgcaaggaaactttcagaaaatcttcaaggtaaaccaactatcattctaccagaatcaaggacaccggtttccaaaattctaatccaaaagggggagtgggactgggggaagatcatcaacaaggcaatccttcacctactcctactcctcaaagcagcatcagatgagaagccgggtgaggcatgttaaccgagaagccctcctccaattaatgtgctattgctccttt

SEQ ID NO: 247247 - DNA, 450 bp, Homo sapiens
tgctgctacaagaaccttctaattgttctgcccatcctccacctctcctgcctctaatccatcatacatactcctgctgggttaattttcctgaccacatcattcccttactcaaaactcttcagtggctccctatgatacagtgtaacacttgactcttcatagcccacttccaaactacttttgtaaagctttaagatgcattccaaaattatgaaagaaacacatgttcacctcaaccaggaaaacactcaaagatatacaaagaaaaacatcagtgatcttcctcacctcctctgcatttcccacccagtctcccaagacatccattgttaaggacctggggtataacttctacctctttcaccatgctccatgctcataataaactatattcatatatgtggagctattgtgttattgcctatttatacaaaaaggattatatta

SEQ ID NO: 247248 - DNA, 1171 bp, Homo sapiens
ggaagctgtaaaaatataagcccaagtattttgtgtcatctgcatatgtcaggatgaagaccaggcatgtaagaaatatcctaaagtagccaagtgataatctcatgaaaaaatatgagaatcgtttttacagagtgagttctcttttgaatggttttgactatgcttttaaaaacatttttaaaatgtacttacatctttttcgatagcccacgtatttcagaatatcctcttgatagaataatatcactcagtgtgatttttagaaaaagaaaaactcggtggtctcatatcttttgacagttgtttgtgaataataccctccccaacaaccttcccagtactcaactgctatgtaagaatgctttcttatgtggtaaatgtctcagtattttgctgcctggtatttgttcagtttccttgtatatctcagggtcagaaggaatcaggctttctcccaactctgaaacattcagacttactttctttttggtcagccttttaacaagcaagacaataaactccttttgtcagaatcgatttgattaaaaaaaaaaaaaaagaatgtgctccttatttctcattgctgtagaatacttaggaatacacatctactaatcacaattaaaaaataagagaatctttagaaacatcattgctttctggaggtagaaattttgaacttgaaggttgtagttccaggcaattttgtgcccttgaggtgtccaattgatagtatagcttgcctctgctaataaatacacaaaagttttctttcctgtgattttcagaaattatttttggaatacaaagattaataaggaatatgtgatgtttatctcctgcatttcaaaatcttctggattttttttgaggcatgaggagcaggtaatgagattttttttctgaatatcttgattctctcccttaacccagattttgcatattatgcattgctcatttgtcacctacaaaaataaaggttaatgattatttgtttgcttttgtctatataagctccctaaggcacagaccatgttcgtttttcttatgttcctcttagcactgtgcctggtgccttgccatataaaaggtaccctataaatatttgttggctgagtaatcagagagcccatttcaaaatctaaattatacaaatcatcaaagacca

SEQ ID NO: 247249 - DNA, 443 bp, Homo sapiens
gtgatgaaactttgtatttcaaaaaatggatccccttcattctctccttgtttctatgtctgctgtcctgaagccagatgtgttaccatgatgtctttatactaatatactaacacagcagttctcaaagcactgttcatggacactttgagctccctgagactcttccagggggaggccaaatctattctcatactttcccttttcactgtgttgacatttgcagtgatagtgcagaagcaacgataggcaaaactgctgacaccttaggacaaatggcagtaccagcaattgcactagtagacatcttattcttcgtcttcatgactggcagaaaacaaacaaacataaaaagaatttgacttaagaatgaccttgatgaagcagcaacatgatttattaaatctttatccttcagtacaagtctttttaatattgtgtgt

SEQ ID NO: 247250 - DNA, 759 bp, Homo sapiens
actattccctcacaaaccggggctttggggaagccatgtcctacttcaggactccacaaactcatccaggtcctctgccttccggccaaggtggggctgcttctccaggcttgtcccttggcctctgtagtcctgtagagccagtggtggtggcctctggtggaacaggcccactgagccagaaagctgagcaggtggcacctgctgcccaggcctggggcccagccctggcaatgccacaagccaggggctgccctggggggactagctgggagacactacggaaggaatacagccgaaactgccacaaattcccgcatgtgaggcagctggagagcttgggctgggacaatggctactccagaagcagagcccctgacctgggtggccccagcaggcctaggcccctgatgctgtgtgggctgtcaccacgggttctaccggtaccctctgaggcagtggggaaggaggccagctcccagcctgatatctgcatcctcaccctcgccatgatgatcgctggcatccccaccgtgcccgtcccaggagttcgggaagaggacctgatctgggccgctcaagctttcatgatggcccatccggagccagagggtgctgtggagggggcgcggtgggagcaggcacatgcccacacagcctctgggaagatgcccctagtgagatctaaaaggggccagcctcctggctcctgcttgtagatggatgaaatagcaccagatatgtagggtggaaaaaccg

SEQ ID NO: 247251 - DNA, 595 bp, Homo sapiens
gtcatggcgacaaagtgagactctgtctcaaaaaaagaaaaagaaaaataccaatactgggtctgacccgaagtcttactctacaaggcacgaagcacttggctcctgtgtttccatctctggtcatctgcttccatacaaatgatctcatttcatcctcaaaactcctaatgaggtagtgggcagtcatcagacacactttacagataaggatatcaaggaacaaaactatctgggtgactcgttcaaggttagggcaagaacctagaacacccagctcctggtctggtgctcttttaacctcatcctattgtcatgtccaggttctagaatgaataggtcaacgctgtaaagtggattccaagtgtgaaggggagggtctatgaggtgacattctagaagggtgaagaagggaggacaggcggcagatcactattccctcacaaaccggggctttggggaagccatgtcctacttcaggactccacaaactcatccaggtcctctgccttccggccaaggtgagcggggggcacctgcaattggagggagtgcggcagcttcccctgagaagttgctttctggctctggggag

SEQ ID NO: 247252 - DNA, 454 bp, Homo sapiens
caggctggagtgccatggtgcagtcatggctaactgcaacctcgaactgccaggctcaagcgatcccccttatctcagcctcccaagtaactgggactacaggtgcacaccaccacacctgggtggtttatgttttagagatggagtctgactgtgtttcccaggctggtcttgaactcctggattcagcaatcctcctgtttcagcctcccagagtgctgtgattacaggcatgagccactgagctggcctgtatatattttttcacatacttgcaattattatgtatatgattagacttttttcattagattatgtgtttttatgttattgtaagctatttgtagacacagttttattgatgatacagttttctataaaatggatattatataatcgacttagttaatttcctgtggttttaaatttagatttcttccattcattaaccaaa

SEQ ID NO: 247253 - DNA, 489 bp, Homo sapiens
agctttagttactataaaacatgtttaagcattttccatttgaaataaaattttaatttcatgctttgtcagtttagtttccctaaataaatagaaaatagtaaaatatcgcatactaaaaaaatcaacttctttggtaataaatcagttcaactgtcagaccaaaacatagttacattttacccaatgtcatgctgaccaatttgatcaaatgccacttccttataactaagagagatgcaaagatgtagactttatgttgagtgagacaggtaaggattactaggagttagataattgttttattaatcaaggtcgattttaattactattttgtctctatgttaattaatggtcttgattcaagaaaatttttttaaaaactcgtcttctcagtcaggcaaaatattaacaaaaaggcatagaaatgaaggcatttaacacagtcatagtttacattttaaaattaaagtacttctagaaataaca

SEQ ID NO: 247254 - DNA, 200 bp, Homo sapiens
cgtcctggttctggctggaggcagtggacacgtggctcatggcctcacaactcccgtacggaagtcgaccccgtgtctgacccatttctttacaaagttgacattctttgtgatcctattttatgtcattcgaaaatgttaatgttggaaacagatgatataaacaggttgtctaggaagctagaagagacaaaaataat

SEQ ID NO: 247255 - DNA, 435 bp, Homo sapiens
gtaactatttgggttgtgtagatttttgtggtttgcttttgctgttgcatgcgtgttgtcgtgaacatctcctgtaagtgtgccagaatttctccaggagtaaaaatgctgagccatcggttgtgcacatgtttaactttccaaagtggaccaccttccaccactgggtgagttcattttgcatccttgacagtacttaattttgtcaggcttattaattcttgccaatttagtgggctttaggcatgaactgtagttatgatttatctccagtctttttgttcatttttaccagttcacagggattcttcacatattccggataccagttcttgttggtttaatgtttgcagatatcttctcccatcaagaccaatgtggtttgtcttttcccatttttggtggtactttttgataaataaaaaactaacttta

SEQ ID NO: 247256 - DNA, 452 bp, Homo sapiens
atttaactttgcctccagcagctcaccataaaatttgggtccaaaaaggccaaggaatgtattatcagaaatgttagctatctctaggaaaatctgtcattcatttaagtgataatctttaaaattagcataactatattctggatcattttattacgagactatcatgtgatttcaatgtctgagtttattaccattgtacgagcaacatgctaagttacaactgtaactcccagggttggtttagcaggaaagtgatggaggcagacttaacagtgatgcgtgtagttcagcaaaggccaaatgacagcactgggagccataatggtggtttcctagtaattcaaacagaggaaagtagcaagaatacactgatctcagaataccaggcttgtcagactaaaaaatcctgtgctttaacagtcagtggttgacagcaacttatcctaagc

SEQ ID NO: 247257 - DNA, 766 bp, Homo sapiens
attcatatgttttaaattgcctgccttcctgagtagtgtgatgaaatctcacgttgtcctgctttgtccctcctgagacattaatcattcctttgtcgagtatctctaagctgtctatgggccccatccttccgtcacttagtggccgtctccattatctgatgaactgtcaaggtattgcagtgcttgtgttcaaggaacccttatttgacttaataatggccccaaagtacaagaatagtgatgctggcacattgttataatttttctattttatcacttgttactgttgttaatctcttaaggtgcctaatttataaatttacctttatcataggtatatatgtataggagaaacaccatggtatatataggattcaattctacctgcagttttggcatttgctgggagtcttggaacacagtccctgtgaatcgagggggaatgcctgtgtatatataattaataaaatagagatctagcaaatatcaaacaagtataaaagtactaaactttttgaaactgagcaagttaataattgttatgatttagttaaatatattttcatacctcatcaaatctcctataaaacaattgatttctgtataatacttaggaatttttaaaaagtaagagcgggctgggcacagtggctcatacctgtaatcccgtccagcattttgggaggcagaggtgtgagggtcacttgagcctaggagtttgagaccagcctaggcaacatagagagaccactgtcactacaca

SEQ ID NO: 247258 - DNA, 365 bp, Homo sapiens
ttccccaaaatgtaaaaatatctggggtgccaatgaaatggaaattctggtatgttgatgtcactgttgagaaagtaagtaactttgatttgatgactgaggaacaggtcctttttaaagtcagggagtcttaacagttctcagcatttagaaaattgaaggaggacctacttgaattgttagctgacaggtaatttaaaaagtttttttaatttttttttatgagatcagtatatgaattttggtctgtaattttgaagagcgtttgaagaatagagtggcaaagctatcacaaaaccgcttttgttcccaactatctatttgtattagcaagatttcttaatgcttctgtctccaaaaaggaa

SEQ ID NO: 247259 - DNA, 347 bp, Homo sapiens
tctgacaactttttgcttggacaaatggtggatgggaacacaggtgcaagagcactcatctgcaagtaaaggtgagattggcaatgcttgtttgccaacttgctggtttttatatagagtacatatttttcttcatgatcaagttaagtgtatactagagcagtggttcttaattggtgacatgtggaattttgtatggaatgcagggttttcataacttacttatcttggatccccagcgtacctacgagtatgacatgcaggctctgtttcatctttcctggattattcatctctagtatttattactggctttagtatttctgttgctttcggcagcttccacc

SEQ ID NO: 247260 - DNA, 390 bp, Homo sapiens
ggtagacagtgctgctcccagaccccagctgagaggagatggaactgcgtcactggctgcttcaccatccacagcctggactgagctgggtgggcctgctactggaagtacaggtgggcatggctcttcccacatccctggcttggcagatggtgccagttgcaggatcaagctctgcccaccattgagcagcccaggcatcatggagcctcagtactcttccttcgggccacatggcgcactccttggctagaccattcgtcaaccgcacccgaggttttctaaagttcctagattgagaccagaccttctcaaggatcttccaatcttatctgcccccatttcaggggctctcttgcataaatcaagtaataaataatgtgcaaccag

SEQ ID NO: 247261 - DNA, 957 bp, Homo sapiens
agacgctgcgcgcgggccacgcgcggcggcggaggctgcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttggtggacaagcgcaaccaagcctaaaggcaagtgctgttgcgaggtcgacatccaggaaccagaggagggcagagcaatccacagaatggatctggggtgactcatggaggaaaaccaacacacagtaccatttaattctttttaaaaagatggaaaattataccatacccagaattactaaattctaaatagagggtatattgcatttacatttgtaaaagaatgtttccccatgtatcttttaaaaattcattttaaagatatacaataaaaagtgtttaactctgtttttcaaaaat

SEQ ID NO: 247262 - DNA, 679 bp, Homo sapiens
agacgctgcgcgcgggccacgcgcggcggcggaggctgcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcaggaaagaaacatcctcaagtttcagtgctcaatatattttccgatcaagactacaagagatcagtcattacaatagcaacttctgttgataagttgggaataagactaaacatcagacatctatcttgaaccgtgaggaagaagccactcactgaggatgatggagccacactcaaaaggaccaagacagaaggacgatggagtcattataccagctccggactgctgagctccagatt

SEQ ID NO: 247263 - DNA, 365 bp, Homo sapiens
agctcggtaccccgagcgggtgggaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttggagacggagtctcaccatgttgcccaggctggtctccaactcctgagctcaagaaatctacctgcttgggcctcccaaagtgctgagattagaggcgtgagccactacccccagcagggaccca

SEQ ID NO: 247264 - DNA, 1143 bp, Homo sapiens
agacgctgcgcgcgggccacgcgcggcggcggaggctgcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttgggccttgctgaggatctggtgctgcatgttcctggctgcagcgtgtttctctttggcgaagctgacctgcctgagaagcgcagtcttgtgcagagaaggaagcagctgggctggttcacgaggagggatttcagtgctcttcagcctgacctgggagctgccccttcccaaagatgtggtttaacagtggacaagcgcaaccaagcctaaaggcaagtgctgttgcgaggtcgacatccaggaaccagaggagggcagagcaatccacagaatggatctggggtgactcatggaggaaaaccaacacacagtaccatttaattctttttaaaaagatggaaaattataccatacccagaattactaaattctaaatagagggtatattgcatttacatttgtaaaagaatgtttccccatgtatcttttaaaaattcattttaaagatatacaataaaaagtgtttaactctgtttttcaaaaat

SEQ ID NO: 247265 - DNA, 1058 bp, Homo sapiens
agacgctgcgcgcgggccacgcgcggcggcggaggctgcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttgggccttgctgaggatctggtgctgcatgttcctggctgcagcgtgtttctctttggcgaagctgacctgcctgagaagcgcagtcttgtgcagagaaggaagcagctgggctggttcacgaggagggatttcagtgctcttcagcctgacctgggagctgccccttcccaaagatgtggtttaacagcttgcttcagggcgttgtgacagttgtgttggaagaaaattggaatttcagccttgcagtgaggggatccgtgctgccaccagagcagctgagtgccaatctgcgggaggcgggagtggagcgaaactgcaaactgagaaacaaactttcacatcaggtttctaattttagagcaaaaagtggaattactttaattatatgacatttaactag

SEQ ID NO: 247266 - DNA, 1110 bp, Homo sapiens
agacgctgcgcgcgggccacgcgcggcggcggaggctgcgcgcgggccacgcgcggcggcgacttgggctgggcggtcgccctgccccaccgcccttcggcgctcgcaggtccgctcccctcccaaaccgcagagcggcaggcgcggccgctggttcgagagctcggccggggcagcgcagccgccggctgcccctcgctcccaggcgccacaaccccgcgccctcgccgctgctgcgtcccgcgagacctgtggggaggccgggagtcacttcgggttccctttcagcccacgtggtcctgggacactccacccaggaacctagtcggcaccgcgcagggaatcccagcagcggggttctggccccagcacgcgttgcggcagcctggcgagcgtccttgcggcctccaagtgccggtggggtgcgtgcgcagggggcagaaaaatcatgtcttcttccagagtggggctccgtttggctgcctgtttactaaacgtttcagaagccggaagaaaatacattgttgagaacatagcaaaagcagctcttcttgacaaaaatggaaagaaacatcctcaagtttcagtgctcaatatattttccgatcaagactacaagagatcagtcattacaatagcaacttctgttgataagttgggcagttctgttctggctgcctgcctagaggccttccaggctatcgatatggaagttcaagagggaatccacccttgcctgggagcagtggacttgattccgatttaccctctctctggtgtcacagtggaatagtgtggagtggtggccagaatggacaagcgcaaccaagcctaaaggcaagtgctgttgcgaggtcgacatccaggaaccagaggagggcagagcaatccacagaatggatctggggtgactcatggaggaaaaccaacacacagtaccatttaattctttttaaaaagatggaaaattataccatacccagaattactaaattctaaatagagggtatattgcatttacatttgtaaaagaatgtttccccatgtatcttttaaaaattcattttaaagatatacaataaaaagtgtttaactctgtttttcaaaaat

SEQ ID NO: 247267 - DNA, 741 bp, Homo sapiens
gccttgctgaggatctggtgctgcatgttcctggctgcagcgtgtttctctttggcgaagctgacctgcctgagaagcgcagtcttgtgcagagaaggaagcagctgggctggttcacgaggagggatttcagtgctcttcagcctgacctgggagctgccccttcccaaagatgtggtttaacaggttctgagcatggtttttgctttgctctgttttttttttttttttaaacttgaggtcccctttatgagccacaccctgttaatgcaggaagagttataggggtggctgcttcttgaaatgggtgaggctctcctttctgctgttactctcacccaggcccttttaagctaacctgtgagcctagaagctcccgtcaagtatttgatgagggcccccagaagtgatattcaagatatatcattagccctgcaacgtgatcactgatgaaaagaatgctcgtagctcctggcactggggcagggtcctggaggcccctgtctgtgaatggtgtggggtgtgtcctagggtgtgatggagacacctggagagggaggacttagggagagatcacttctagctggtaggaaggtctttcaatacttaaacatcagtgtagccaagttggtgcttacagctggaaatcagttctagaggaaccctggaaaaaagctgttctagataacggacttctagaatgcagagaccaaagactggaaaaagaaactattccttccc

SEQ ID NO: 247268 - DNA, 452 bp, Homo sapiens
ggatcttgattcgaacaaacttaaaaaataagaccatcagagaaatttgaacattgactaaggtttttttaaacgatattaaaaaactattgttaactatttctggctgcagtagtggtgttaacagttataattttaaatacaccttttagagatgcctacagaaatatttacagataaaaatgagatgatgcctgtgctttgcatcaaataatttgggggataaaggggatcagggtataagtggattgagacttgccatgaattgaaatgggagaatttgctatttttgtttctgtttaaaattttccattaaaagtttaaaaaatatatccaggaaaacagcctacttatgaaaagatatttaaattctacaaaattgttggtgaatatttaactgatctgagtgatgaatgagtaagtataaaataaatggataatatactaagaaa

SEQ ID NO: 247269 - DNA, 730 bp, Homo sapiens
ctcgaactcctgacctcaaataatctgcctgcttcggcctcggaaagtgctgggattacagatgtgagccactgcgctgggctctcatttgccaatttttaagttgggttatttgtctcattataagttttaggaattgtttatatattctagatatatgttccgtattggatatatgatttgcaaatgttttttcgcattctttgggttatcttttcactttcttgatagtgtgctttgaggggcaaaagtttttcgttttgatgaaatccagtgtatttttttcttcctgtttatacttttagtgtcataattaataaaccattgcctaatacaagtttatgaagatttactgctgttttcttccaagtcatatagttttagcttttacatttagttctttggttcattttgccttaatttttgtgtatgttgaggtaggagcccagcttcattattttcatgttgacatttagttgtcccagcaccatttgttgacaagattgttcttttcccctcaactggtcttgacacctttgtgggtattgatctgtttgtctggtctatgccagtaccatgctggcttgattactgtagctttgtagtaagatttgaaattaggaagtgtgtgtgtctttcaattttattctttctcaagattgctttggctattctgggtcccttgcatttccataggaattttaggatcagctcagcaatttctgccaaa

SEQ ID NO: 247270 - DNA, 783 bp, Homo sapiens
ctcgaactcctgacctcaaataatctgcctgcttcggcctcggaaagtgctgggattacagatgtgagccactgcgctgggctctcatttgccaatttttaagttgggttatttgtctcattataagttttaggaattgtttatatattctagatatatgttccgtattggatatatgatttgcaaatgttttttcgcattctttgggttatcttttcactttcttgatagtgtgctttgaggggcaaaagtttttcgttttgatgaaatccagtgtatttttttcttcctgtttatacttttagtgtcataattaataaaccattgcctaatacaagtttatgaagatttactgctgttttcttccaagtcatatagttttagcttttacatttagttctttggttcattttgccttaatttttgtgtatgttgaggtaggagcccagcttcattattttcatgttgacatttagttgtcccagcaccatttgttgacaagattgttcttttcccctcaactggtcttgacacctttgtggaaaatcagttgtctataaatgtaacggtttctttctggactctcgtttctattgtattgatctgtttgtctggtctatgccagtaccatgctggcttgattactgtagctttgtagtaagatttgaaattaggaagtgtgtgtgtctttcaattttattctttctcaagattgctttggctattctgggtcccttgcatttccataggaattttaggatcagctcagcaatttctgccaaa

SEQ ID NO: 247271 - DNA, 596 bp, Homo sapiens
aggtttgtgtggtttaagatgtctttctagatatctgggatataaagatattctcatatacttcttctgtccttcttatttaaattttaaattcaattgaaaattatttggttgggtgcagtgtaaagaagaaatagacttctttttttttcttcttagcatcgtttattattatgattttttacatcatctatatttttcccagggatccactatgtcaattttgtcatatatcaagtttccatactgtttggcagagaaaatgttggttcatcaacaccactgcctcttcctgcatagacagaaaaacttcattacccagccttccgtgtggttgtgttgagagccagtgcctgagctttgccaatgggaatgcgtgggagtgttataggtgcctaagagtaggtgtgtcttcatgtgcacgtgccccctctcatcctgcggccagaagcaaagagcctcaaatgtggagttgcataatggaagcagccaagatctccaagttgaaggagagcaccagggagagttctatgaccttcatcaattagtattatgagtgagaaattgctctgatctgaatgtttgtgtccccccaa

SEQ ID NO: 247272 - DNA, 439 bp, Homo sapiens
aataaactatgttctaactgccacaggattttttgtttttctcgagcagctaaataagcactggcctcaagacaggcactactgaaacaactgcagcccactgacagccagatgctgactaactcaaaacctcccctattcacaagccaaagcaacagttttgattggacgagagactgatttcagtaactttctcctgataagagatcatggaccatggactggttctggccggtttacagaggctgtgtagtgagtgccttcccatcttctgcttcacctagggcctaattgtaatgcacttaaatgttaagtctccaccccaaagtgaacatgggctgcatgtaacatgcatgtttactttccacacatgcatgtgaccccccttcatgaatattcacagcttatcctataatcattaaacatgtatacttagcca

SEQ ID NO: 247273 - DNA, 728 bp, Homo sapiens
catcttgaacttatttgtgagaacatttctcagtttggtttaaaagttgtcagtgacctaattttatgaagactttttcctccttggaactgacctttacaattggacagcattgctttttcttacaattctctttttcccgtaagcctgttattcagtcagatagggatgtctttgtaaaacctgtttttcaggaatgtaccgtttgagagtttaatttactgactcagaatcctatagagatcacagtcaggaataactcaaatcaaaattcttccctgcaaggccttgccccatgactcagtgtcctctctgttggtgactcattatcatctgtggccttccagccttgtcatcatcagattctacttccctgttgaaacttacatttcctgaatttcatatccttagggtgtattctctgcttctgaggaatcggccaactctgctctcttcttccccctgactgccccgcccgacatacacacacccacccacacacacacaagggaccctagaatgtaaccagcccatttaattgtctaatccagaggagtgattcgattattgggaatgtgtgcagctgagtctgctgtttcactagggaaatatttcgggatgagccaaggtacctaggatcagcctttagaccatgtcatgaaaatattagatggtatagccttgaaaacaaagaactgaagagaacttagggagacatatttgaccac

SEQ ID NO: 247274 - DNA, 515 bp, Homo sapiens
aatgatgggatagcgcctttattgtgggacaaactaattgcttaatgaatagccaataacatttcctcatactctggtttctctttggatcttataaaccctttgtcttttaccaaaaaaaaaaaaaaaaaaaaatcaaaaccaaaaccaaaaaacaaaaacatttccttatgtaaagggacatgacttttaaaaaatatgaatatttccacttttcttgtggttctccctcctgtccttctgtcttttcaaccagttgtcaatccttgcctcagaagagtttatgattctacagaacagcaaagaaaagcttttgggtttcaaaggtattgacttttatgttgtaaaaatctcaggtccaaagggaaagttgatgatataagagtaaggttcctgtttgcatccttttctcccactgcagggttggggaaaagaagccctctgcacaccagaattacccagagacatggaacacttagcactgcatcatatgttggccttacagaggtcctccg

SEQ ID NO: 247275 - DNA, 336 bp, Homo sapiens
gaaaattcagtagagaaaggactgactttaaaaagaaaaaaaaatggtccaggaggagctgagcacagtggtgtagctggccagtagtcccagctactcaggaggctgagacaggaggatcacttaagcccaggagttcacggctttagtgtgagtatgcagtgatcacacctgtgaatagccacctcataccagcctgtacaacatagcaagattctgtctctttaaaaaacaaaaaacggtgcaggagaatttggatatccatacacaaacagattattttagaccccttacctcacactatgcttaaaagtatactcaaaatggattccctat

SEQ ID NO: 247276 - DNA, 622 bp, Homo sapiens
ggccagagcctggggatcaaaggggaaataaccttgcaaatgcatcacagatgaaccccagagttcttgcatttctttatggggaattgtaaatctctgatacaaactaaacgctataccttcaaatggttggatacttggacaagaacttcttcagaatcaaatgaagcttcacttctttcagacatcagaacttcatgctatctctatccccactctacttacactcacacgtattgccttgacagaatttgagttgagactagaaaatattttgttttccagaatagcatactatgtaggaatataaatggttcctggaatgaaagtgattatgaacgggaagggccattcatttctagttattcagaagattttgagtttatcaaaggattagataaacctcttttaatttaataaatggtagccaatattagcaggatcatgagaattggagatacaatttggttgtcagtctgaaattatttcattttttctgaaattaaatattaatttagctccctgactcttattcactcagaagcccatttcaacttggttttcatgcaattaccacactcttgaaattgatctcaaatcaacacaactttgcaattgtaaa

SEQ ID NO: 247277 - DNA, 676 bp, Homo sapiens
ggccagagcctggggatcaaaggggaaataaccttgcaaatgcatcacagatgaaccccagagttcttgcatttctttatggggaattgtaaatctctgatacaaactaaacgctataccttcaaatggttggatacttggacaagaacttcttcagaatcaaatgaagcttcacttctttcagacatcagaacttcatgctatctctatccccactctacttacactcacacgtattgccttgacagaatttgagttgagactagaaaatattttgttttccagaatagcatactatgtaggaatataaatggttcctggaatgaaagtgattatgaacgggaagggccattcatttctagttattcagaagattttgagtttatcaaaggattagataaacctcttttaatttaataaatggtagccaatattagcaggatcatgagaattggagatacaatttggttgtcagaaaagacatgaaacatctattttccatttcaccttatctttaggtgaaattttttctgaaattatttcattttttctgaaattaaatattaatttagctccctgactcttattcactcagaagcccatttcaacttggttttcatgcaattaccacactcttgaaattgatctcaaatcaacacaactttgcaattgtaaa

SEQ ID NO: 247278 - DNA, 815 bp, Homo sapiens
ggtttcactctgttggccaggctggtctcgaactcctaacctcaggtgatccgcctgccttggcctcccaaagtgctgggattacaggcgtgagccactcgcggccaataggaagatttcatatttaagaagtctcaacttctagcatctctagaaaacccacaggacttggctatacctggtggccattcctgcttgagactagattgccagagctgagtagcggttgacccttttaggtgggtactgaggtctccatttgcagtctccaccaggtctgctttgcctttgctattgcagtatttgcctggcatctggcctggatcttatgctgaacctaatattcagacttctcaagtctgaaactttaaggaaaagaaaataaggaatgtaaatagtacctttcttttttaaaaaaatcattttactgtctctacaaaaataaaatcattcttattaagtcaaataattggtgaaggttaatgttagaacatgtagcattcattaactttgtcactgattgcattatacatatgggtgagccattgtttcttaataaaaatgggggtgagacttgctaagattagttacggacaatgattgatgaccagaactcatattttttactgtatttgtataagtagcagagaaatatagtaggtgcttcaagggttgcaagagtaaaatgccccttttctcaatgggagaaaagggagtattagatctagtaggaaattaagtaaaccaattactgtgattcaggctaggttaagataaatatcacgagtgaagtatgagcaaaggtcatgagggtt

SEQ ID NO: 247279 - DNA, 696 bp, Homo sapiens
ccaaggtcgccatttaattttgacacagaaccaaagtggcgagtacatttcctctccaaggtgaagcacaaggagaaactgatcactttgaccacaaggtattggcaatactggtgatcgatgtattctgggaaagatccttggcagataagtgctggtgaacagagaggtctaggagataggggtcaaaccatttttaggtgcttgagaatctcattcattcattcattcatttaataaatattgattccctctatgtgtcaggcagtatgttcaaggcactgggaatacatgagtgaacaaaagagaaaggtactcctgccctcagggagctcatattctagagggtggaaacacagaatatacaatacacttaaaaagtagtgaaaattgtatcatattttggaaggtagtatatgcaatttattagagaagaaatggagcagggtagggtgcatgttgtcggggggcctgtggtgcagtttaagtagggtgggcagggccagtcttgtgagtggaggacatttgagcacacacttcaagatgaggagtaggtcgtgtgggcatctggccctaagtgttctaggcagagggaacagccagtgagaacatggctggtatgttccaggaccaccaaggaagccactgtggctggtggagggagattctagtaagaggtgaggccagagtggtgag

SEQ ID NO: 247280 - DNA, 393 bp, Homo sapiens
tcatcataattttttctaaaaatacagtcagagaaaaacactcattgaaccctccactggaaagtagctgcaaaagaccccctgatcccaaacctgcttgacagaccacagccaagggcagggacactcaacaactgtaaacgaggaacatttcacagcggcagctggcccctctcttcttccaaccagccaatattttttgtctttctagaaaacctgtcttgttcaaaggcctgatggagctgattcggttgtgatcctgggcatatggatggcatatttgctgcgagctagccggcccccgctgctgcggacaaatctttcattcatgaacaggagcttgttaggccaactccggactctaaagccacttaattaaattgtggaaagtcg

SEQ ID NO: 247281 - DNA, 2357 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247282 - DNA, 2283 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247283 - DNA, 1073 bp, Homo sapiens
gtcatgcgtgcgctgtccttgctgaccgagccttcagtggacggagatgtcatgcgattgaacagcagatgagtggtcgcatctcgagagcattaaggcagtggggagcgcaggtgcaggactcgagactcagtgggacgacgatgtctggttgcctgatcctgtgataggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaaggtaagtaggggatatgtatccaggcaggaaacggaattccacacacatggttcagctgaagagattttaataaagaggctatttgcagaggtttagttaacggaagtttgaggctctagtgacagtaggaagtcattaccacccttaggcctgtagggacaaagggaggaaatggtttctagaacccactaatagctgaagccagggatgtgaagctgcccagagaggagctgttgtcttagtgtcataatcactgccaaaaccatggtggcagacgtgggaggactcacaggaaaca

SEQ ID NO: 247284 - DNA, 2559 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctgtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247285 - DNA, 3065 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatctttcttgtatccttctggaaacccatcattgcctctgttcagcaaacctgtctcctgggactctagaccgagcacttcttggactttgtctcctttgggactctgagcaacgctgatgggaagtggggcaagttttcatcaacctcaggttcagaaagaaggaaaagacttaatttgaaaggagggctggtggttcagtagaatctgatcagaagaaaataaaaagaggccaggtgcagtggctcacacctgtaatcctagcactttgggaggctgaggcgggtagattgcttgagtttaggatttcaagaccagcctgagcaacatggtgaaacccggcctctacaaaaagtacaaaaaattagccagacgtggtggtgcgtgcttgcattcccagctacgtgggaggctgacgtgggaagatcgcttaagcccagaaggtcaaggttgcagtgagctgaaatcgcaccactgcactccagcctgggtgacaaagtgagaccctgtctcaaaaaaaaaaaaagaagtgggctgggagagagctctgttccctttgagatgagttattaattcttggagccagccagttcttccttaatgcagtggcagttacctaatggtgtcctcagttgtgggcttctatagctctccactcttccggagcctgcggcccagatggcacgacactgccatgacgcaggtagctgggagggagtaagggaagctcccggggggtgtggatgggcactaggtgcctgcagctcttccaccctcacctctcctttccctgcttccacccagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247286 - DNA, 2323 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacaggctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247287 - DNA, 1879 bp, Homo sapiens
tgttcctgagttccctgttgcgctattacccgcacaagatgggcccagctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247288 - DNA, 2964 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatctttcttgtatccttctggaaacccatcattgcctctgttcagcaaacctgtctcctgggactctagaccgagcacttcttggactttgtctcctttgggactctgagcaacgctgatgggaagtggggcaagttttcatcaacctcaggttcagaaagaaggaaaagacttaatttgaaaggagggctggtggttcagtagaatctgatcagaagaaaataaaaagaggccaggtgcagtggctcacacctgtaatcctagcactttgggaggctgaggcgggtagattgcttgagtttaggatttcaagaccagcctgagcaacatggtgaaacccggcctctacaaaaagtacaaaaaattagccagacgtggtggtgcgtgcttgcattcccagctacgtgggaggctgacgtgggaagatcgcttaagcccagaaggtcaaggttgcagtgagctgaaatcgcaccactgcactccagcctgggtgacaaagtgagaccctgtctcaaaaaaaaaaaaagaagtgggctgggagagagctctgttccctttgagatgagttattaattcttggagccagccagttcttccttaatgcagtggcagttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247289 - DNA, 2850 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagcaaacctgtctcctgggactctagaccgagcacttcttggactttgtctcctttgggactctgagcaacgctgatgggaagtggggcaagttttcatcaacctcaggttcagaaagaaggaaaagacttaatttgaaaggagggctggtggttcagtagaatctgatcagaagaaaataaaaagaggccaggtgcagtggctcacacctgtaatcctagcactttgggaggctgaggcgggtagattgcttgagtttaggatttcaagaccagcctgagcaacatggtgaaacccggcctctacaaaaagtacaaaaaattagccagacgtggtggtgcgtgcttgcattcccagctacgtgggaggctgacgtgggaagatcgcttaagcccagaaggtcaaggttgcagtgagctgaaatcgcaccactgcactccagcctgggtgacaaagtgagaccctgtctcaaaaaaaaaaaaagaagtgggctgggagagagctctgttccctttgagatgagttattaattcttggagccagccagttcttccttaatgcagtggcagttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247290 - DNA, 2368 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagtcttgtatccttctggaaacccatcattgcctctgttcagcaaacctgtctcctgggactctagaccgagcacttcttggactttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247291 - DNA, 2060 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagaggccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247292 - DNA, 1192 bp, Homo sapiens
ggctaggtcgaggccgggtgttaatcggccgagctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247293 - DNA, 1901 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctggcgggggaaaaaccttaattggacttggccgggcaaaaacttaaccgggcccttgggcctggaaaaaaaagccgcttgcccgtttcccggtttcccccagggtttttgggaaaaccccgcccccggggccccccatttgggggggggaaagaaaaaaacggaccctgcccattggttccaaagcccgggaggaaaaccccagggttcttggaccccaa

SEQ ID NO: 247294 - DNA, 1942 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcaggtagctgggagggagtaagggaagctcccggggggtgtggatgggcactaggtgcctgcagctcttccaccctcacctctcctttccctgcttccacccagataattgggaactgtgtctgtctcctggtcctaagctcagcacttcctgtcttctctcgaaccctgggtaagtattgaaaggaggagataaaggaattggatttttttgagtacttactgatgcaaagcaggcactttatatacataatttctctaattcccacaacaaacccatgagtaggtattatccgcattatacagatgaggaaagcaaggctctgtaaagtgcctacactgagcttcagggtcaaagtacatacttttacatttgctacatcccactgcctctcactattacttgaactttttggtacagagagcacttttctaaatc

SEQ ID NO: 247295 - DNA, 1986 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagaggccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247296 - DNA, 1332 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtcgtgctcatgtgtgccatccacatcagagagagcatgcaggtaccgagctcgattaagtac

SEQ ID NO: 247297 - DNA, 1562 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctgggtatgtggcttcgtagggcttgggatacctgggtttccccaaggagagtagcccctggttccaggtgcttgctgacagcctcccatccctgcacagagaagaggcggaaggcttcagcctggcaacggaacctgggctaccccctggctatgctgtgcttgctggtgctgacggtaggtataccagccctagaggtgaggagtggaccctcagtacttgaggccttctcagggagaggggaggcaatgcagggacctggttatcatcagtaatagtggttgcttctcactgagtgcctacttttatgtcctgcctgtggtgagcacaaatgttgagcacatcaatccccattttgtagacgaagagacagagttg

SEQ ID NO: 247298 - DNA, 1219 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctgtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatctcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247299 - DNA, 1067 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaaggtaagtaggggatatgtatccaggcaggaaacggaattccacacacatggttcagctgaagagattttaataaagaggctatttgcagaggtttagttaacggaagtttgaggctctagtgacagtaggaagtcattaccacccttaggcctgtagggacaaagggaggaaatggtttctagaacccactaatagctgaagccagggatgtgaagctgcccagagaggagctgttgtcttagtgtcataatcactgccaaaaccatggtggcagacgtgggaggactcacaggaaaca

SEQ ID NO: 247300 - DNA, 1062 bp, Homo sapiens
actagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctgtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatctccagcagagcctaagcactgtgctatcctggaggggctttggaccacctgaaagaccaaggggatagggaggaggaggcttcagccatcagcaataaagttgatcccagggtttgctttgtttttttaaagtcgacctgtctctgtgtat

SEQ ID NO: 247301 - DNA, 442 bp, Homo sapiens
agtgagcaactgctggatgaatgtcattacgggcacaggctctgtgtcatctcctctcctagtgcttccacagccaggaccagagacctccctgatgactggggaacctggtgatggtggcctttctctttatggggagcctgagtatgctcagatcgcagctttccttccctagacattgtgtaattgggggtgggggcacacttgccccagttcctagctccagcctttcctcctcttaggatggctcaggatgagtcccccctcaacaaggcagctacccaagagtaattcccctggggactttctgtgtgaatctccccttccccctcctctcttttccctttcctggacccagccactgatgtaaccaacctcacagactagttgtttattatattaatagtttgagcatataaagaggaacttgtgatgggagaga

SEQ ID NO: 247302 - DNA, 340 bp, Homo sapiens
gtctggcaagtgactggctcttgtccctacagtgtgtactccactgggtctcgcccgcatgttctccgtcactgggaagctgctagtcaagccccgggtatgtggtattccttgctctttgatcctgcagggtgagcttcctgcagagctggaaccaaacaatgaaacaaccctatggttgtgtagtacacaacttgcagagagctacagcctttgttggttcctgtattctgtacccctatcatgcagagctggtcactagacatgcagggcagaatacagggcaattgggagggactgagcaaagctgcgggccacagggtggtgaatgagggtctgg

SEQ ID NO: 247303 - DNA, 814 bp, Homo sapiens
caacctatcagttgcagtgttgaaatgtggccaccaggaggcagcagaaagttgggctggtagcagaaaagggcctggggagcccacctctcatcctggcctttgtgcttcagggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttggtgagagggagtgagggtgcaggctagtggggggtggtaatcatctaggacactctggaacatggatcaccccagcaggggagagggtgtgcttcctgctttgtgggtaacgtacctcatccacacattctgtggcttggctgcctggtccctaacggactggacctttgacttgcttttgactgcccatctcctcttctccagggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatca

SEQ ID NO: 247304 - DNA, 507 bp, Homo sapiens
tactttattcgagtcacagaagtagggactggagagttgaagccaagtctgtctggctgcaaagcactctacggtattgtcttcctgtcacctgtttattttagtaaagacaaggaatgattgttagattttatcccaagtgtgtcactgtcaaaccctggcttatttctattcttgagttcatccactcaagaatacctgatatgttccaggcagtgtgctaggtctcgggattgaaaaggaaagtgagagatgggatcgggagcagcaaagaaggggcagaaggtcgggttcatgggtaaactgcaggcaggttgttaagtatgttgcccctttgtgcggatttaccttttatattcaaagagaagaaatggcttacataggttggctagtgagaagcactcaagggaagcaagcccctaccctgttctggccttgttcacccagaaacgctatttcctgtgttatggttctggccaagatttagctgaacagttatgctgctta

SEQ ID NO: 247305 - DNA, 711 bp, Homo sapiens
catcaatgcaatcttaacaaaccaagcatgttttctgaaccaacccatgttacaagctctttaattcacagacatttcttcagagtttttgggaaaattctattttataatttcaaagaaaataagaaaacaaaggaaccctaacagttttattggggacagagaaaaagaaagcaaaacaaacaaggtttagacaagactgacttcaattagctgtagacaggatgaacaagctacagaggttttggtataagaggtaaaggagaaaatggatatcattagccagcatcatactgctgggtttcaacttatcaccagagaaaatactaccacaaccttttatatatacatcaaatgtattacaggtcatcttgacaagaatatagcatttcagagttgacagtggtgcttgattaattcaaaaacatgaacaaattttaaaagggagacgataaattcatgtaaagatactgaataaccagatagaacttatttctcttgagacagaagggataactaaaattagtgtcaataattaaaaagtgaatgactaataacagtgtaacaaatcttttggcaagtcaggtggacgcaagtcctctttcaacaaaattgaagacagacctaattcagttgttagctgataggataaaaacattttgatgctaaagaactatgtaatttaacatataatttagaaacagctaagag

SEQ ID NO: 247306 - DNA, 319 bp, Homo sapiens
caaattaaaattttaaaacaaagcctgtttaaaagagctggatagctctttggaaatagttaagcagcaggatattaaaagtttgaatactggttcatgtttattaaaatcgcaagtaaagctataatcaaaaccaaaaactgctgcttggttcggcttatgacagggagaattgagtccacattgcatagcaccaaaacttcttgtcctaatcacttttaattactatttccctacttttaaatttagcttccctcaaggcttcagtagaaaaatgtgaaatccacagaagatttaaaactgggctcttccaaacact

SEQ ID NO: 247307 - DNA, 465 bp, Homo sapiens
tctggactcacaggtgcttttccctctgccagggatgctcgttcccaccttgcctggcggaggcctcaccgtccttcagacactcctgtgtctcttgcctggagaggccaccctgtgtggccactgcctgcagacctgagcatctcccccaccagactcagtggggcgggcctggtgttgcccactcctccttccccagtgccaagcatgtgcctgcctggaatgttgtaggtgctcagtaaacgcttgttgactgactgcgtgagagggaacagattgctcaaatgcagtgcgtcctggattttgggaacaggcactattctagtgccaagagcacatgagacggccaactctttcccgggcacgactcttgcagggcactgagcttcagctacaggagctgttgaaaatcatcgtttgttaatttcctggggtttctgaaacaaattaccacacgttcaatgg

SEQ ID NO: 247308 - DNA, 395 bp, Homo sapiens
agaacgcccaatgcaaaatcaagtatcttctataaactaggttggggaaatctgaatagccacacaaaggattttacaagtggattatttatcaccaaactccagtgtcagatgtgaaacgataaaaatagcagaagagatcacaaggaagaagctccatggcgtccgtgtgtgcaatgatggtctcaaagtgactgcaagaacacagtaaacaccatcaaaaatagagaatggaatcatatcaaactaaagtgcttcaccacaccatagaaaactcaacatacagaaggggcatcctacaggatgggagcaatgattggatcaccatacatctgttcatgggggaatagtcacagtacataaggaactcccaacaactcaatagcatgaaaaca

SEQ ID NO: 247309 - DNA, 476 bp, Homo sapiens
gtcgcccaggctggagtgtaatagtgcagtcttggctcactgcaacctctgcctcctgggctcaagtgattcttctgcctcaccctccccagtagatgggattacaggtgcactcaactctgcttggctaatttttgtatttttaatagagacagggtttcaccatgttgtccaagttggtctcgaactcttgacctcaaatgatccacccgtctcagcctcccaaaatgctgagattatagcatgagacaccgtgcctagccaagatcttttttgactaatagaatcatgacagcttaaccaatatttaacactgatcctttctctaagactactttgtgcgggttcctcagagattctcctactcttttcattcttgttaagcaagcagtctgaattcagctggttgcttctttctcagcccctagggatctaggctccacttaaaggttttctctcctgaggttccatttttt

SEQ ID NO: 247310 - DNA, 393 bp, Homo sapiens
caatttgtatagttaaaatagaaagaaaaagaaacctaccacttcggtgtaggatggagtaacctacagcaaatgaaagatcctgccaagaaaaactggaaaatctagattacggtaatttaaaaagaaaaaaaatattttaaatgcatcagagggctgggcgaagcaaaaaggattagaaagggccccactctggagagaggagaactgcagagaggtgagttgctaactagcagccacttatcccctgggggcccctcatcctgccactgggcagaggaaaagtcacttcctgggatgaccgcatctaaggccagctttcctcttttattcttcatcacaactgtctcagggcttgcactgcaatttgtcattaaatgtcagcttcattgc

SEQ ID NO: 247311 - DNA, 491 bp, Homo sapiens
ttctggccctctaatcatatgcttggtctttctggaatggccagcccatcccttgaaatgctctaagggcccaccctctgtcacctcattagtgcagactcagatgtggtcagaagtgactcttcacagataacaaaagacactcctgtcacccagaacattctaagagttttcggagttctgtgccaggaacaagggcaaaacccagatatattctttctaccacatccatgatttagataaaacttgggttcttgcaggaagtttctgaggatattaagatgttcatgaccatcctggctaacacggtgaaaccccgtctctactaaaaatacaaaaaattagctgggcgaggtggtgggcgcctgtagtcccagctactcgggaggctgaggcaggagagtggcatgaacccggggggcggagcttgcagtgagcagagatcacgccactgcactccaacccgggcaacagagcgagactctgtctca

SEQ ID NO: 247312 - DNA, 398 bp, Homo sapiens
aaaaagagacagaaagtttcctgtgtgtacatgtccaaaaaaaaggtacaacaaagcagaaaaacccttctgagggtgcataataaacaaaggactattttagggttctaagttgcagttggagtgtatgtataattgagtggttgggtttgcatatttaaaaaataaaaagtatttttagtagagatggggtttcaccattttggccaggctgatcttgaactcctgacctcaaatgatccacctgccaatcccagctactcgggaggctgaggcaggagaatctcttgaatccaaaagacagaagttgcggagagccaagatcgcaccacggcattccagcctgagtgacagagtgagactctggctcaaaatgaatgaatgaatgggataatgtt

SEQ ID NO: 247313 - DNA, 262 bp, Homo sapiens
agaggtctttttttttggaaaagagttgtgcatattatcttgtgatagtatttagttttagagttaaaaattttcttggaaggcaaggaactattatataatgctgtagcatttactttttgttgcttgttgtttttaaattccccacatttccttagaagacataagttgctttacaaattaatgaaacacacacacatacacacaaacacaataaaagacctggaacgtttcataacaatctgttacccttgttaagtat

SEQ ID NO: 247314 - DNA, 151 bp, Homo sapiens
ccagagaggccatcccagccccactagccctattgagcagacaggtgacagtagccatgcgagtgactcctggatggaccagcagaaggcctgcccctgctggcaccctacagattcataagcaataataaggcgttgtttttagttgcta

SEQ ID NO: 247315 - DNA, 383 bp, Homo sapiens
agttgatacactctgttgtgcagccatcactactacctagttccagaactttttcatgagcccgaaaggaaaccctgtgcctgttaaactgtcactgtcccctcactttcccctcctccaacgctggcaaatgataatctgctttctgtctttatgaatttacttattctgaatatttcataaagacagattgacataatatgtggccttttgtgtctggcttctttcatttagcatgtttttgagtttcatctatgttgtagcatgtatcagtatttcattcctttttatggctgagtaatgttccactgtatggatatacttagatctagttttaaaatgtattgtaaaaccataaatagaacaagtttacaaaaactgag

SEQ ID NO: 247316 - DNA, 563 bp, Homo sapiens
gggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaagctgagtggagaaggaaacagagtcttgtgaatcccctctgcaaggaacacctcatgacacagggaaagcttacaatgtagtggcaaatttttaaaaataaa

SEQ ID NO: 247317 - DNA, 227 bp, Homo sapiens
tctactttgatgggatctgcacatggaaaggttgatatttgacctaatgttgaacccaacatgactataaatcaaatcagacacaacactaacttccctgtggcactcttttgtgcatatacatgctcaggaaaatcagaggattctgggaatgatgcagaagcaacccacagaatcatcgagagcatacaggaactcagcctccacaattacgtcctttaaaaaaa

SEQ ID NO: 247318 - DNA, 621 bp, Homo sapiens
cataatgtgagcagtggggagtggctgtaaatacagatgaagcttcccttttctgtaaatacagacgaggcttccctcgctcacagctgcttacctcctgctgtgtggcctggttcctaacatgccatggacccctacaggtctgtgacctgggggttggggacccctgatttaaagcatttctttacagtaaaagtaatatataccaattttttttaaagggtagtgtacaggaagatgtaaaagcacctgtaattctacctgagaactactacttttttcttttttttttttctgaggcaggagaatggcgtgaacccgggaagcggagcttgcagtgagccgagattgcgccactgcagtccgcagtccggcctgggccgacagagcgagactccgtctcaaaaaaaaaaaattaaaaaaaatccaaaaattagctgggtgtgatggtgcacatgtttaatggcccaaggattgcttaaacccaggaggtggaggttgcagtgagctgtgattgcgccactgcactctagccctgtgctacagtgagagtctggctcaaaaaaataaatatatttaaaaaaatgcggcccaaatttcagctcacttggccaaattcgt

SEQ ID NO: 247319 - DNA, 412 bp, Homo sapiens
cttaattatatggatatattgctgggaataaaaaaaatttttcaaagtaaacatcctaataacctaccagaggggtttttggtggtggtgtttgccttttaatattatggcaaagttatacgtaaggagacttattacaagtctatttgggtttttgtgttcattttacttattctgaaatggttttttggctgctataatgttatacatacatacagtagtagtatgctttcagtagcatcatgtttttaaatctttgctattaatatactcaaataaccttaaagcaggtttataaaatcattctttgttcattttctacttactggtaattatcacatccttaaattttgaaacattagaatcttaccttaattacaagtaaactgccccctggtggcaatttttctga

SEQ ID NO: 247320 - DNA, 492 bp, Homo sapiens
gagacggagtctcgccctgtcgcccaggctggagtgcagtggcacgatctcggctcacggcaagctccgcctcccgggttcacgccattctcctgcctcagcctcgcgagtagctgggactacaggcgcccgccaccacgcctggctaattttttgtatttttagtagagacggggtttcccgtgttagccaggatggtctcgatctcctgacctcgtgatccacccgcctcggcctcccaaagtgctgggattacaggcgtgagccaccgcgcccggccggtattgactgttttcaagtaaaacagtcatgctttatgagctagagagtatttgctcttcttcctttgaaaagataacaatgttttctcttatacttaaagctgagaaactgagttattcctttattttcattagattataccaatcaattaagaaagttcagtaaaaatctagctttaattttcctgaaacctcttcttagaaaattttt

SEQ ID NO: 247321 - DNA, 374 bp, Homo sapiens
atatgtccaaactcttagaaattaacacacttctaaataatccatgtgttgaggaattctcaatggaagttagcaaacgttttgtactaaatgaaaatacaacacatcagatttgtgggatgtggttgaagcaatgcatgagggaaatttctagcattacctgcatatattagaaaagagggaaataataatgtaagcacctaccttaagaaactagagtaagaaaagtaaaataaaaccaaataagtagaaggaagaaaataataaaagtagaaattgatgaagttgaaagcggagaaaaaaatagagaaaatcaatgaaacaaaaagctgattctgtgaaaagaaaaataaaattgaccaacaagaatgaca

SEQ ID NO: 247322 - DNA, 434 bp, Homo sapiens
gagaccctagacaagttacttagtgcctcagcgtttgctttctttcttctgtaacattgacatcgtaacacattgttggtgttactgtagttattaagatgatgcacagggccttgcacatgcgagaggctcactgaatattatccctcttctctcctgctacgtttggaactgcccagccctccaagctgggtgcattgtttagaaatgaatctttgcaggctgactggttgaatgtcttaccattgtgcctcctatccctagtgtcactccctgttctgtgagatggatgagatgaattccctgctgcctagaacagtagaacttctcactgataaaagacccaggccttaccctaagggaattctaaaaagtcgtggagacagaaagaggctgttaggtgttgaggggtggggaggtggggaaggatattg

SEQ ID NO: 247323 - DNA, 495 bp, Homo sapiens
taattgcatatgccttagagtgagttttaaaagtgtaaatgttttgtgtgtaaaagcattaaaaactagtttcaacagcagtaaatacatttttcctttgtgaaaatgaagacccttacagtttaaccataaacttaaaatagctaatctaaaaacagacatgttactttactttttagtgagaaacaccaccaccaaatagaaacaccaccaccaaaaactgctttgggtattggatatttatgtgggttttttgtttgtctgttttttgagagaaggacttgccatatggtaggctggtctcaaactcctgggctcaggtgatcctcctgcctcaggcttctgagtagctgggattaaaagtgcacaccactgcactgggctaggatctttatgtttttatctcactttagaggatataggaaaaaagatatttggactacaaaaagggaatattgcagtaatataattaatctgtaattaagtaattcctta

SEQ ID NO: 247324 - DNA, 584 bp, Homo sapiens
  misc_feature (389)..(389): n is a, c, g, or t
cctgtctcttctttcttcctttctcttgccctctctcttactctcattttttttccggtctctaccttttaataagatgaattcttttaaaatcattcaattatttaaattttttatttaaatataatgccttggctttctgtcttcttaagaaaaggatgattgcattctctctttaaaaaaacagtattattcatttttttttccttttattgatttatttcctccccatgagccagtggtccttacaaatttcctacagggaaatttctgggctcgaaagctggtctgtaaactggccagggtggtgaggtgtctcttgtacctggaaaacagctgactgctgtggaaggggtgtcgctgtagagtggagtgggaggcgacagggncagttatctgttcaggcagtgtcatctcctgggtgggtcctttaggagttctccacctcactcaaagcctggaaccatgaagtctcctgtctcaaaaatgtccctgattatgaaatcattctgtgttcagagctgtctctaaaaagaaaagtgaaaaaaaaaaaagtcgacgcggccgcgaatttagtagtagta

SEQ ID NO: 247325 - DNA, 363 bp, Homo sapiens
cctcccaagtagctgggactacaggcgcccaccaccacgcccagctaatttttttgtatttttagtagagacggggtttcaccatgttagccaggatggtctcgatctcctgaccttgtgatccacccaccttggcctcccaaagtgctgggattacaggtgtgagccaccatgcccggctgagaatagattttttaataccagaaaaatatttgactttttcttgtaattattgcttctaataatttttaaatatgcagatatttcagaccctttacattaatcattaaaacaaacacattcctcacataagagacaaaaggtggacagttagaggaatattcccctgctccatttcttcca

SEQ ID NO: 247326 - DNA, 2021 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaaggtatttcatgtttctttacaagtaaaaaaaaaa

SEQ ID NO: 247327 - DNA, 1004 bp, Homo sapiens
tttcctaatagtttggactttttctattttcctgtggactctgagaagcctcaggaccatgtttattcagcactgaaacaagtaaaatgaagagaattgtgggccttacttaatcaaagactattcacattttcaccttaatttaggaataatattcctagaaatacatgttgttatgacgataagtagtattttttcaccagcactaaaagttatagttaaaatattttgctgtatcccagctacttgggaggctgaggcaggagaatcgcttgaacctgggaggcggaggttgcaatgagccaagattgtgccattgcactccagcctgggcatcaagagcaagactccgtctcaaaaaaaaaaaaaaatttgctgtaagcgaagactgaaatagcttctataggagagctttagaatgaagtcatttagaggagcaggcgaatcctaaccgcatctctctctttagctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccaggtaagaccatgcaacacttctgtgcaacagcagcaggtcagaatgtgctccaagcctgcagagagtgattaggctgagaggacccagaatctgagctaaggatctggaagcgttaagcccagagctttggcattttccttggaaatccatttgtcagatcaattttgggtatggt

SEQ ID NO: 247328 - DNA, 272 bp, Homo sapiens
aggtgactctaaggatcccgtatatgctgtctcagccctgtgcaaaccaggtaagcctagcatcctgcttgccctgatctggcaatttggaaatgactcaaagtattgaattttaaagattagagttttaggatactttcctcattatatttacactttaactacaaaccaagagtcttggccaagcacagtgcctcacacctataatcccagcactttgggagtccaggacaggagggtcgcttgagcgcaggagtttgagacagctatca

SEQ ID NO: 247329 - DNA, 6868 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatg

SEQ ID NO: 247330 - DNA, 6893 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccagagctctgaaggaacgcatctgcattcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatg

SEQ ID NO: 247331 - DNA, 6985 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatg

SEQ ID NO: 247332 - DNA, 4068 bp, Homo sapiens
tttcctaatagtttggactttttctattttcctgtggactctgagaagcctcaggaccatgtttattcagcactgaaacaagtaaaatgaagagaattgtgggccttacttaatcaaagactattcacattttcaccttaatttaggaataatattcctagaaatacatgttgttatgacgataagtagtattttttcaccagcactaaaagttatagttaaaatattttgctgtatcccagctacttgggaggctgaggcaggagaatcgcttgaacctgggaggcggaggttgcaatgagccaagattgtgccattgcactccagcctgggcatcaagagcaagactccgtctcaaaaaaaaaaaaaaatttgctgtaagcgaagactgaaatagcttctataggagagctttagaatgaagtcatttagaggagcaggcgaatcctaaccgcatctctctctttagctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatg

SEQ ID NO: 247333 - DNA, 4432 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatg

SEQ ID NO: 247334 - DNA, 4441 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccaggtgcaatatggtgcccctgcatcactgagcatgatccagggagggttcccgcttggcccccaatgcagatgaggctgtctggtggggcaggatagttgggggttcttggtcagggtccataagtgacgctgcatgggaggagatgagcaagtgccaggattggctcca

SEQ ID NO: 247335 - DNA, 3748 bp, Homo sapiens
atgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtacgtctgagctaggatgcctgtggtgggatcactgctggcttattaatcgatcgtcctgttgtatagcatggccattctatacttttctaagaattgagcactgaaagttggatttaaaataacccattccattatagtgcatataagatctcagctagtcactgatcaacttcactcgaacccggtaccat

SEQ ID NO: 247336 - DNA, 163 bp, Homo sapiens
ccatcaacaccaccatccaggatgtcaaccgctacctcctcaagagtggaggtgagggtgctgctcttcctgcctctgcatggacggtctctctagacccatttggagatgtcaggggtgacaggttgggctgtgaggcagggatgatacaaggcacagttgg

SEQ ID NO: 247337 - DNA, 118 bp, Homo sapiens
ttgagggctcattcggacctgctggcttagttaggggacctcttactctggaatcttatagtccaaaacggggaatgttctagacagagagattctaaattcacattaaaaaaagaga

SEQ ID NO: 247338 - DNA, 414 bp, Homo sapiens
aatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttagcaatttccatctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatata

SEQ ID NO: 247339 - DNA, 476 bp, Homo sapiens
ggtcccgtggcccccgggacggcctcggcccggagccccaggaaccgccgcccggcccgcctccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccgcctggacccttggcacttaataaagaagttcagtttgatgagaaaggtg

SEQ ID NO: 247340 - DNA, 418 bp, Homo sapiens
aagccccgagccctcccagcgcagatgttaactcacccccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccgcctggacccttggcacttaataaagaagttcagtttgatgagaaaggtg

SEQ ID NO: 247341 - DNA, 1181 bp, Homo sapiens
tcataaaataaaatcttaacaaatttcaaaagattgaactcatataaaagtatatttctggatacagtggaattaaactataaatcacttacaggagtatagctttttaaaatactcaaatatttaggaattaaaccacacacttataaataaaccatgagtcgaagaagtcacaatgaaaattataaaatattttgaattggatatgaaaaacctattttgaattggtgggaaaagatacatatccaaacctgtggtatgcagctgaaatagttcttaaataaaaattataactttaaatgattatattagcaaagaaggaaggaagaaaatcagttctctaaatgtcaattaaaagaagctagaaaaagaatggccaattaaacccacagaagatcgatacaagaaatgataaagacaggaacagatataaataaatgtaatcatagaggttagtaaacaccaaaaagaagtttttggaaaaatttaataaaatggacaaatcctttgcaagattgattaagaaaaaaagagatgggccaagcacagtggctcatgcctgtaatcccagcactttgggaggctgaggcaggtagatcacctcaggtcaggggtttgagaccagcctagccagcatggcgaaacctcgtctccacaaaaaattaaaaaaattagccaggaatggtggtgggcatctgtaatcccagctacctgggaggctgaggcaggagaatctcttgaacctgggaggcagagattgcagtgagccaagatcgtgccactgtactccagccactccagcctgggtgacagagtgagactccatctcaaaaaaaaatacaataaaataaagataaaatgcaaataatcataacagatacatagacattgctatagatcctacttatattgaaaagaaatacaaagatattgtaacaattttatgccaatacatatatattcagaggaaattgacacattcattgaaaaatataactcactgaaaccgaacaaaagacagaaaacatgaataggtttagatcatgaggaaattaaatctgaaattaaaatcatttcccaacagaaaacaccattccaagatggcttcactggtgaatttatctaacattaaagtataattttacacaaattattttagataataaggagcatgagagcac

SEQ ID NO: 247342 - DNA, 1127 bp, Homo sapiens
tcataaaataaaatcttaacaaatttcaaaagattgaactcatataaaatttttaaaatactcaaatatttaggaattaaaccacacacttataaataaaccatgagtcgaagaagtcacaatgaaaattataaaatattttgaattggatatgaaaaacctattttgaattggtgggaaaagatacatatccaaacctgtggtatgcagctgaaatagttcttaaataaaaattataactttaaatgattatattagcaaagaaggaaggaagaaaatcagttctctaaatgtcaattaaaagaagctagaaaaagaatggccaattaaacccacagaagatcgatacaagaaatgataaagacaggaacagatataaataaatgtaatcatagaggttagtaaacaccaaaaagaagtttttggaaaaatttaataaaatggacaaatcctttgcaagattgattaagaaaaaaagagatgggccaagcacagtggctcatgcctgtaatcccagcactttgggaggctgaggcaggtagatcacctcaggtcaggggtttgagaccagcctagccagcatggcgaaacctcgtctccacaaaaaattaaaaaaattagccaggaatggtggtgggcatctgtaatcccagctacctgggaggctgaggcaggagaatctcttgaacctgggaggcagagattgcagtgagccaagatcgtgccactgtactccagccactccagcctgggtgacagagtgagactccatctcaaaaaaaaatacaataaaataaagataaaatgcaaataatcataacagatacatagacattgctatagatcctacttatattgaaaagaaatacaaagatattgtaacaattttatgccaatacatatatattcagaggaaattgacacattcattgaaaaatataactcactgaaaccgaacaaaagacagaaaacatgaataggtttagatcatgaggaaattaaatctgaaattaaaatcatttcccaacagaaaacaccattccaagatggcttcactggtgaatttatctaacattaaagtataattttacacaaattattttagataataaggagcatgagagcac

SEQ ID NO: 247343 - DNA, 215 bp, Homo sapiens
agacctgcaacctggccctcccaagacaagctgctgatggctgtgggccggctgtcaccacaggaccctgatcaccctgagaaatgccagttggaggaagcaatatggtcaccctgtgtgagccataagtgagggtttatagcataatcctaatgaggaactttgtctgaagtctgaggctgagttacttcaactatttgaaagttggctacgat

SEQ ID NO: 247344 - DNA, 5113 bp, Homo sapiens
  misc_feature (33)..(33): n is a, c, g, or t
  misc_feature (36)..(36): n is a, c, g, or t
cactgtggctacaagtctatgctactggccggnagnctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagggccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247345 - DNA, 5406 bp, Homo sapiens
  misc_feature (326)..(326): n is a, c, g, or t
  misc_feature (329)..(329): n is a, c, g, or t
tccctatcctttttttgtgaatgaaaaaaggaggtcgcgagcggtacctgggactgcagcgccaggcgtcttcgcggcagcgccttcgccgcgggcccgggcgcgtagcggcggcggcctcgcccctctcccggcgcccctgcgcgccgcccgctgcctccgcagcccggctccgcgcgccgccgtgacattgggcgcctggcgcgcggggcgatgctgatccggaaggggcagcggctgcagtgcagcgcgcgcgtccgctcctgggcccacgtccggcctgggctgccctgccggagtttctgagtggccgcgagctggccggnagnctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagggccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247346 - DNA, 1132 bp, Homo sapiens
aggatgtggaccaaaatagtgccctgagggccaggggctgggccaggcatcaagaatgctcacctggccaaagatggggaacagggcctccggtctaggtggtttatctctgtgctctgcacagccctggacggggaacaaagcctctggcccagggtttatctctgggctttgcacagccctggaggaggagggaactgaccagcaggccggccccctggtcacaggaatcatgtccttcacctgccttcccataagctggactttggatcccagcccttaaaaccctgtgttgtttcttcctgcagacctggtcgagaacactacttcaggacagggaatagtgacaggccagcagagccccagaggcgaggtggcagtaaacaagaatatgcacgcgcagtggaccacttctgaaggtcaacatataactttctcatccctgacatcaactgtcatccctgtgagcagaaccaactaccaaaggagagaggagcctggagggaacacagagcgatgcaagcctggagaaaaggccccgatggcccccagaagacctcttcagacagcatgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacaggtagggacctggtaggccataactaagaatctggccaaagaggtcgggagcgccagcacggtaccaacaaaacgcgcgccacagcaaaa

SEQ ID NO: 247347 - DNA, 729 bp, Homo sapiens
atgactacgagttcactggccgatgctttacatgaggatacatgcctagcgatgactgcggcctccatgggggagcctttacttatcctgaggtggcacgcagaggtccccaaaactgctgccttcgagtcccactcttcctccccgtccccaggtgctggaacgctcccgagacgtggtagatgatgtcagcgtctctctgcgcctctgggacacctttggagaccaccacaaagaccgtcgctttgcttatgggaggtagggaaggcctctggccgcctgcagataaccaacagggtgggtttttccctgcttttcccaggaacaaagcacctctgtgaaatttcagctggcaagaagaagtggagaaaacagctctggcagagcctcatgggggctggggcagcctggtgcagtgaagggagcctgggtccgggatcaggaagcctggattgagttctagctctgtgcctagtagctctgagatgatgtttctcagctgtgaagtggtgaaaatggccatttctaactcacaaaatagctgtgaggccaaaacaagtcttgagctctaaagtggcacataaattggaggtattgtgattatatgttttgtgtcaagagcacgtgagcagatacctaagccaggtgtgggactgtacagggctggggtggggcagatgttccaggaccaggtaagctaccacttgtttctctgcccgtaaccttact

SEQ ID NO: 247348 - DNA, 409 bp, Homo sapiens
gagaccgactctcgctctgtcaccccggctggagtaggggtaggaaaggtacccattcccttttggagaggaccagattgagggaagctgagagggcagggaaggcctgggtccgggatcaggaagcctggattgagttctagctctgtgcctagtagctctgagatgatgtttctcagctgtgaagtggtgaaaatggccatttctaactcacaaaatagctgtgaggccaaaacaagtcttgagctctaaagtggcacataaattggaggtattgtgattatatgttttgtgtcaagagcacgtgagcagatacctaagccaggtgtgggactgtacagggctggggtggggcagatgttccaggaccaggtaagctaccacttgtttctctgcccgtaaccttact

SEQ ID NO: 247349 - DNA, 5504 bp, Homo sapiens
aggatgtggaccaaaatagtgccctgagggccaggggctgggccaggcatcaagaatgctcacctggccaaagatggggaacagggcctccggtctaggtggtttatctctgtgctctgcacagccctggacggggaacaaagcctctggcccagggtttatctctgggctttgcacagccctggaggaggagggaactgaccagcaggccggccccctggtcacaggaatcatgtccttcacctgccttcccataagctggactttggatcccagcccttaaaaccctgtgttgtttcttcctgcagacctggtcgagaacactacttcaggacagggaatagtgacaggccagcagagccccagaggcgaggtggcagtaaacaagaatatgcacgcgcagtggaccacttctgaaggtcaacatataactttctcatccctgacatcaactgtcatccctgtgagcagaaccaactaccaaaggagagaggagcctggagggaacacagagcgatgcaagcctggagaaaaggccccgatggcccccagaagacctcttcagacagcatgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagggccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247350 - DNA, 5292 bp, Homo sapiens
aaggctaggtacgaggccgggtgttcacccttaaaaccctgtgttgtttcttcctgcagacctggtcgagaacactacttcaggacagggaatagtgacaggccagcagagccccagaggcgaggtggcagcctgttctgttccacgcactcctttatctggaagcagtaaacaagaatatgcacgcgcagtggaccacttctgaaggtcaacatataactttctcatccctgacatcaactgtcatccctgtgagcagaaccaactaccaaaggagagaggagcctggagggaacacagagcgatgcaagcctggagaaaaggccccgatggcccccagaagacctcttcagacagcatgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagggccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247351 - DNA, 4783 bp, Homo sapiens
tgcatgaaaaagtcctataattttgctgagggataaactaaatatgtgagcatgttaaatacccatgtgaagcattgcctgctaattgccagagaggcagtgctgtcacggctttgtactggggaggtcactggggcctggcatagtagggaaagctttctggaagaaaaagggcttggagtggaccttgaaggagcttgatgggatttggccagacagagcagggcaggagtgggtggggattggcacccagatcctgagcagagtccctccagcctgtggaagaacaggcagcctccctccaccaccaacacaagcttggtttccttcttgaacctaccaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagggccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247352 - DNA, 3639 bp, Homo sapiens
gttctgcattggtgctattagcattgcctgtcggtctcagctcctggtgtcctggagctgcggctgccatgctcttgaagcctggttttccccagctgggagcgggtttgttccgtgccccgaatcttctgggttcaggaggaggctccgtggctccccttggggcttgttctcccagcttctttcaccagtcctcctgtgatgcttcttctggacagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247353 - DNA, 2845 bp, Homo sapiens
tgggtgacgtggcttgtggtttgaccgtggcttggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247354 - DNA, 1417 bp, Homo sapiens
gttctgcattggtgctattagcattgcctgtcggtctcagctcctggtgtcctggagctgcggctgccatgctcttgaagcctggttttccccagctgggagcgggtttgttccgtgccccgaatcttctgggttcaggaggaggctccgtggctccccttggggcttgttctcccagcttctttcaccagtcctcctgtgatgcttcttctggacagatgtgaccttcatcctggatgatggcaccatcagcgcccacaagcccctgttgatttccagctgtgactggatggctgccatgtttggggggccatttgtggagagctccacccgggagctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaatataaatc

SEQ ID NO: 247355 - DNA, 375 bp, Homo sapiens
gagcacaggtgagaaccacagcccttcccaggtggcccctggcaatcctccaacctgggtcaaaagcagctacgaccctaaattcatgcttagttactgacatccagcaatgcctaagggaagggtcaaagttcaggattagctgaccttgataagaacactgagtcttccaagtgtttactacacagatcctgtacccctagtcagacagcctaattgaaaccagcctcattgcaatgtgatcatgtttttaagcagcctgttctgttccacgcactcctttatctggaagcagtaaacaagaatatgcacgcgcagtggaccacttctgaaggtcaacatataactttctcatccctgacatcaactgtcatc

SEQ ID NO: 247356 - DNA, 950 bp, Homo sapiens
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcaaaaaaaa

SEQ ID NO: 247357 - DNA, 1047 bp, Homo sapiens
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtctgaggcagttgttcagggtgacttcacgtggcttctgagcaggtgtggttttggttggccctgttcctgggactcctgctctgtgtccatgagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcaaaaaaaa

SEQ ID NO: 247358 - DNA, 986 bp, Homo sapiens
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtcctggagcatccagatggagaggggcaatgccctggtgggctacgacgtacccacctgttttgtttccagttagacgtgggaaaaaccaattcaattataaagaatacatcttattccctgggcataggcaactgtgatgaaaatagcaacttacctttgggctagatgttttcagattatacttaaataaccgtggttagaaatttttcaatgcatgcttacctgccccacgcaggtgggctacgtcgtaacctctatg

SEQ ID NO: 247359 - DNA, 825 bp, Homo sapiens
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaagaactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtccagaa

SEQ ID NO: 247360 - DNA, 934 bp, Homo sapiens
attgcaagttgtcatgaagataagacagcattgtaggggtgaggtgaccctagattagacaggttggctgcagaaggcttctctgagggtgtaacacttgttttgagagctaaaggatgaacgggaggagcatcatgagtaggagggaggcaggagctttctggatagaggcagcagcgtgtgtaaagagcttggggcactagaagaactggaagataaatggtgtgactgcagaatgatgagtgagactcaggaggcacgacatgaggctggagaggtgggcagggctgtgcaggtctcagtaaggagtttgattttattcaaagtgccagggaccattggatataaattcttcataaactgcatgcagaagagagattaaaaggttggcagaaaggaataaaaatgaaactggaggaccaagctggtaaaaattgcccccaagggtctatcagaatcctaactcacttagaccaataagatcagtggttacttacgaacaatacgtttgaaaagacctatgaaaaaacacgtgaaatttggagtttctctgtctctcatgtttcctgtaagtaattcgctagatatagagactcgattagattttgattcagtattttaggcaaaaatattttttgggtggtactgtgtacttcctattttgtcacaatgataggcatataattatatgtttagttccccactttaatgatgctaaaattaattagtgagttcaggtgttatgcctgattccttcatcataaacttctccatcaagtttcaccaaatcattttaacagtgattaataatcattggctagatacactatttcattagagttgcaaaataatagttttcctagcatttcttctttatttattggctaattttctttgattaagcactttcctaaatggagtattcaaaaaaaaa

SEQ ID NO: 247361 - DNA, 328 bp, Homo sapiens
cggcacgagggtgtacaccatggaccgtggcctcatctcctacaaggggctgcaccccttccatgtggagaaaggagtgaaacctttagggcagcttgccccggccccggcccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggtgctttccagagcggcagaaggaatgctccggtgattaagataaa

SEQ ID NO: 247362 - DNA, 492 bp, Homo sapiens
tgcatctgattggtgaaacataaacatatccagaatctcagcttcaagggaatctggataatgtgattttcagctttccagcctctgcttcacagtatcctatacaccataatcgttttgtcccaacatatactgtattgcaagatgctaaggtttctgatgatgcaatgggatgaaataataattctaaaaattctggccaggaatgatggctcacgcctgtaatcccagtactttgagaggccaaggcagatggatcacttgagctgaggagttcaagaccagcctgagcaaaaggtgaaaccccgtctaaaaaaatacagaaaagaatagctgagtgtagtagcatccatctgtagtcccagctactggagggctgaggcgataggatggcctgatcctgggagattgagactgaagtgagctgtgatcacaccactgcattgtagcctgtccagccttggtgacagagcaagaccctttctcaaaaaa

SEQ ID NO: 247363 - DNA, 314 bp, Homo sapiens
tgtgtcaccaatcaagtaagcctgaagcagagtggatgttgatgacggtggctggactgccctgcgcacacactggcgtggctacggctctgcgtgaggcatccagtgctggacttagcagcaccttaaagaaatacacaagtacccggaaccttcctctctgttttgagtcttgtgctttatttttatttactagtgcctgttagtgcaccaatttcaatagtctttgaccattaaatgattgtaaaataagcagtatcagatatttaaatgtttagataacatcaagataaagtccagaaaaatacaggccc

SEQ ID NO: 247364 - DNA, 513 bp, Homo sapiens
gagctgtgtgaggtgtgacaccatagtcagttcacattctgctgccttgactctgaactaattcgaagtaggttagcagctacgtctatgtccgtacctcacccacggcacttggagacccatctgatgctctgagaatgattttttattcaaacagagattatttctttctagtcaagaaagtaatctaggttcatcagaaaaaatattaaggcataaaattaaaatcaattattatcccaatacctgaagataaatactgttcctatactagtcaagaaagtaatctaggttcatcagaaaaaatattaaggcataaaattaaaatcaattattatcccaatacctgaagataaatactgttcctatactaaggcgatttcatttctgggactcttttctttctgttggttttttgttgttgttgttgttaagggtaaaacaaagaatacatttcaattaccataattttcttagaagcagggaactaccctgtgccagggactgctcctg

SEQ ID NO: 247365 - DNA, 211 bp, Homo sapiens
cttttggcgccccctctggatacagatgaaaactgcagtccatttttaagtcgcctgttcataagttttcaggaagatgtaaaattcaaaaatgcttgcatcaaatcaacgggaaatgtataaatccccgtcgtttatgatgtaaaactctacatattagtatcttattgcataattgcattaaaagtatatttatacatatacgtatata

SEQ ID NO: 247366 - DNA, 402 bp, Homo sapiens
gctcttaatttattcttttctctcttttctacaattcatactaatgacttatttccaatacaataaacataaatattaaaataattcaaataatctaaattttattctatgaaatttataattttcactaaatttcacatgtaaaagtatcctcattagaggagtttttccaaactatttcagttactttttgtagaagaaaagggaaatgaggctaactttttaaatctatgtatctaactttttagcttgtaaataccaactcttctgagacactgaccattgctttacaatccctcagaattttgtatttactaatataatcttgtagtcccatataatgtcatcctttcctaccactctaagaaataactgggtttttttgttagattgtttctttga

SEQ ID NO: 247367 - DNA, 687 bp, Homo sapiens
ggaggccgaggcgggtggatcacgaggtcaggagatcaacaccatcctggctaacaaggtgaaaccccgtctctattaaaaacacaaaaaaattacccgggcatggtggcgggcgcctgtagtcccagctactcaggaggctgaggcaggagaatggcgtgaacccgggaggcagagcttgcagtgagccaagatcgcgccactggactccagcctgggcaacagagcgagactccgtctcaaaaaaaaaaaaaagaatttctgtaggagatcttccaaattactgcttacatacatgtatattctattacaaaaattacaccactcaatgtagtctaaattattgagagtaaattgtagccattcttttacatgttttctgaacttagttgccaataatcataatcattagcttttcaaggtttgctctgaaacttacaaaccatgcaaaagtgaaaacttaggcttaacatatttggcaatttaaatcaactaaattgaatcaatctaaatactgctttgcaaagtaaaaaaggaatcaaaatgacacataagacaatcactaatccctatatttttagggtctatttcaagaaatttactactacttcttaccagcctaaggactgtgtaagaaggaaatacagtatacatacagggaagccaactgttttaatgatacctttt

SEQ ID NO: 247368 - DNA, 583 bp, Homo sapiens
gctgagaagttctaccatataacatcagtaaactggagaaccaagaaagctggtggtataatcagtctgactccaaaggcctgagaaccaggggagccaactgaaattgaaggtctgagaaccaagagctctgatatccaagagcgggagaaggtggatgtcccagctcaagaagagagaaagagaattcaccctttctccatctttttgttctattcaggtcctcagtggactggatgatgcctgcccacattggagagggccatcttctttattaagtgcattgattcaaatgctaatctcttctggaaacaccctcacccctcacagacacatccaaaataatgttttaccagctatctggccatccttagcccagtcaagttgacatatataattaaccatctctacaaaaatacaaaattagccaggcatggtggcacatgcctgtaatcccagctactcggaaggctgaggcaggagaatcacttgaacccaggaggtggaggttgcagtgagccaagatcgtgccattgcactccagcctgggcaacaagagcaaaaccccgtcttaaaaaaaaaa

SEQ ID NO: 247369 - DNA, 330 bp, Homo sapiens
agaacatgccacttacttccttccagtctgggtgacagagacagagcgagaccctgtctcaaaaaaaaaaaaaaaaaaaagtaaagaaagaaagtattactgtgaataccttcatttaaaaagaagaaataaatcaatatttggaggccaacatttggcctcctagaacatattagaaagtacaaagattagcagacagataccaatattggaaagtataaagattagcagacaaagataccaatacaaaagtacagaccaatatcccctctgagcatagatacagaaattttcaacaaaatgctaaaaagctaaatctgacatcatatt

SEQ ID NO: 247370 - DNA, 399 bp, Homo sapiens
cactcaagagaaattagttctattttccttcttccctctagtttaataatttaaaaaattaaatcatgcagccataaaaaagaatgaaattatgtcctttgcagcaacaaggatgcagttggaggccattatcctaagcgaattaacacagaaacagaaaacctaatgccgcacattcttacttataagtgggagctaaacactgggtacacacagacacaaagatgggaacagtaggcattggggattcaaaaaggcagaagagaggaaggggggccaggtttgaagaactacttgtgttcactacttggatgatgggatcattagaggcctaaacctcagcatcatgcaatatacccatgtaacaaacctgtgcccgtaccctctgaatcttggata

SEQ ID NO: 247371 - DNA, 236 bp, Homo sapiens
aaccaatgttttgcttgagtgtaccaagcaaggcctcttgagatgctgggacacaaaggtgaattttattttcccttttgcctttgagtagttaactgcctagtagatgagatactggaggtaagagaatgaagattataggatatttaaaggcatttatcatacatatatgtgttatgtttataatgtgctatagaaggacatattaaagttgaagtttctaatattttagatta

SEQ ID NO: 247372 - DNA, 484 bp, Homo sapiens
tcctatagtattaaaggctaataaaattattttaaaatttttaaaagaaattagtacttgccaatatagataaaactaactacaaacaaaataaagaatacatgcaaattctaaaaataaatgtgactataaagttacgggactgatattcatttttggtctgtggaattactctaaatcaggtgacataatcactgttaagggtaattccagaaaaactgactgctctttgtttgggtacatgaaatattttccttccatcacagtatttgttcactgacaagttccattttactcaacatgaagtatgtttgaaaacttacttagaacatctaactcatcagaatttgaatttcttgactctataaattttatataggtctttagttctgtaaatttgaaatttcaaatactgagttttcacatacaaaaaagaatatttttgtattgaaataataaaagctaacattattataaaataaat

SEQ ID NO: 247373 - DNA, 1128 bp, Homo sapiens
taaataaaaataatggaatagctaataatgtacttgatgaccatataccaagaactggactaagtgctcactaaacttaaattttttttcatttaatcctcacaaaaactgtaagaagtagttgtaatttattttatagaaagaaaatagatcacacagctactaagtggcagaacttgggtttagaaccgaggtttgatgcgtcttaacattgctttccttataccgcaattgattattcattagagcatctaactccctccctgtctctttggtttttaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggaggtgggaagacaggattgagtttatatgtaaagttcttctcttcatgataaagtaacctgtatgtatatatttttttgacagaccttttcagagtcagcaatacaaagcaaagtacttggtcttttggtaaggtgaattgttttgaattaattttaattgcttaaaagcaaaagctaacacttatatagtacctactatatgctaggcagtattgtaagcaatttacatgtataaactcatttaatctttacattagccctacagagtaaatactattgtatatcagttatctattgttgtgaacaaactatagcttagtggcttaaaacagtagccatttaatttacttatgaatctgtgggtcagtagtttgagctcagctcagctgtaaagttcttctggtctgtctggtctcatgtggggtcacttatgtagctgcagtcatctggtggcttgactggggctggagggtctaagatggcctgactcttatgtctgacagttggtgctgcttaccagctggcgggctttgtgtccacaggcttctccacatggcaatctctagagggcaggccccactgtccaagcgctttttaaacctctgcttatatcaccttgctaatgtttcataggacaacacaggttatatatttaagcccagattaaaggcagtaaagtcacatt

SEQ ID NO: 247374 - DNA, 521 bp, Homo sapiens
taaagcacaccagatgtgagtcactagaaaaacaaaaccaaactcttcaaatgagtaggagtgaatgtaagaattctaatgaatcagcccagggtacacagcctaaatgaagtggaaaaagctaggggaggtttgctaagggggtgcatttgactcttgcgtcctataagttgggaatcctttgtcagcagttgtaacaggcatgctcagctgcaaccacaaacattttccaatggaggagtgttgatagcattttcattgaccttaaaaaaataaaaaatctaatggcagggtcaaggggaaggcaagaggtgtaatttgctggtcagtctcagtcagccgcctgcagcagcctcgtcctgtgtgagactttaagggaatgcacattggcatggggggttcccaggcggaggggggcccagattcagccttggcctcatagaggagcaacaaattgaaacaagagcagccctgttgaccttcaaactgcaaatggactgctttctttgtgccatgtcgcc

SEQ ID NO: 247375 - DNA, 428 bp, Homo sapiens
ctttcctagtgccaaattgtaacaggaatttaatctatctaaatacagggagcagtgatttacataataaatgagataattattatttaataaagatttagagaattctctagattcctgtgttcaagaaggagggcctcaaagctgcctgcagttatatttttatgataattatttattactatctcatgacttaaaaattttcttaacaagtaaaataactaccttttaaaaaatactgtaagaccctttgctatgacctcagataatttaaagtgatgtctcacagacctttatttagactgaaaggcttataaaaattttgtgtgtgcctgtaatcccagcactttgggaggccgaggtgggcagatcacgaggtcaggagttcaagaccagcctggccaatgtggtgaaaccccatctctact

SEQ ID NO: 247376 - DNA, 1834 bp, Homo sapiens
  misc_feature (1830)..(1834): n is a, c, g, or t
cagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcgggtgccaccgggttccccaggggaatacatgtccccagctctgggaggggtttgctactggcctcctactttcctccctaggtggacagtgctcctctagagagctgcgactttaattaaaaacaacaggaaaacagaaaannnnn

SEQ ID NO: 247377 - DNA, 1700 bp, Homo sapiens
  misc_feature (1696)..(1700): n is a, c, g, or t
cagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggacagtgctcctctagagagctgcgactttaattaaaaacaacaggaaaacagaaaannnnn

SEQ ID NO: 247378 - DNA, 599 bp, Homo sapiens
tacatacagtttcagtttccatcagtgacaatccagtcatttccaagataggaacacacctaccaaggtggctcttaccaagtagggactgaaataagactatcttctctcctaccccaagttcagactagcctacccacattttcctgagtattagctcatttcagttgaatgcttgtccccactaattataaaaataatgctcacttttttttttttttttgagacagggtctcactttgtcacttaggctggagtacagcggcatgatcaaggttcactgcagcctcaacctcccaggctcccatctcagccccccaagtagctgggattacaggtgtgcacaccaccttgcccaactaattttttttttttttttggatagaaaaggggttttgccatgttgcccaggctgctcttgaactcttgagctcaggcggtctgcctgctcatttttttaaatttgaaaaaactaaaaagtgcaagcattttaaagcatccatgatcttccagccaaagattaaaacattacaaggggtcataccatcatctttcctatgaatctgaccataactgtgaaaatatttaaatttgtatag

SEQ ID NO: 247379 - DNA, 800 bp, Homo sapiens
tatctctaacattaggaatgctggaggtgcattttaagttttaataataagtgctagaatgaccaaattgcagactaattgtttccatattgtacttaaaatgagtttttaaaagtgaaaaagaaatgactatatacaatcaatgctatttattgtacctctgggcctactcttctaaaaattgtagcttatcgatttttctctgtcaagcttgaactaatgtaaataattgaaataatgtaaagttatattttcatgtttttatagatacaacatgacaagaatacataatgtaagagtatttcaactatggataatgttgattggataatgcacatctcagttacaagcagtactcatagtttaatatccatgtaacggtgcatcaatatattgctatataaatatgtctgtgtgcatataagtgaaaagtggtcaaacaagagtgatgacagctgtctaaaggtttttttattcattttatataaaaactgttatggaaagaccaaaatgtttatgaactattcttatgtaaatttacaattgtcctttactgtacttttttgtttacagtatagtaccttattttctgctgtgttaagtgggtgtcaaactccaagaagacatacactttctataacttctattgaagatattggaatttccaatttttcatgtgtactatgtcagaaaatgctttcgattttatttttaaatctaacatcggatggcttttccggagtgttgtaaaaacttcaatcatacataaaacatgttcttacaaaaggcaaagatcttta

SEQ ID NO: 247380 - DNA, 114 bp, Homo sapiens
gttcagttggcctgctggagaaagtaagaaccaaggtacagttgttcaaaggagcaaattatagtgccaggtgcagtggctcacacctgtaatcccagcactttgggaggctga

SEQ ID NO: 247381 - DNA, 733 bp, Homo sapiens
tcagtaatatttttcatgtataaacattgtggagactattgtagttgcttgtacaatactggggcattggtgatatctgtctctttactattgtagctcctgcctacgcctttagtaactgctaaggtgcagactgtagatctggactgtctgtgtctgtggctcacaacctcaacttctctgctgcctttgatttgctccctctgcagttttgttttctctgtactccgattgcttctcccatgcttctctgctttccaaagaaaaaactgaccttgtatagatcctgtcagctgattgcagtgctcttaacttctccattgtgagttgttcagtctgaggagtaggtataaacccagagtggtattctcttttctgttgtgtttggttttgcttacatattcaggagctgctctttacccccagaacatccgtatatatgtttttttctgtttctagatttaaaaatattccagaagcctggcctcaagatagataatattttacttttaatttggtgcccttgttttagagatttgaactggattgcatttagtaaaccaaaccccatctttaaaaaaatcatcttaaaaaaaaatagtgggccggacatgatggctcacatctgtaaatcccagcactttgggagactgaggtgggaggactgcttgagcccaggagtttgagaccagcctgggcaacacagtgagaccttttgtctacagaaaaaaaa

SEQ ID NO: 247382 - DNA, 231 bp, Homo sapiens
gggtctcactctgttgcccaggctggagtgcaatggcgtgattacagctcactgcagcttcgacttcccaggctcaagtaatcctgccacctcagcctcccacaggaatgcaccactatgcatggctgattttttactttttgtagacagagtctccctatgttgcaatggtgagctgtaatcgcaccactacactccagcctgggtgacggagtgagaccccatctcaaa

SEQ ID NO: 247383 - DNA, 398 bp, Homo sapiens
cactcccccaggccagggccccacttggagtcatggtaccatatgaaggagacccatgaacagtggagaaggggctgggtatgttcacctcccagccaccccaagggccttccaccacagtgtgcccccctgcttcccatgatccttgtatggggtcctcaggtctttgaatggttcctccagctccccccacccccctcccagtaatgaaaatcataaaccaagcgcctcctggtcagagccctgcagccccttcaccgctaaatgggaataaagttagaaccgtcctcacgaggttggtgtgaagataactgaggtaatgcttggacagccccgaaccacagggcctggcatacagtaaatgctcaataaatgttggctactattattactactgt

SEQ ID NO: 247384 - DNA, 280 bp, Homo sapiens
tgctgaattgcttctgtgagttcacttttcagttctaaggaagaataatatttgctacatatttcacaggggttcttatgaaggtaaatttaccagattaataaaaatttatgaatattaaaattatcattaataatataaaacacttatttgagattaaattaaatttttcatgagcccctctttggcaggaactctgtttaattctttgtatttatcccagcttcttaaatggtggctgtaacataataaatgtttaataaatgcttatatgaatgga

SEQ ID NO: 247385 - DNA, 308 bp, Homo sapiens
aggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattcccccca

SEQ ID NO: 247386 - DNA, 596 bp, Homo sapiens
tttaaaacattttatttcaaagttgagcactgaaggttgaacataatattcctttttgctagaccatatgttcttccaggaaagaaaatgggcctatttagtgtggaatttccagtttttaacagagtggcttgtacttagtaggtattcaataaatgtttgttaaatgaattacttttccattttatgctacattcagtccaatttttctactcactaaaatctctattctattgcaggtagttattttataaactgaattcataatactatcctgtgattgccaaagaatgtggttctgatgagtggacaagtttcagcacattttaatgtagtgattagtaatgctgaagcttacataaggttttattgacattatacatatgcatatgtgtttatacagatgtttacgcacaaaacaggctatagattctttagcccgatttgttgaccccactgatttaaacaaagataatacaattcatttttgtatttgctatggacaaggggaaaaattcatttttataataattaaacaagtgtttgataagtaatattataggataaacatttacattttagtgacagtattctca

SEQ ID NO: 247387 - DNA, 607 bp, Homo sapiens
agagtgaatcactgggctgccatagggatttagttggacacagtgggtggccaagtcgtctctgctcctcttcatggtagtgggggctgctctctaccatctagacccaccctcatgggaaaggccgcagacccttactcagcctgtgggacaccaggcagagtcccttgcagctgatggtgagctgaggtgcactgtatttctgccacagggatttgttaatgatttactttaaatgtccacctgcagggtagctgggacgatgaaagcatcccaagacctcccttttccatctgtggctgatcacctctggaacccacagctagccggctgctcctccactatcagatggcggctgtcagtcatgggcttgtcaccgagtgcatccgtcatgctcgggccatgggccggcacctgtgtgtgtgtgtccagcttaacgacagagatttttggaaagacgccctaagatagacatacttgaaactgagtgagaataagtttgacttatttctttttgagatactttatatgtttgaaataattaatagctggcgccagtgaatctagtttctgtctgtttcctttaaagattatatgtagtgttggt

SEQ ID NO: 247388 - DNA, 445 bp, Homo sapiens
ctgcccaccggaaacgatggcgcgaggccgcagagctaaatgggggcctctccagggagtgctctgttcacggctccatcgctgttaggtagctgggacgatgaaagcatcccaagacctcccttttccatctgtggctgatcacctctggaacccacagctagccggctgctcctccactatcagatggcggctgtcagtcatgggcttgtcaccgagtgcatccgtcatgctcgggccatgggccggcacctgtgtgtgtgtgtccagcttaacgacagagatttttggaaagacgccctaagatagacatacttgaaactgagtgagaataagtttgacttatttctttttgagatactttatatgtttgaaataattaatagctggcgccagtgaatctagtttctgtctgtttcctttaaagattatatgtagtgttggt

SEQ ID NO: 247389 - DNA, 470 bp, Homo sapiens
gaagaattttcctgtgtagttgaaaaccgattgcaataaaatgtaatatttaatagtattattcaattggtagcacataactccatatttacactgattgattttcttcaattgcctaaccgcctactaggttcagatttttccatgttaattttgatttagtatttttatttctgaaagcaaatagggagcaaaccatatattatcgctgcatgtttttttcagaagctagtgagaacctcggaatctataacaatgaaataatgtgaaggtaaattaccataatatacaaggggatttcatatcctagcaatcttctatagactgctaacttgaatcatacccatgtgcaaattatctatatactacgatgtcagaaaccataaattgagtttctactatgttaggaacagggcatttttctgatatattcaacgtgctttttctcctaatatttataagtatttagg

SEQ ID NO: 247390 - DNA, 371 bp, Homo sapiens
tcctcactttaccttctgaggtcatcacatatccaaatatctaataaattttcctctacctcccctgcatcagccaagacataggtatcactctttcaaaagaagacatgaaaataacctgctttggattcagtcacattaccccagggatggtgtatggtctctccacccacctctgaaacttaccttttgcattttgcttttggtcctggcaatgcaccctacaatcctcagttttcattaacaactaatatccacaaggcactggagtatattgcagttggctcaatctttctagagccctagactgaatgttaagaaacaggtgatttttttcccctttccacctacttttatattcacataatctt

SEQ ID NO: 247391 - DNA, 1049 bp, Homo sapiens
cggggtttcaccactttggccaggatggtctcaatctcttgacctcgtgatccgcctgcctcggcctcccaaagtgctgggattcacaggcgtgagtcaccgtgcctggcctgtctctttaatcaaatcacatctcatatccagcagtcatagatgagtatgctagaatcatggactgcttggaagtcttttaatctggtgtttacctactcatccgttggtggaaatttgggctgcttattaattattaattatttttaattattgaataccagatctggtttctaaatggaatgaagactaccagctctcctcaaactaattgattattgaggtgtgtttcttttccttccctggtgatgtgcaaagagaatgaaaagggaaaaggggccaggaaggagatgttttttctccttcattcattcaacagctaatcttgagtaccaactgtgtacaaggcactaacctagatgcctgggacacataaagaacaagtagacaaagactcctacccttaatcattgagttttattctagatgggggagagggtgacagataataaacaatagaattcataatatgaattcattggagagtacaagaaaggtgaactgtagggggaagagagcaaggtaagggggtgaaggagtgttggggagattgggattgcaatttcagaaatggtagtgttatgaactgaatgtgggtgtctcccccaaatttgtatgttcaagacctcactctaatgtggctgtatttggagatggggcctctaaggaagtaactaagatgaaatgggttcgtgaggatgggcactgattcaacaggattagtgttcttatgaggacagacaccagagttctccctctcactttcttcccacacgcatgcactgaggaaagtctgtgtgaggacacagcaaggaggctgccgtccacaagctgagaagagagccctcacaagagatggaattgactggagcctcagtcttggactttcagcctccagaacagagaaaataaatgtgtgttgttaagccaccaaaaat

SEQ ID NO: 247392 - DNA, 1074 bp, Homo sapiens
ttttttgtatttttagtagagatggaagagacagagtttcaccatgttggccaggcaggtttcaaactccagacctcaagtgatccacctgcctcggcctcccaaagtgcttagaattacagctgtgagccactgcgcctggcctctatgtttaacttttgagaagtctcttgattcttgccactacgaggtgattttatccaactattacaggaaagaaaatgggagctcagaaggttggactgcttgttcaaagtcacctagctagagagctgcgcagctggaactagtatacaagtctagctgttgaaagcaccctgagcacgttacagctctcctcaaactaattgattattgaggtgtgtttcttttccttccctggtgatgtgcaaagagaatgaaaagggaaaaggggccaggaaggagatgttttttctccttcattcattcaacagctaatcttgagtaccaactgtgtacaaggcactaacctagatgcctgggacacataaagaacaagtagacaaagactcctacccttaatcattgagttttattctagatgggggagagggtgacagataataaacaatagaattcataatatgaattcattggagagtacaagaaaggtgaactgtagggggaagagagcaaggtaagggggtgaaggagtgttggggagattgggattgcaatttcagaaatggtagtgttatgaactgaatgtgggtgtctcccccaaatttgtatgttcaagacctcactctaatgtggctgtatttggagatggggcctctaaggaagtaactaagatgaaatgggttcgtgaggatgggcactgattcaacaggattagtgttcttatgaggacagacaccagagttctccctctcactttcttcccacacgcatgcactgaggaaagtctgtgtgaggacacagcaaggaggctgccgtccacaagctgagaagagagccctcacaagagatggaattgactggagcctcagtcttggactttcagcctccagaacagagaaaataaatgtgtgttgttaagccaccaaaaat

SEQ ID NO: 247393 - DNA, 503 bp, Homo sapiens
ttttttgtatttttagtagagatggaagagacagagtttcaccatgttggccaggcaggtttcaaactccagacctcaagtgatccacctgcctcggcctcccaaagtgcttagaattacagctgtgagccactgcgcctggcctctatgtttaacttttgagaagtctcttgattcttgccactacgaggtgattttatccaactattacaggaaagaaaatgggagctcagaaggttggactgcttgttcaaagtcacctagctagagagctgcgcagctggaactagtatacaagtctagctgttgaaagcaccctgagcacgttacctcatgctgtaccttgcatgtcttgttgtttccaattttcagatgaagaaacagttccacacactaagagacttaacgagggtacagttagtttcaggagagctggtagttttcattccgtttagaactggacctggtaactgttgattatcctaataaatgcacttcattta

SEQ ID NO: 247394 - DNA, 1160 bp, Homo sapiens
ttttttgtatttttagtagagatggaagagacagagtttcaccatgttggccaggcaggtttcaaactccagacctcaagtgatccacctgcctcggcctcccaaagtgcttagaattacagctgtgagccactgcgcctggcctctatgtttaacttttgagaagtctcttgattcttgccactacgaggtgattttatccaactattacaggaaagaaaatgggagctcagaaggttggactgcttgttcaaagtcacctagctagagagctgcgcagctggaactagtatacaagtctagctgttgaaagcaccctgagcacgttacctcatgctgtaccttgcatgtcttgttgtttccaattttcagatgaagaaacagttccacacactaagagacttaacgagggtacaagctctcctcaaactaattgattattgaggtgtgtttcttttccttccctggtgatgtgcaaagagaatgaaaagggaaaaggggccaggaaggagatgttttttctccttcattcattcaacagctaatcttgagtaccaactgtgtacaaggcactaacctagatgcctgggacacataaagaacaagtagacaaagactcctacccttaatcattgagttttattctagatgggggagagggtgacagataataaacaatagaattcataatatgaattcattggagagtacaagaaaggtgaactgtagggggaagagagcaaggtaagggggtgaaggagtgttggggagattgggattgcaatttcagaaatggtagtgttatgaactgaatgtgggtgtctcccccaaatttgtatgttcaagacctcactctaatgtggctgtatttggagatggggcctctaaggaagtaactaagatgaaatgggttcgtgaggatgggcactgattcaacaggattagtgttcttatgaggacagacaccagagttctccctctcactttcttcccacacgcatgcactgaggaaagtctgtgtgaggacacagcaaggaggctgccgtccacaagctgagaagagagccctcacaagagatggaattgactggagcctcagtcttggactttcagcctccagaacagagaaaataaatgtgtgttgttaagccaccaaaaat

SEQ ID NO: 247395 - DNA, 318 bp, Homo sapiens
ttcccattatttgtcaactccccggtttagtctcaaagtgaattcaagaaccaccaccagaattaggccttttgccttctcggacatcatttgttttctaaaatgcagatctttagatctttacagtatctgacgggcgcgatggctcacgcctataatcccagcactttgggaggccaaggtgggcagatcgcctgagatcaggagttcaaaaccagcctggccaacgtggtgaagccctatctctactaaaaatacaaaaattagccaggcagggtggctcatgcctgtaatcccagctactccagaggctgaggc

SEQ ID NO: 247396 - DNA, 377 bp, Homo sapiens
gttcaattaaaatatgtctgagtttttggcctaaatatagtaatagacacaaatattaaactcatttttcctaagcttttaaaaaattatatattctcaggatacgacggataatcatttgcctctgcaaatttaagtcacacaatttatttgtgtgttctctattctcattgcaacatgctttagggctaaatataatcaaaaaaaggattcaatatacgtacattaatattagtaaacctttgcccctagtaaaatgatcatggctctaaaactttaaggcttatcacttttctttcaaggaaagagtcgggcatattttaaacatgtcaacaaaaaataaattctttcatttactcattcctttctcccttcca

SEQ ID NO: 247397 - DNA, 278 bp, Homo sapiens
gcagtttcatgcagtcattgtggaaaacagtttgaagttgctaaagaaataaaaaaatggaaccaccatatgacccagaaattcctattctgggtatatactgaaagaagtaaaatcactacctggtaaaggtatctgcactgccatgttcattgaaacattattcacagtggtcaagatatggaaacaacctaagtgcctgtcactttatggtatagaattttggagctttgatgatgttgcatccaagtaaatattctataaaaataaaattctat

SEQ ID NO: 247398 - DNA, 375 bp, Homo sapiens
acacttgaaaatgcaaaacatggccacctgttcacttcatgcctagctccattcccaaagcctcctggtactggcctagaccagccccagtcactgacccctcacagggctcacagtgcctatgcatgtgccagagtgtgtgggaattgttggaagtcatgcaggttgcgaagagtcacagaatatcagtgatatgagttcatcagtttgaagagttccagaaaccaaatggtatcttgtgaacatgccaggaggcagtggtgggaagtgagatttgtagagtaagggataaaaatttgtaacagagtcgtacactttctttttgaagcaattccatccttcactcactacgggtttaaaactaatgcaggaaac

SEQ ID NO: 247399 - DNA, 454 bp, Homo sapiens
gtgttccctgggcttttggcatcacggccaagaaatcattgacaaatccaaagttatgatgcttttctcctatgttttcttgtagtaaaagttttatggctttaactgttatgttcaagtctttgatccattttgggttattctttgtacatggtataagggaagggtaccacttcattcttttgcatgtggatattcagttgccagcatcatttgctgaacagattctctttacttcatggagtggtcctggtacccttgtcaaagatcatttgaccataaatgtgaagatttagttcaggactctcatctgtctgcatgccagtaccacttagttttgattactctaactttgtagtaagttttgagatcaggaagcatgatgcccccaactctgtactttttttgactgctttggctatacgggattccttgagatacggtatgaatttta

SEQ ID NO: 247400 - DNA, 506 bp, Homo sapiens
agactgcctcaggtatcttcttagagggtaggcagctgggattctgctccaccagttctcacctggcattggtggaggactgctcccagggactttaactctgcagcactctagcctttttatattttcttctcccttgcagtctttcagactttcagaggaaagcaatctgataacataattcctcagaaagtattaatatgacttagagaaaatgtgcaatggttaaccttctcaacagtgaatcccaaatgggggaattttaagcgtgtatcggatgggagaggctttcctagtctccctactacatctccctactcccaagcctccatccctacttgctgctgcatctgctggcaaggcttgtctgtcctgaaagctgctgaaagttagcatttactagtgacatcacttagtgaatatgagtgtgagccttatcaaaactgtgacccatgtggccccactccataccaatgtgcacatctttaaccactttgggcatcttg

SEQ ID NO: 247401 - DNA, 1406 bp, Homo sapiens
  misc_feature (150)..(150): n is a, c, g, or t
  misc_feature (195)..(195): n is a, c, g, or t
  misc_feature (790)..(790): n is a, c, g, or t
ttgggtaaatgctggggtgggggtgtgtggcattcactctgaggcctccttccattccctgggtgctcatggccctggctctccaaaggccccaacaacaaagagcaaaaaatacaagacacaaagtcagctaagatgagaaactaacantggtgggactgggaactgccagcttcctggcgtgtccagttgtgngaccctgtcatccttccctgtctcttggatgtgagaactcttgttgtagcctgagtggggggcatcctgggaaacccacaagccagtgggcccagggctgctgtaggaaaaccttgctgtgtggcttcaacagtcacaagtctccaagtaccagcttgatggtagacaggaatgacgagctccctgttcaaggagctcagtctagctggaaacagaaaggtgaatgaacacatgggcagcaaggggttgccatgaactggaagtgtgctgagacctaagagtgaaaagaacacagtcaggggtgctatggggccagcaagaggacagtaaagcccaattcaagatgcaccgaggcaagcctctcacaagggaggatggtgatggtgaggggtagcaggcaccagcacccgccagggaacaccgagtgcaggcattctgttgggctgacagtctcttgagacccagctgaggcccagccccctgcccggcatcccacagacctacacctcactcctctggaggtctgggtctgaggtcatgcttctcagtttcagcacacctcactggtttcagacaagtatctcagctgtcaggntgtggaacacaggttttctcaatgacccgagaatttagaggctcagagagaaaaataaagtggctccttttccaagtaactttccagataatcccacttcttgggcccagccaaattaagagacccaattaagcaggtcccaatagctcctgaagaagtgagcaagggctggaagctttgtccctccccttccctgatggagaatttgctctctacctgctgatgcagagaaagtagagagaagtaagaaaaacaaagcctgaaatgccacaaacacaactgcccactgaagagaagcctgctctggaaccctccaccatcaactctgttgctcaaacagaaacacctctaccaagcactggcagagaggtgtccctcccaagggcaggcgaaacaggctgggccagaggcagcccacctacagcaccccccaccccttgcctgcactaggcccccttgagattgaggcctgtgtccactccagtccggcacctggagcccgtgtgtaggaagaaactctactgctgcagtgtctgtggtgtgacagacatccagtggccttggtaaactctacattcaggcaggcttactcccctctcagaaggagaaaaatgca

SEQ ID NO: 247402 - DNA, 787 bp, Homo sapiens
atttctgtagtttctgcatatctcacacggttcctggcaaattgaagagtgtttcatgaattcaggactttattgtgtttgctgtgaatcagtttgttttgtactgacgatgatgttggctaactcccttgtaactagtacttatttgaaataatgtcctcgggattattttaagcaatgtttaagtatgaaatcatttcattctcctaacatctcaaggaatatactattatattctactttacaaaaggggaaactgaggaacggggaagttaagtggaagctaagtggaagaatccagataattgacctctccttctattggtatgcaattgctagagcaatgatagtcctccggtagagccttagacattgtgtttattgcattcctgttccacccactgcattccggatactccaacttacttccaacacacatatgcaggcgtctctaaaattccggagatatggtcaccaattatttttatgtgcgacatgctcaaatcttaatatagtaaacgcttgtatattcataaaccagcttaataaatgaaacattaccattcctgttgaagagctttgtgtaaccaccttcccaatcacgactactctctgactctgagataactgctcttctgaacttggtattcatcgttgcaatgtatgtctttatatttctgctacatatgtaagtaagcagtatataacattctatattttcttttcctactttacttatcgttacctttactaggtccatccgtgttgacatatagagatattcatt

SEQ ID NO: 247403 - DNA, 1200 bp, Homo sapiens
taaaagtttttttaattattgactttttaacaaaacaggaaaatgctcacaatatagattgaataaataaagaatattataaaactatatactacataatcttagttgaaagaaaaagggaggaagaaagaggggaggtaaggaagcaaagaagaaaagaagggagggagggtgggcaatttcacaaatagaatcaaagcattaaaaatgtccatcttcttttaattcagtaattctatctccaaaaaagaattatcagaaatgctgccaaagactgtagtttgacttcagtccatgcataacctgaaacaacctcaaatcccaacaaaaaggaatatttaaatatgttatgaaatgtccacatgaaaggaagagacagagagagaaaaaccaaaaaagaaaaagagaaacgcatattcacagaaaaaaaagacttaaaggaaataaatctaaaatatatcaaggggaatgtattagatatttattatttctcctgctcttcttttgttcctcaagttttaacttttcctctagtacagcttcccttcaggttgaaaaacttccattagtatttctttaagaggagagctcctggaaatgaagcctcttggttttccatcacctgaaaatatctctattttgctttcactcccaaagaatattttttctggatataaaattctgggtggatagttttttttttcttccagcattctaaagacggggtttcactgtcttcgtctttggccaccatggttttggatgagaaatggacagtcattcgaataggtttcttccttccttccttccttcctttccttttctcttttttctttctttctctctttcttgagtccttcctttcttctcttttcttccttcccttttcttacgtataatgtgtcatattttaatgctcttaatgttttttaatccttggtttttagaagttttcttatgaggtggctgaggagttgttattaaatgtatcctgtttgaaattactgagattcttcaatttgtgaagatacgtttttctttaaatttgaaactatttcagccactctttctccaaatatttttttctgcaccagtatttttctttttaccttctgagatggaatgccaataccaagaagtttcagccttttgacattgtcccacagtaccatgaaaggcttttcatttttctccaatttt

SEQ ID NO: 247404 - DNA, 487 bp, Homo sapiens
taaaagtttttttaattattgactttttaacaaaacaggaaaatgctcacaatatagattgaataaataaagaatattataaaactatatactacataatcttagttgaaagaaaaagggaggaagaaagaggggaggtaaggaagcaaagaagaaaagaagggagggagggtgggcaatttcacaaatagaatcaaagcattaaaaatgtccatcttcttttaattcagtaattctatctccaaaaaagaattatcagaaatgctgccaaagactgtagtttgacttcagtccatgcataacctgaaacaacctcaaatcccaacaaaaaggaatatttaaatatgttatgaaatgtccacatgaaaggaagagacagagagagaaaaaccaaaaaagaaaaagagaaacgcatattcacagaaaaaaaagacttaaaggaaataaatctaaaatatcgccagtagtttgtagttacccatgtcat

SEQ ID NO: 247405 - DNA, 393 bp, Homo sapiens
aataagaagcaaaggtaatcctgatgttgaattacaagttaatgcagagcacagacatgaaaataattctatgggtttgctgcagcataatccttgccagatctccaagttccattcatctaatgaaaagccttagtttgaagaacattttggagaactcttacatcaagaggtctccagtacctcaaaaaccagtgttcaaaaggaaaatgcacacgcgcatttcagggaggtgggaataaaagccttcctttgcgcagcgtgttacatgtggaaatgtggaacgcacacgatcattcttactgttaaaaaaccccacaaagattataaaaatatgtcagtttttttttggtgcaaaaactcacacgattaaaaatattatactatgaaagc

SEQ ID NO: 247406 - DNA, 378 bp, Homo sapiens
acgagattcaatttgctagtactctgttgaaggctcttgcatccatgatcatgaaatatactggcttataattttcttttaatgtctttatcaggtttcagtatcagggttattctggcctctaacacaagttggcaagtgtctcatttctggaaaaagtttgtacagagtaacaaagcttgtaaagtttgtaatattatttcttaaatattttattttatttttatttttagagacagggtctcattatgctgcccaggctggagtgcagtggctactcacaggtgcactcccagtactaatcagcacgggagttttgacctgctccatttctgacctgggctgtttcacctttccttaggtaacctggtggtctct

SEQ ID NO: 247407 - DNA, 368 bp, Homo sapiens
ggaggtctgggtgcctcctgtccagggtatgagcccttgaaggagctttggaagggaaaagagcagatgtcgcctcttgccccaggtcttcgcagggcaggagtgtgcctggtggtgcggacctggggcctccctagggaagagggtcggggatcagcagccagaggaggaagagctatgagtctggaatgaagagatgagaagctggagcttcttatgtgaaaaataaccctccagccatggctgcgtcaccaggcacaggactgcatcctgtggtttcgcctagaattcttgaccaaggcatccctccccgtgttctctcctggcctccctgccttctgctactcaatctccagtagcccagctac

SEQ ID NO: 247408 - DNA, 666 bp, Homo sapiens
atgcttttttttacagaataggaaactatagtttaaacagtgcgtccaatagaactttctgcagtgatggaaatgttctagatctgcactgtccagtaagtaaacactagtcacatgtggctattgaatacctaaaatgtggttagtggaactgagggactgaatttgtgcatttatttaacttaaatagccacatgtggtcagtggtcaccatattggacagctcaggcttagtgttctcagcctctgcagtgttctctgtgatctggtcctccattacctctggtcatcttctacttcccctcctcacccattctaacttcactggcctccttacaggccttcagataaacctggcatgtcattgcccctgcatccctctttcccttgcctcctttaaatcttggctcaaagctgggcctggtggctcacgcctggaggtgggaggatcacttgagcccagtagttcaagtccaggcttgacaacatagggagacgccgtctcaaaaaaaaaaaaaaaaagtaggcctgggtggtacacatatagtctcagcaactgggaagctgaagtgggaggatcacttgagcctgggaggtcaaggctgcagtgagctttgatcgcgttactgcactccaccctgagtagcagagcaagaccctgtctca

SEQ ID NO: 247409 - DNA, 578 bp, Homo sapiens
atgcttttttttacagaataggaaactatagtttaaacagtgcgtccaatagaactttctgcagtgatggaaatgttctagatctgcactgtccagtaagtaaacaatgtggtcagtggtcaccatattggacagctcaggcttagtgttctcagcctctgcagtgttctctgtgatctggtcctccattacctctggtcatcttctacttcccctcctcacccattctaacttcactggcctccttacaggccttcagataaacctggcatgtcattgcccctgcatccctctttcccttgcctcctttaaatcttggctcaaagctgggcctggtggctcacgcctggaggtgggaggatcacttgagcccagtagttcaagtccaggcttgacaacatagggagacgccgtctcaaaaaaaaaaaaaaaaagtaggcctgggtggtacacatatagtctcagcaactgggaagctgaagtgggaggatcacttgagcctgggaggtcaaggctgcagtgagctttgatcgcgttactgcactccaccctgagtagcagagcaagaccctgtctca

SEQ ID NO: 247410 - DNA, 294 bp, Homo sapiens
tccctgtagttgttcaaaaaaatgttgatgaattgctgcctaaggaggaagaacagttggagctctaagcccctcaactcccagcttaagggatggtgggggagagggaggaagtgacagtaatgggagcagagaggaaaggcagaagtggggaggcagtattgttttcagccctcagggttccaggtcctctccctggctcactgcatctggtcatccatccttactgatgcattgaaacaaaataatattcaatttttagaaataatacgtcaagagtataaagtaacatgt

SEQ ID NO: 247411 - DNA, 342 bp, Homo sapiens
agcaacgtgaaatggtaatgccgcttgccatactctgcccatgagggtaactggccactcctctcctctaggttgggatggtgaaagattgctccaggaactaaaacttgcttccacctgctctccagtccccccagcaaccccctccatggcttcggttgctttctccgaagcagtaaatcgaatcctttctgaacatgcacaccttcaccgcaattccccacagactcaaatcttgattgagtgatagatagtggatgaaatcatactgcaaggagaatgcacgctggaatcaacagtacttcatatgcatctctatttcttattagactgaggtctttg

SEQ ID NO: 247412 - DNA, 527 bp, Homo sapiens
aaggcagacctggctgtggccgccttcaccatcacagctgagcgggagaaggtcatcgacttttccaagccctttatgaccctggggatcagcatcctctaccgagtgcacatgggccgcaagcctggctacttctccttcctggaccccttctcccctgctgtgtggctcttcatgcttcttgcctacctggctgtcagctgcgtcctgtttctggctgccaggctgagcccctatgagtggtataacccacacccatgcctgcgggcacgcccccacatcctggagaaccagtacacgctgggcaacagcctgtggtttcccacgcttctggaggtggggagggcctctggacagatgggtgtcccctggtgcccctccactcttctcttcctctcttttttggggggagaaacctcggaatttctatgagacctcccccagggagggggtcagttgggcccccatccctccccttgccacatcgcagcccctgttggaataaaaaaaagaacaaaaccccaaaa

SEQ ID NO: 247413 - DNA, 544 bp, Homo sapiens
agtgtgctgagtgcctccactgggctgaagctcacagggccaaggcccttgtgtcgccttttcccgagggagtctctcgcttcctcatctagacaggaggaccgtgaaggaggagcaggcggaccagccatctgtcaggtgtgagtcctgctctagcactggtgtagccctgggtggggtctagattcaaggggaatggacatgaacactgtgaacaccaccagagcccccaaaacaggacaatgtcatcacaggctgctataaaaaaaatgccaacctgagatactagcccagcgaaacagttttccaaaatgaggatacaataaaggcatttttggacaatgaaaagagaatttgccaccagcagacatttaaagaaattctaaatgcagaaagcaaaggtgatctcaaatggcatgtctggtttgtgaagaaagtggagcaaagagaataaataggtcagtaactccaaattaacagtggctatatcaatactttgtgagattaaaatgtttcataaaaatacttgggaacccccaataaa

SEQ ID NO: 247414 - DNA, 191 bp, Homo sapiens
aaagacatagaaaaggttagaaaaaaatgatcaattacagactcagcctagataggagaggcaccattcaagtaacaggagttaagagaggccgggcacagtggctcacacctgtaatcccagcactttgggaggccaaggcgggcagatcacctgaggtcaggagttcaagaccagcctggacaatatgg

SEQ ID NO: 247415 - DNA, 272 bp, Homo sapiens
tctgcagctgttaggaacccaccatctttagaagaaaaaataggactgacagtctagccaaaattttgctttaaaaaaaaaaaacaacccatcaacattcctgtggtgattacggtggatcctacaatttccttgcctacaaagtgcattaaaggccaggtacagtggctcatgcctgtaattcccaacactttggaaggccgaggtgggaggattgcttctggccaggagtttgagaccagcttgggcaacaaagtgagaccccatctcta

SEQ ID NO: 247416 - DNA, 400 bp, Homo sapiens
gtgagccataggtcaaaatgactacataggttatcaataagccccatcccaagtggaattctgaagaactgtccagaaagttatcatatgtaaaaactgacaattgacaatatatagcttagaagaaagaaaacttggagaaaaattcacaatctttacagacatatgtcatttagtgtaaggactaagagccaagacagtatgtgtattataagaatgcaataattaaatcttgagtaaatattacattaaataatgtacattatactgcttttagaaaaaggtagtattacgcgatatgctttagaaatattttaatccaaaagaataaaaaccacaacctcttttgttccctaaaattattttattcctaaaggaatcacatatatattttcagtta

SEQ ID NO: 247417 - DNA, 327 bp, Homo sapiens
tgggagggaggaggaaatggcctttgcaagcctgacctgttgtttgaaatctcaagttaccttacatgttttatgatattaaccatgtagtccatacaatttttgggattcaatatgaaatattttaaacatatttaccaaggagctcttctccagagatccttgatttaggctgatgtttcaggaagctgagctgtggattagtggccctgtgtgcccttggtctcttgctgtgtgtgtgtactctggcttcagaagcagagacggactgtgttaccttccataatgatgccgggtaaaggaggcattagctgatctggtgaaatg

SEQ ID NO: 247418 - DNA, 388 bp, Homo sapiens
aaatatgatccaaacatgaagaagggtactatcattagggcctgttggttttaaaaatatataggtagataggtagatagatacagatatatagaaaagttggggctgggtgcactggctcacgcctgtaatcccagcactttgggaggccaaggtgggtggatcacttgaggtcaggggttcgagaccagcctggccaacatggcgaaaccccgtctctactgaagatacaaaaattagctgggcttggtggcacatgcctgtaattccagctactcaggaggctgaggcaggagaatcacttgaacccaggaggcggaggttgcaatgagctgaggtcgtgccactactccagcctgggtgacaaaacgagactctgtgtcaaaaa

SEQ ID NO: 247419 - DNA, 452 bp, Homo sapiens
tcgcccaggctggcgtgcagtgacaggatcacagctcactacagccttgaattcctgggctcaagcgatcctcctgcctcagcctcctaagtagctgggattacaggatttggctaaacatgttcgggctctcagcattctttcacccctcccttcagaggaaacacggagatgccctgacttggagttgagagatctggtctctggtcctgatgccatcactaacaggcaatggaagcttcagcaagtccctccactggtctgtgcctccattccccatctgtaaagaggatcgctggtccctatcacccccctgggatgtagtgaggcttgtcatgtggcaagggaaagcacctgggacaaagcaaggtcttatgccaatgctttctgtagcatcatcctggagcctcaagtcttgtttgaaattgaataaaggagaaacatagggacga

SEQ ID NO: 247420 - DNA, 571 bp, Homo sapiens
gcatgcccaaagatggcccagatgttggtattatcagacagacaggcatttcaaaataaatatagtaagcatattaaaggacttagtagaaaagttgaataacatgcataaacagttgagtgatttcagcagagagaggaaccataaaaagaaccaatgtaaatactagaaatgaaaagcacaatatcataaataaataatttatttattggacttaataacagactggatatagcggcagaaagaatcagtgaactttaagaagaaataatctaacgcacttcagaaataatctgaagcagtaagaggaaagaaaagtgaatacaaacagaatagatggtctgaaacgtgtgggataatatcatatggcctaacatacatatcactggagtcctgcaatagtaggggaggggatataagacagaagaaatatttgaagatatgatggcttggaattttccaaagatgaagagttacttcaactcacagatccaaaaagcttacagaaccctgagtaggataaatgctgctaaaacaactggattgtgtatgtaaaaataaatgaatacat

SEQ ID NO: 247421 - DNA, 394 bp, Homo sapiens
aacatctctgaggctcatattttgatccataaaactgggatcagagttgacctacaaatgatctgcaagtttctacagtgaacccactaggaaacacttctagagataagagtgtttcataagtatgagacctcatgatggaaagtctgaattttctttcaaaattaagaaacctatatatttgggtgaagcataatgcaaaatcatattccttctaagacttcaggagaactttccagctaatataattgtgtgattattactattctttgaagatctgtgatttagaaagtatttaaaccatgagtgtttaaaaactgtttgtattttaggttcactgacagcaatatattactttatcaaattaaatagacttaagaataatacaacaatg

SEQ ID NO: 247422 - DNA, 281 bp, Homo sapiens
ctggcctgcttcttcccaatctgtgcttcctcttggactgatactctctcacacacatggatacattgaggcaggggaacacacacaggattccaagatggaagaaaggcacttatttggaattttcagaaggcagactcttgcagattcaaaatataggtaggaccctggtctgaactgtgccccctttctctttcatagggagcataattcagaaacagatttaagaactgaagatgaacacctgtgtgtgtgtgtgcagacacaggcaacacttcatc

SEQ ID NO: 247423 - DNA, 429 bp, Homo sapiens
aaagctgacttcctccacaattcccttttcaaaatgttagaaataaacggaatggcctgagttaaatacatcgatatatttaactcaaggaggatggtacaccatttccaaagaggatggcagtcagtgaaagatgactgaaacgggattgctaaatttcatgtgaatctggctgatgccctacagcccagtgaaaccagacctctctattggacagaattcgtttgcatctctaccaaacaaaaatcctttgccactcctcagtcttccacaggttagcaggggctttggtcatgggtaaatataatagtactccctcccttcagcgtcaaatgaccctaaaggtggcttgttagacaatgtcctagtccagggtgactaggtagaagtcgtttggatagtttttcttaatatttttaaggagagaaa

SEQ ID NO: 247424 - DNA, 601 bp, Homo sapiens
cgatacttggcccagtcccattacctgttccaattagccaggcttaacttctgtgatctaagaaactttcttttcaaccaagttgctttttaagtatagcattagtttaaatccccaatgcataggagaagccgtaaaactttaccagcctctgcttcagaaatttcctttccatggacactggggagcttcagtgtactaaaatgggggccatcaaatagcttgattaccatcctcccatatctgtcaagccgctgatgtgcacagagctgatgtgcaaaatactgcaagggccaaacaaaaatgacacataagggccaggcacagtggctcatacccgtaatcccagcactttgggaggccgaggtggggcgatcacgaggtcaggagttcaagaccagcctggccaagatggcgaaaccccatctctactaaaagtacaaaaattagctgggcgtggtggtgggcgcctgtaatcccagctactcaggaggctgagacagagaatttcttgaacccgggaggcggaggttgcagtgggccaagatagcgccactgcactccagcctgggcgacagagtgagattccgtctcaagaaaa

SEQ ID NO: 247425 - DNA, 653 bp, Homo sapiens
catagtcttccaaagaattcgtgggacattcaccaagacggcgcacatcctgggccatagagcacttttaaacaaccaaactcatgcggagtgcactctctgatcgtagtggagtctattagaaatcagtaacagaaagacaacaggaaaaccttcaaacaggtaaaaatgaaacaacacactattaaataatacatgatttaaagatcaagttttaaaggaaataaaaatacataaaactgaaagcaaaaacagaacataccaaaatatttgggacgcaggtaaagcagttctgagagtgaaatttatggcactaaattactacattaaaaatgaggagagatagagaaagatagttcaatagaagcctccagagattgtactcactcctccataggatcaccaaattacccacagaaaaaatcatcttcataagaaccaagaatcaggtgagcaatcacagtacctggttttagcatcatactaaggaaagaggcactgaggagagtaggagagatagtcttcaatcacctaggccacctttccctcatccaaaaaatataactgataaacaaattcattatagttgctgaatacaaaattaacatccaaaaaggagtagtatttgtctatgccaaaaacaaacaatctga

SEQ ID NO: 247426 - DNA, 619 bp, Homo sapiens
cctagcagagctctgtcaggagatgaggaaaatgtctctgtttttcaaatatttggatcttgctaaagaccaacacatttttttaagtgtgtataattttagggcaatttgatccatatgtttctgattctcttgcacttaaatcatcaaaatattgatttttaagagccatttgatgtcgaaggaacctttttaataagcttttaaagctctttaaacccagagcctggagccagggccagagctcaggctgtccgctggccagtcgcaccctcccctcccctgggtcaggattacttggagctgagtctcacttcccctcttcctggcctccctgcctccccaagaactacccaggggtgctgacagaggggcccaaccccttctgttcacagacttctctcatgcttcttcaaagcatgcctaagacacaaaccaagaggagcagtcatgatctttacttcttaaaggctgcataaaatttagttgcataaatgtgacataatgtatttaaccaacgcctgttgacggatgtttaggtcatttcccgtggtacacctttatgcacatttctgattgtttcgtttggatccatttccaaaagtaaaaatactgcgtc

SEQ ID NO: 247427 - DNA, 419 bp, Homo sapiens
tgtacaatgcaaaggacaaagattaaattatattagcaatctaggagcagaagggcaagactgcttttttaaaaaacagctaaaggtttaggaggttttattaatatttaaattgtattgaaaccacagctgcagcctttgactccagcatagagatatgcaaatatggctttcaaaagaaaggcaatttcagacagccctcaaagtaacaagaacaaataaaacaaatgattttgtaatttatctttattgactgatgttgcacaaggcacagcccataccctgtgagagtcagcaacagccgagctctctgaggagagaagagaaagccaggctggagggagaggcaggccgacccatagacaggtgacaggaaagacacagagcaggcagatgggagaagaagacaactaaattaa

SEQ ID NO: 247428 - DNA, 336 bp, Homo sapiens
agtcagttcacttttgcaatctcctgagaatcaatttcttaagacttgtggaatattcagtttaaacacaaaactaaaaacaaacagctgtattggagtattattgacatacaatagcatggcatatttcaattgtacaattgtataagtttttgcatgtgtacacacctgtgaaaccatcagtacattcaatattatgaacctgtacatcacctccaaaatattatttgtgcatacccctttgtgatcctttcttactgccccttctctccaggaaaccactgatctgctttctgtgaatatagattagactgcattttgtggagttttatatga

SEQ ID NO: 247429 - DNA, 701 bp, Homo sapiens
tgtggtggctcacgcctgtaatcccagcattttgggaggccgaagtgggtggatcacctgaggccaggagttcaagaccagcctggccaacacggtgaaaccccatctctactaaaaaatataaaaaattagccaggcatggtggtggatgcctataatcccagatacttgggaggctgaggcaggagaattgcttgaacccaggaggcggaggttgcagtgagccgagatcgtgccattgcactccagcccgggtaacagagcgagactctgtctcaaaacaaaaacaaaaacaaaacaaaacaaaagtcttattaacaaaataggactaataaaaggggctcttgatgaaagatatctttcaaaataccacagcagatatcatatttaatagtgaaagctatagaagttacatcatttctgtgcctcagtttttttcatatataaaacagggataacaaccagcctactttacagggtcattgggaggattcaactatttaatatgtgcaaagcatacagaacaatgcatttgtggcacatggcaagcattcaaatgctgcttattattttattacaatcattgtcttcatgattatttccactaaaatcagaaacaaagaatgcaatatcattgtatctattaaacattgtactacaggtcctaattcattgagagaagaaaaagaaataaaatgtat

SEQ ID NO: 247430 - DNA, 353 bp, Homo sapiens
ttttactaatttatgcctattatgagtaatgcctctaagaacattcaagttcagtctttttgtggatatatgttttcatttattttgggtaaatattgtcagaatggggttactgggtcacaagtttatgtgtagctgtgtaacaaattgtgacctttcaaaagtggttgtactcttttacattcccaccagcagtgtatgagagttccagatgttcctttctctttagttcttggtattgtcagtctttttaaatttagccattgattagatgtgtatttgtatctcattatgattttaatttgtgttttactgatggatgatgttgagtatcttttcatgggcttattgac

SEQ ID NO: 247431 - DNA, 486 bp, Homo sapiens
gcattttcatttacctatgacaatgttttcctgttttcttctagaaatggtattgttttgcttttctttcttggatctacgatccatctagaattaattaattttcatgtatggtatgaggtagcagtaattgttttccatttagatatccaattgctcctgcaccaattattgaaaaaacaagcctttcccccacggaattgcagtgatgcctctgttgtaaatctggtaaccaaacatttgggactattttgggactctattctgttaatttttctatttgtatacctttgggcggtcccactttggtctcttttataagttagtattctccctaagatctcacctgggaagaaacaaaacaaaagaaaataaaaaaatccccaaagctcaaaagacatttgaaaactactgagttagtatatttcaaaatgcctagcacagtgtctggcacacagaataaaaatattttaacaatgattaaca

SEQ ID NO: 247432 - DNA, 249 bp, Homo sapiens
aatccttacaacaacactttgtggtaggtgcacttattcttatgccattttacagatgaggaaaccaagacacagaggatagaagtaacttgttcaaggggacataaccgtaggtggccgtgccaacaggaaaccccaggaagtctggcttcagagccattccctttagctctgatggcacactgtcttgtagttcagtcttcaaatgccacagcctctgggccatcatttcctcctcccggggttctc

SEQ ID NO: 247433 - DNA, 576 bp, Homo sapiens
acccggacaagaattcaggcagcacagtccccctcccggggcagtctaccgtggggaaagggcaagcacacaaggtgggcctgcagcggcccctgaggacgccagcgacagtctctggtgggaccagctggccgtcccttctcccatttgaccctcctcctggtccgctgccacagatcaactgttgccacagctaccagggaaaggggtgtttgtccacgggaatgctccctgcggaggagctctgcccgggggcctcagccgggaaggcggccaggcgggttgcggtaccaggggctgcccagcgaggggagacaaagctccacaagtgagaacagaagctgtgccggcggcatcagttacccggcagcgtctgggaaccgcgctgggttgcgctggggtcggctagtgggccggcgttcctctccttccctccctcggctgggctccgctccacccctcactcaccctcctctggatcagcgccacctccttcctttggtcagcccccttcacctgcaataggccccaatacaaggggcttgaggaaacagttttgtgttttgttttgtggtt

SEQ ID NO: 247434 - DNA, 561 bp, Homo sapiens
cagcatgttcctactgaagaaactgggaatcctcggcaggttagtagcaagcagaactttagagtcccttgaaggaaggttgaagtgatgtttggactgctgaactgcagagtgaacctgggaatgagatgcactgacaccctcatcagtgctttccatcagtgtgcaagacttagctatttctcaaaagaacacagcttcctctcacatggaatgtcctaccattggggatgtaaccagaagcctccgaagcctactcagttttttaggtgaagatcccagatttttgtttgtcacaactctcatggttacatttataggtagggaatccagccacttcagtccagtttctgaaaattcctggctaggttatttttcagagttccatttggacattttaccacctcttctgattgtggacaagacagtgaaggcattgatgaatgtgtagggctttacagctttatttacaatccaatctggaaatgatggactcctgttacaaatagacacacttaatgtaccaaatctggaaataaaatatttcagaagtctttttga

SEQ ID NO: 247435 - DNA, 326 bp, Homo sapiens
cagcatgttcctactgaagaaactgggaatcctcggcaggttagtagcaagcagaactttagagtcccttgaaggaaggttgaagtgatgtttggactgctgaactgcagagtgaacctgggaatgagatgcactgacaccctcatcagtgctttccatcagtgtgcaagacttagctatttctcaaaagaacacagcttcctctcacatggaatgtcctaccattggggatgtaaccagaagcctccgaagcctactcagttttcgagcatcttttacactgaagcaagcatctcctcacaagtgcctcctccttacctcatccg

SEQ ID NO: 247436 - DNA, 628 bp, Homo sapiens
caaacaaaacaacaacaactaaaaaacctttcgtagaggaaagaagattcttaagaatttcagtatagtgtaccccaggagattgattttgcagatgttaattatgctgttgaaaaatagtctttctttcacacattttgtagtattgtcttttctaggtgtaagaagtagaccttatgtggttgagtggatataaatcctccaacttgttataaacagtcgtgtgggtagaaatagccaaggggatttccctttaaatcgaggacgctaaatggattctccctggcttcgagaaactctttgttgtatgctttatcttttactttgattcatgactgaccagttcttacatcaaacatttttttcccctttgaagtaagagaagagatacttaaaaaaaaaaatgtagtctagaaagagactaggaatagaacactgctgacttgttcttataccaagagctggaggcataaacagttttaataaaaaagaatactttgtatcttttgatgtaacttccctttagagattctgtttcccctgtcttaaattctcaggctatttctgattgctgtttaaataattggtagttactatttgagtcatgcttcttaaaaaaaaaagatat

SEQ ID NO: 247437 - DNA, 761 bp, Homo sapiens
aaggtgctatcaatacagctagtcttccaaagctcgtaccttcagatcttttgttttagatctgttatgaaaatgcactagtgtaagccacatttttatgcaatcaatgcccgttgtacagacagactcattcagagattaaagtgtgagttgcttgatttctttctgctatgcttcagctcagttttagcagtatgtataacatcttttaatgtgatgtaagtatgtaggtataaagttcctggatatatcagttattaagccacaattataactaagcgtgagttatggcagagacaacttgaaacactgctagtgattctaaaaatttcctaatttgacgaagaaacaggaaacaggtagtatctattttagataatttttttagattttaccattctttaatatttacatttgccaaccagaatcagacaatagaatttctgtcattccagtttaagctaataaaatgtcaagtagaggttcttggctgggcatagtggctcatgccagtaattccagcactttgtaaagctgaggcaggtggattacctgaacccaggatttcgagaccagcctgggcaacatagcgagacctcatctctacaaataataaaaagccaggcatgatggcgtgcgcatgtggtcccagccacttgggaggctgaggtgggaggattgcttgagcctgggaggttgaggctgtagtgagctgagattgcgccactgcacccagattgccaacctgggtgacagagcag

SEQ ID NO: 247438 - DNA, 375 bp, Homo sapiens
atctaaatgcccatcaacagtagactgaataaagacaatgtggtacatatacaccatggaacactatgcagccataacaaagaagagatcgtgtcctttgcagcaacatagttgaagctggaggccaatattctaagcaaactaatgcagaagcagaaagctaaatactgcatattctcacttataagtgagaactaaacaatgagaacacgtggatataaagagaggaacagctttgcccagtggcggcattgtagccaatgaggtttacctgaagtacaattattgctaattgaaaacttttcccaatacccctccatgacgacttgaaatatagtcagcactggcaatttttgaccgtctctacagagactg

SEQ ID NO: 247439 - DNA, 913 bp, Homo sapiens
gttatatctaatgacttgatcagatgcaggtgcaagttaaattttatgaggaggaacacctgggtcatgttgaatttggttgcttaataggaaatgcttctgtttgatactaagcggaggtcaccgactactagagaggcaggaggtattttcctagctggaatttaatgagggtccaggatgagttttctgatagagtcctctgccctttctctttcctcacattttccctcttctgggtgtgtgccaaaacaagtgggatgggaatggtcttcttacatgagcttgccagtctggaggccccctcagtcttctgcagcccacgtgtctccctccacctgcactgcaaggtccacctgcactgaagcgggatgatgcccacttcagatccttgtttccagctgttcaggtggcagagatttcaaggacctgctcccaaggatttctgttgcagtggctgtgttttcatttaggagatgtgctttaatttaggagctacctggagttgggccaaactccaggttaaggacacaggcctcctcggtagactgcccaccctgcagacatcagctgcatgttcagggctccccaggccaccctcatcaattcaggggttcccactaccccccgcccccgccaggttcagtagttcactagaacaactcacaaaactcagaaaagccctacacttaggattacagtttcgttctggcaaaaggaggatacaaattaaagccaaacaaaagaggttgagggcgaggtctgggagggtcccgaggtggagtttctggttttcctctccctgtggagtcatggacagcgctacctcctaccggtatgaggtgtgacaatactcacagtattgccgaccagaaaacatcacctgagcctctgatgtttggcctcgatcacg

SEQ ID NO: 247440 - DNA, 391 bp, Homo sapiens
tctctttccatcgacaggtcctgttggttctgtctttaaggtatatcctgaatctcatcacttctccagtgcatctgtgccaacttcatcacacttcggaggtcccgtgcccctggaagaatctgttgaactcagtgggtccttttcactcctctgcatctccatggatgcctccctggtcccagctacctacacgcatctggacttctggaatattctcttaactcctctgctctcttcccacacttgtttccttccatcctattttcccatggctgccagaatgggcattttaaaatgtaaatctgatcatatcgttctgatgcttaaaaccttcccttattttttcatgatactgagaataaaacgtaatctctttatgaacctatga

SEQ ID NO: 247441 - DNA, 532 bp, Homo sapiens
cagatgttaggaagtccaggccccatgtagcaccatttctggagctgagggttcagttggaatgtacactagtgagagcctgctgcccacaagttgctcagcccctcctgagaacatgccctgacagaatgaccaatcttggtgtatgtgtgtagaatgattagattatccccaagcaaatatcagatacttgaatgtactaagatttctgggtatagtatactttgtcctccttcacaggcatcctcagaggtttggaaagttttatataggatgcttgattagtcctttctgatatttgtaaacatttcccaataaagctgcatattcatctgtcctttaataaagcactattgaaatatgatgacatatagggaaagcctgtttgtgctctacaggcttgtgaaaaggtgctagaatcaaatacttgaaaatgagttgaaacatcagagacaccccataagccatatgtggcatgggcatctgaacctaatgtggaagcgtataaacatattctctagccctaaggaaa

SEQ ID NO: 247442 - DNA, 375 bp, Homo sapiens
caaggcccatgaagaggcagtggagtcattgaggcttagaagtttaagaccttttccttacaggtagcaggaagatgcctttggtctaagcctgcatattttctgatggttgaacaaggcgaagtttccctggccctcttgtccctgtggggagagagtgtcatttgcatctctcatggaattggaaatttgaagcaccatcatctccccttcattcctttcttcctttcatgtattattccttgtctccagacttcaatggtagatttcctgcttgtaaataccaggcagctgctgctgcagcaaattcatgcagaatcaccaaaaacaatggtttacttattgcattagccgaactcctaccctcgaactgca

SEQ ID NO: 247443 - DNA, 441 bp, Homo sapiens
atctttctcctaaccttcctcaaggaaacctctggccttttagcagggtaactgtgctctgaagaaataaataatcagggttttggggggctactggatactggttctgaactgtcattgattttaggggagccaaaatatcactgtggggctgggcatggtggctcacacttgtaatcccagtactttgggaggccgaggtaggcggatcacttgagttcaggagatcaagacctgcctgaccaaaatggtgaaaccccatctctactaaaaacacaaaaaattagctgggcctagtggcatgcacctgtagttccagctacttgggagggtgaggcaggagaatcacttgaatccgggaggtggaggttgcagtcagctgagattgtaccactgcactccagcctgggcgacaaacaagattccatctcaaaaaaaaaa

SEQ ID NO: 247444 - DNA, 387 bp, Homo sapiens
tatctacaggggtatcctaattgcccaccaccaaggagtgcaacaagttcctaccttgcctggaggttgctttccatttcctgagtgagagaaactgcagctttggatgaagttctgacaaagatatggaatggtggaatggggacaatttgccaacagagactttgtcactggcagggatggggaggcagcacagccaggcgattgtcccacacttgagaataaagccatttaggaaagagactctgcaaggaaaggcagcgcttggattgaaccctgtctctgctgggcaaaatatcctaatgaggaaggaaaggcagaggcaacaaaagaaatcaacgtggctatgagtgaatagcaaggatctcattcataaactcaaaattt

SEQ ID NO: 247445 - DNA, 353 bp, Homo sapiens
cataagccacagcactcacttccaaaacctttatttcttcgagcctcaatttcttcctcttaaaaatgggaataagatctgctatcttgccctggctggcgtcaggttcagtggaggttaaagtgctcatgcaaactggatgcctgaggcttttgcagcttcagggatcacaattcctggtgacagctgaagaataatggtccagggccacctcctgcattaccaaggccagtctttcacctggtgccttccctgggtgtctctggaaatatctctgcttagtgttctgcacagaaacctgcctggagtgctcagccagcgactggccaagatcgaggttctctgcttctcta

SEQ ID NO: 247446 - DNA, 502 bp, Homo sapiens
ttattatttcaagcagtttacaatgctattaagtatgctttgagatattttgatggttgtataatttccagtcttaggattcctatgatttatctaactgcttctctactattttgtttttccatcattacaaataatgtataaggttataaacgtatcctttctcatttcatcacaccattgccaactctagttattataaaaattctgtaggctaggcatggtggctcacgcctgtaatcccagcactttgggagggattacactagatcacttgaggccaggagttcaagaccagtctggccaacatggtgaaaccccatttctactaaaaatacaaaaattagctggtgtggtagcacacacctgtagtctgagttacttgggaacctgaggcacgagaattgcttcacactgggagatggaggttgcagtgagctgagatcatgccactgcactccagtctgggcaacagagtgagactctttctcaaaaaaaaaaa

SEQ ID NO: 247447 - DNA, 1154 bp, Homo sapiens
agcggccgctcgcgatctagaactagatctacttctcatatgattcagagctgctttctagactgccagataaggttgagcctaacaattccataatttctgtttttctcatatatgaatattatgctctacatcgtctcatcagagacgatgtgatccttatattaaatgtagacagcctcatttgagtacttgaataacgagaggaaattcactgtttatcatgcaatttatgctgattaactttttctagttacattaacactttcacaaagagaaagttaactttttaatttgtgtttttggtttatttcaaaaactttccagaattggagttggtgattcatgtttttttgcctctagagggagtaatgacactagggaataatgaaaccaagaaagactgatgagatttcaagtgtattaattttttttgctatcaaattttgatcagattacagtgggaaatcaacttttttttaatgaagaaaatgtatccgtatgtaggacctttttaatgagaggagacagtactaaaaattgagagaaatcacagttgcaaagaaaattaacttttttttgttaaggaacttttagaatgttacaacaacctgaatttgcaaatggtttgggatcccaagtgtgtcactgtctgctgtttgaaactcaggctgcatttttctcatatgaaggacagttaatttcccatccagggagattgtactcttagataatatttatatcatcctaaacagcatggattcaatacaaatacaacttatctcaaatatttccatgtaagaggtgatgctaattgtttcctgtatctagtgaaatgttttcctaggtcccttattacctcaatcttctattccttttttctatttggagatgattccaagacatgcatttcttgctaagaactgagtaatttagaaaaatatctttttgtgagaggctctttggaggtaaggtatataccttactcttgaaattgctgttgaaacccaaggactaatttttatttatttatttatttatttatttattttatttatttatttatggagatagggtttctctctgtcacgcccaggagttccaaaccatcctgggcaacagagggagaccctgtctctaccaaaaaaaaaaaa

SEQ ID NO: 247448 - DNA, 534 bp, Homo sapiens
ggctggtgtagatcttctgagctcaagtgatcttcctacctcggtctgccaaagtgctgcgattacaggtgtgtcatcctgcctggccagaaattaacttgattgaaagaaaagaaaagcttttgatatgctagcgtttttgcatgcatgcttttgcatgctaaagtttctatgccatttacagagatttcatggtctcttcaattgctctaagttgtccttgaggtgcagaaactcaagcacacagacttctcagctagaatttgtagctctagcaattcctttgtttattgcacaaacctagcttgtaccgagaccaaaagttctgcccccttgaagaccaaggcagattctggaattccttgtgcttgccaataccctttgacaaatgcccagccccaaaccccagcctgaacttcaggaggaagattttatagaaacacattggacttttcctgcctgtatattaaccaagagactcttctgtcactcttttttcctgcaataaactgatattcatgcaagtatctctaa

SEQ ID NO: 247449 - DNA, 283 bp, Homo sapiens
cctcgctgccggggtcgctcacagccccgggggaccgacgaatctccgccccgggcctcggggccagccctgcccgccgctcccgggctagcacacgacgtgccgcgccgacaaacgcttcctctccgcccgccacacgcccggagccgcgttccccgccggcccggactgcgcacgggcccaggaggcctgaccgaaagcggggcacagggcccggcgggcggtgctcacgcgactccgcggcttcccggcccgagcaggccccgcgcggtcctccggggcc

SEQ ID NO: 247450 - DNA, 361 bp, Homo sapiens
gtaaatgaaaggcatgagacttctcgagatgggaacaatgccagagttcaccaagtagctgaaaatttaggaaatacaagtcttaggaaaacatgtttcatgttttcatttttaaatttagtttttctttcttttttttttttttttttgagacaagagtcttgctctgtcgcccaggccagagtgcagtggtgcaatcttagctcgctgcaacttccacctcctgggttcaagcgattctcttgcctcagcctccctagtagctgagattacaggcatgcatcaccatgcccagctaatttttgtatttttagtagagacagggtttcgccatgatggccaggctggtctcaaactcctg

SEQ ID NO: 247451 - DNA, 418 bp, Homo sapiens
atctagactgcaaaggggaaatttcctcttgaccccaagtttaggaggaagcctttccagccagttctctccatccagacgctggagaggactttccctgttggcccagggtttaggaagggcttctcagtcagtctatgccagtctataaggttttgtggggatgctcacagtaagggcactgaaaggagcaagtttgtcaggtcactgcaatgagtaggccatgctttcagttcttcctatctggtcagctgccttctggcactccagctggatttacgagccaaaattatggtttgaggtgttgtaattggctaagtctctggacaaaaattacccaaaataatctgaaactttactggccaaagtgggactcctttaaaattccaaaacttgccagtctacacacacaactgga

SEQ ID NO: 247452 - DNA, 192 bp, Homo sapiens
tttacattttttaaaaaaattatattttactttaagttccaggatacatgtgtagaacgtgcaggtctgttacataggacaatgtgtggcatggtggtttgccacacctatcaaccctaaccttcttggttcatggatttttcaactagaagtttgctagctactaatcttgtcttgcattgtaagattgat

SEQ ID NO: 247453 - DNA, 401 bp, Homo sapiens
aaaagtataaatacttattatttgacagtgatgcaatgaaactagaaatttaaaatataaatatatgaagtcacaagaagagtaaatactctatcaaaaatgtttgttaaagaactaaaaactggctgggcgcagtggctcatgcctgtaatcccagcactttgggaggccgaggtcaggggttcaagaccagcccggccaagatagtgaaaccctgtctctactaaagaatacaaaaattagccaggcgtggtggcaggcgcctgtaatcccagctatgcaggaggctgaggcagagaattgcctgaatccgggaggcggaggttgcagtgagccaagatcgacccactgcactccagcctgggcgacagaataagacgccgtctcaaaaaaacaaaaac

SEQ ID NO: 247454 - DNA, 446 bp, Homo sapiens
ccagtgtcagcctggctgaggaacaaggtgtgccagcggcagtggtggggtgttcgccacagccgccgttttggagccacagtgtgccgggagccgtgctcctgctatgtgtcctttgccaggtgtcacaccaacacagcgccgcgcggggcacactcagtgcaggcaggaactggctggtgccagtggcctctccagattgtcccacgctgtgtggccttgggtacacacgggttccctggggagcttccctaccacctgggtctcaccctcagagactgaggtttaattggtcttggcatcacctagacctgctaaatcaggactctcatcctcacaagatcctaggtgcttggctcactttaaagtctgggaagcactgggagctggcacccagcagagcagtgttcagagagaggccagggtgcttgagggggtcatgtctc

SEQ ID NO: 247455 - DNA, 472 bp, Homo sapiens
ggagagcgacaagtgtcagtatacagtaaatcagtgaacgagtatttggattatataactttaaacagtgaatggggctgtaggaaaaattgaatgggtaattgggtagagggactggaggataggtaggtaccgttttagatagaatgatcagggaaaatttctctaaggaggtaggattagagctgagaaagagacagatctaagggatgtattccaaaaacagggatagaaaatactactaccctcagataagaataagttaattctgtccaatggcagtgagggggccagtgtgtaaggtacagagaattgaaggacaggggaacttggtgaggtttgggggtttggtggggtctatgtgccacagaaagctgattttgtttttgtcacaatgggaagccattagaggctttgaagcacatgaatcaacatattcttatttataaaggccattctgggaaaaacagtg

SEQ ID NO: 247456 - DNA, 453 bp, Homo sapiens
cagaactaatcagtgagtttggtagtgttgcagaatgtaagctctcaatataagtggtcttttgtatttctgtatattagcaatgagcatttggaaaatgaaataagaatacaatttcatttaaagtaacatctaaatacatgttgtgcttataaataaattcaacagactgggcaccgtggctcacacctgtaatctcagcactttgggaggccgaggtgggcagatcatgaggtcaggagatggagaccatcatgcctaacacagtgaaaccccatctctactaaaaatacaaaaaattagctaggcgtggtggcatgtgcctgtagtccagctacttgggaggctgaggcaggaggatcacttgaacctgggaggcagaggttacagtgagccgagatcgcatcactgcactccagcctgggtaacagagcaagactctgtctcaaaaaa

SEQ ID NO: 247457 - DNA, 422 bp, Homo sapiens
gtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaactgtaatctcagcactttgggaggccgaggtgggcagatcatgaggtcaggagatggagaccatcatgcctaacacagtgaaaccccatctctactaaaaatacaaaaaattagctaggcgtggtggcatgtgcctgtagtccagctacttgggaggctgaggcaggaggatcacttgaacctgggaggcagaggttacagtgagccgagatcgcatcactgcactccagcctgggtaacagagcaagactctgtctcaaaaaa

SEQ ID NO: 247458 - DNA, 452 bp, Homo sapiens
cagataacatgatattcatgatatcactaggaaaacccctaaacaataattatgttttagaaaatcaaatgaaataataaagcaacaaaatataaaattgacatgcaaaaaaatcactagccttcataaacagtcagaaactataatagaaaaacattatttaaaaaatcaacagaaatataaaatgattagtaataatcttaacaagaactggtcaaaaccaatataaagactatgaaacatttcttgaaagcacaaaagtagactgaatgtatcgacagacatcttttatttttggatatggcatattaacattattaacatttcaaatctctccaaattaatttatgaattaatacaatctaactaataaaaccaaaaagcttccttatgaaattagaaaggtggatagtaccagttatatggaaaaaaaaacataaaaatcctaagga

SEQ ID NO: 247459 - DNA, 467 bp, Homo sapiens
atgaaggggttcttcaagatcgtgatccagtgctacagccatcttaactggttggtccctattttgtacttactggtaaatactttaaatatcactcctgcctcttcatagccaaagcacaggacactgcctagcttatcaggcttctaattctttggcaaaataataaatgaagacataccaggtctatcaatggcccagggtcaatgggcatgctgtcaaaactatgcagacaatgatcagtgatcagactgtcaagaaaaatccagatactaaagtactagaaaagaaaatggtcaagtctgtctattctctgtgtttgccttcagcatttgataaaataaatgcttatcttgataatgtgcaaaaaaatcttcaatgtgatactttatagagaatataattcaagtatttttaatgtttttaaataaagtttaaaagcaaagtttctataaagtaagtctcca

SEQ ID NO: 247460 - DNA, 382 bp, Homo sapiens
caagtttttttctaatttcccttgtaatttcttctttcatccattagttatttaggagtgtattgtttaattttcacatatttgtgaatttcccaagtttcttcctattactgatttttaatttaagtctattgtgctcagacaatatactttatgatttcaatcctatttaaaggtattcgagtttattttatggtgtatgcaccatattgtcagtcgtggagaacgttttatgtgtacttgagaatatgtattctgctgtttttggtgaagtgttctgtagatgctggttaaatctaagtttatttaagtttttatttctgtgtggatcttctgcctattcattctataaataattaaaagtggggtattgaagtctgta

SEQ ID NO: 247461 - DNA, 370 bp, Homo sapiens
tcctctgtgtcgactgggaaagtggtacccatctcccgggctgtgtgtgatcattgaatgagacacatgtcagaagccctgcacatcacaggcccggcgcgaccgctcacgcctgtaatcccagcactttgggaggccgagacgggctgatcatgaggtcaggagatcgagaccatcctggctaacacggtgaaaccccttctctactgaaaatacaaaaaattagccgaatgtggcgacgggcacctgtagtcccagctactcgagaggctgaggcaagagaatggcgtgaacctgggaggcggcgcttgcagtgagccgagatcgcgccactgcactccacctggacgacagagcgagactccgtctc

SEQ ID NO: 247462 - DNA, 368 bp, Homo sapiens
ccgggtacagcttaggtttctgtagggtttcacattggaaacattctgctcgtttcaattcatgtttttgcctgtttttgttttgttgcttttcaaaaaagcaactgatttacttcttaacactcctaattcatttggagccgtccaaatgttgtgttggtcagaaggggctcagcagccagggagcgctgctctggaaaggacccagctgctgctgaggtcgcctcgaaacccaggtcgctgtggtctcgggcattgtattttcagccccaccaaacaaggagctttttgttgtgagccacagactcctcctaggttagcaacaccacgctgagcaggagtgctgggttagttagggcggcagccat

SEQ ID NO: 247463 - DNA, 343 bp, Homo sapiens
gaaaatgtgatgtagctgagtgggtgagatcatttatgaaaaagaatattgggagaaatgagagcctctatgacaaatccttgagacactccaaaacttctttaccagacaatgaagaataaatttgaaaagcaggcgcagagtggctagagaggctgaaggagaggcaggaaggtgttgtgtcttgaaagtcaaggaaatgttgtgaagggtggtgtagaaacttatgcttcagtaacttcgacatattagtttttttttgcaagagtataccttcaaattaaaaaagataagagttttcattaagaaagttttattccatagttggactgtcataaagtga

SEQ ID NO: 247464 - DNA, 356 bp, Homo sapiens
ggtagtttggggtgcgagtccaggggcgagggaagtctcgagatgaggagaaatgtaggaggcagccgaagggccggcaaacgcggacagagatggcacctgagcgtccctgggagaacctgggcgacaggccagagaccgaaagaaatggaggcacgaaaagaagcttcgagaaactgagggactgaaagacgagggtgttgggagaggagggaagctgaaaactagagagcgtgggcgagagtgccgatgggttccagcgagagtcttagagcccacgaggccgagaggcgtggtcgcccatgaacttggggagtggagggaaaagtcggaaactgatcgtggacactagaaac

SEQ ID NO: 247465 - DNA, 548 bp, Homo sapiens
aacattagaacattacatctgtcctttaattaagcctagtgtagcttaaaggccaaagttacaaccttacgactaggctaaaagacccaggaaaggtagaatggttgacgaagataagagtatttccctgtggcagagagtgactgcgtgcactccattccccagggccaacgtactagcctgtgggctcagggacttaagctaattctttccagccttgccaaccttaatccaatcaatggtttcccccatgacctaagagttggcacatctcccttagtatttgaaaacacaagagaattccaatctcttattttcacttattaatcagctcctccattgaggagagtgaaaataattagaatagttatttttatagatcaaacatggttacctgttagaaatttcacatgatcctcctacctactacttgcaacacagcaatgtcggcctggttgtgtatttttcaagttctcagaatgactctttttttttttttttttttagatggaatctcactctgtcacccaggctggagtgaggtggca

SEQ ID NO: 247466 - DNA, 961 bp, Homo sapiens
  misc_feature (259)..(259): n is a, c, g, or t
  misc_feature (267)..(267): n is a, c, g, or t
agcggggacagagagaaatgccgaggaataggggcgcggccgcccggtttcggcgatgggttatagggtccgcgtcagccccgcgcccgcacagccaacgtcacgccgcattcttatttccaaagacccctggagcttggggtcccaccccagcggtctttcggggcgtcccctgcccttcacgcgccgcgccggctcggcccgaagcgccctgcggacccgcagcctgggccgccccgaaccggacggccccgcgggntcggaccnggaggaacggcctcgctttcagagaccacggaggcggtccccgctgtccctctggccgggtcctcagcacgcgttctcctcactcccaggactagcgagcggcgggcgggaccggggcctgggtcggagcggcgcagccagaaaggccccagcggcgctgagacgtttgggggaagcgggggcttcgcgtttcgatggcgggaagcggaatgaggttggaccggccgggccggcgttcagggacccggcgggaggcggagggctggcgtcctcgcggacatccatctgcagcgaaccaggcagaggctttgggattagatccttgactccttgcgtcagtagttaaggtttgtttaaatataaaatgggatggcccttcttacaaggttgctggaggattaaatgaataggcatgtggaaagcacctagtataataaggctcggtagtttcttccatcagggctggaagagaccacggagcctgctttcctccttcggcgtttgatctcacatatcccttcttctctggcgatcaaaaatccctatcttctgtagagatcccttttacagatcagtggcctccaggcggtatctctagcaacaagtgctaccccaagcggccggccacacatattccctggcttcatgacatagggaggcgcagtccccacgtgatgcagaagggaaatgtgcc

SEQ ID NO: 247467 - DNA, 458 bp, Homo sapiens
gtccgcggaggctcagagagggagtgtagggggaaggatgtcaatgggaggccccagcctgagccctgagcagctggccagccaggaactggcatgtgagtgagaggcatcctagtctcctgctgctccaaagacaatgcccgctgaacaggatggcaggccacatcagcagtccatacagaagtgaggctgtcgtttcttcccctggagcaccagtgaggacaggccccagctgggagccaggcaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatggtgcatgctgctgccaaaccagagatcacttgtagacttgaaagggaacatgagct

SEQ ID NO: 247468 - DNA, 824 bp, Homo sapiens
  misc_feature (259)..(259): n is a, c, g, or t
  misc_feature (267)..(267): n is a, c, g, or t
agcggggacagagagaaatgccgaggaataggggcgcggccgcccggtttcggcgatgggttatagggtccgcgtcagccccgcgcccgcacagccaacgtcacgccgcattcttatttccaaagacccctggagcttggggtcccaccccagcggtctttcggggcgtcccctgcccttcacgcgccgcgccggctcggcccgaagcgccctgcggacccgcagcctgggccgccccgaaccggacggccccgcgggntcggaccnggaggaacggcctcgctttcagagaccacggaggcggtccccgctgtccctctggccgggtcctcagcacgcgttctcctcactcccaggactagcgagcggcgggcgggaccggggcctgggtcggagcggcgcagccagaaaggccccagcggcgctgagacgtttgggggaagcgggggcttcgcgtttcgatggcgggaagcggaatgaggttggaccggccgggccggcgttcagggacccggcgggaggcggagggctggcgtcctcgcggacatccatctgcagcgaaccaggcagaggctttgggattagatccttgactccttgcgtcagtagttaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatggtgcatgctgctgccaaaccagagatcacttgtagacttgaaagggaacatgagct

SEQ ID NO: 247469 - DNA, 384 bp, Homo sapiens
tttacccacaaagaaattccttgaggacaaagaacaggcaatactcaaagtcatccctctgctcatgtgagacaaatgcatatctgattgcttcctctgccctattggttcactaagccagactaaggcacgtgactattcctgtaaattgtgcattcagtgaaaggctaatcagaaactcaaaagaatgtttcaagttgtcccacctttctgggccaaaccaatgtacatgttacatgttttgattgatgtctcgtgtctccctaaactgtatgaaaccaagctgtaccctgactaccttagacacatgtcgtcaggacctcctgaggctgtgtcgcaggcatgtccttaaccttggcaaaataaactttctaaattggtaaa

SEQ ID NO: 247470 - DNA, 369 bp, Homo sapiens
agccctccccaaggattcctatgaaacaaagtcaggaatgattttcctggggactgagagtgcccacagggctctttctgctgctttgtctacccctatagtttgctcagctctctagatttgtctcagctccagtttttcagctgcctcatagatcctgcaacagcaagccacttccttcaaaggatatgtggattctctcagctttcctggtattttcctgtcgtagttattggagcaaaagcgtgagtctccacatgctactctgtccatctgagtgggagctgcaagttagtcctgcctcctcctcagtgtagttttcatttgtattattctgatgataaatgattttgagcaccttttcatgta

SEQ ID NO: 247471 - DNA, 556 bp, Homo sapiens
tactttatagagattagtcatatgtattgttgacttgtcctaatgatataaattgggacttaacccacaggcccagtccaatcatgagaaaagcatcagacaaattccaatagtggggcatcctactaaatacccaaccagaactccttagaactgtcaaggtcatcagaaacaagacaagtctaagaagaaacagccacagccaagaggcacctacagaaacaaaatggaaatgtggtttcctggatgggatcctggaacagaaaaaggacattagggaaaaactaagaaaacgtgaatcaactattgtattagttcattttctgttgcttatagcagaatacctgaaactagataacttataaagaaaagtagttgttttcttacagttatggagtctgagaagtcaaaggtcaaggggcagcatctggtgagggccttcttgctggtggggactctgcagagtacagaggtggttcagggtatcctataacgagggggctgagtaagctagctcgggtctttcttcctcttcttataaagccaccagtcccac

SEQ ID NO: 247472 - DNA, 576 bp, Homo sapiens
atgaaggaacagaaatccagaaagccgggccagaaatagcatccgtgagcatctattgatagcataaagtccgtgggcagaaacccacaggcccagtccaatcatgagaaaagcatcagacaaattccaatagtggggcatcctactaaatacccaaccagaactccttagaactgtcaaggtcatcagaaacaagacaagtctaagaagaaacagccacagccaagaggcacctacagaaacaaaatggaaatgtggtttcctggatgggatcctggaacagaaaaaggacattagggaaaaactaagaaaacgtgaatcaactattgtattagttcattttctgttgcttatagcagaatacctgaaactagataacttataaagaaaagtagttgttttcttacagttatggagtctgagaagtcaaaggtcaaggggcagcatctggtgagggccttcttgctggtggggactctgcagagtacagaggtggttcagggtatcctataacgagggggctgagtaagctagctcgggtctttcttcctcttcttataaagccaccagtcccac

SEQ ID NO: 247473 - DNA, 239 bp, Homo sapiens
aagctgagccataaccgtcctaccaacccacgtcagcagaagagcccagtgggagggcgtgtgttcacttctgctcctctgggcaaagacgcccaggtcagaaacacccacccgaccctcccactacccagagacagccccacctgcacagctcagagcaggaccactgaccctctggctctccggtcatatttgctattgaagaccagaataaagtatttttatcaggattgaataca

SEQ ID NO: 247474 - DNA, 108 bp, Homo sapiens
caggcttctttcagggtagacccacgggactgtgtagaaaagggcttgaaggaggagatttgtgccggagcccctggtgctgtcaaagtcaaataaaatatacagaca

SEQ ID NO: 247475 - DNA, 341 bp, Homo sapiens
tacagaaatagtctccttatacttggcagcaaattcttagaaaatgaaattttaaaaaatctgtttataaaagtatcagacaaaatatcaggaaaaaaatttgacaaaagatatgtaagacatctacaccaatatgaaacactgctaagagaagttttaaaaagacttacatgaagacgtagaccatgttcatgaattagaaggctcaatatgttaacatgccagttctccctaaattgggatggcattgaatctataaagacttataaattgagagtacattctaaaatttatgtggaaataaaaaggagctaggacaattaaaaccattttgaaaaagt

SEQ ID NO: 247476 - DNA, 488 bp, Homo sapiens
aagagaagaggtgtgaacatgccggaatgtcttccagaggtaagttaataacttcattaggatgtatttacttggagggtatatattagaatgacatttttttaaattacaaatcaaaattttaatttgtgttacagataacataaaacttactaatttttaagtgtatgttaagtgcattcaccttgtgctactatcaccatcatctatccacagaactcacgtgaaactgaaactatatctgtcaaacagtaactccccattcctccctccttggtccctggcaaccattattctactctgtgtctctgtgagtttggttactctaagcacctcatggaatcatgtagtatttgtccttttgtgagactggtttattttacttaacattatatcttcaaggttcattcatgttgtagcatgtgtttgaatttccttcctttttcaggctgaataatactccacatttgtatatacaaactgtttat

SEQ ID NO: 247477 - DNA, 566 bp, Homo sapiens
ggtcacaccagccacacttccagggctcagtagccatatgtggctagtggctaccatattgggtagcaaataggcttccctgggggtgatttgtgttttgaagaatgagtaggagacagccaggaattggcaggagaagaggctctgggcgagggcagcagcccgggcaggggtgggaacatcggggagtaggagccgctccctagagctgcccctgtgtctgtgagtctggagtttgtggcgaccaaggagaatagcgagagatggggccagcgttcaacgatcttttcagtttggcttttattttaaggaaatgtggaaccatgggaagattttaagagtgggagggacattatttaatgttaaatatggaggtgaaatttacatcacataaaattaacattttaagttgttcagttaagtagcacttagcaccttcccaatgttgtgcaacgaccacatctgtctagttccaaaacacttttatcacctcaaaagaaaaccctatatcctttaattaattaattaattaatattttagagatacagtcttgctctgtccccca

SEQ ID NO: 247478 - DNA, 368 bp, Homo sapiens
atatctgtatctatatcatctattctaattctcgtatagtaaaatataatggtttttgccattatttttaaatggcaaaagccgcaattacttttgcaacaactgtctatctatctagagaaaatggtttggatctgtgtccccaccaaatcccatgttgaattgtaattcccgtgtaggtggtggggcctgttgggaggtgaccggatcatgggggcagcttctcatgaatgggttagcaccatccctttgctactgtcctcacgatcgtgagttctcatgagatgtggtcacttaaaaatgtgtcgcaccttttcctcctctcttgctcctgctcttgctatgtaagactcgcctctgccacgact

SEQ ID NO: 247479 - DNA, 314 bp, Homo sapiens
cttgattctgaaggggtaggtacattaaaggattttattgaagagaggatcatgactggatttgtagtcatgctgaggaaatagtggtagttagaaatggatctgaataagagttatcagctttagggcctgacaagagttttaaacttgtctctctgtttcttccagaaacaaattgttcaaactctgttagcttccatttcaccatgagatagtagtaattctggtttgagaaagtagaaattctgacttgggtttattttgtaaggattttgtagatgttaattaaaaaaaatttattttagatggtaaaa

SEQ ID NO: 247480 - DNA, 489 bp, Homo sapiens
aaaattcagcctaattattagctgtgctttcttggataagttatttagattctctaagctgttgtctcacaagtaaaatggagatatgtctgcctcataggctattaagaggatagcattctcatacagcagtgttacaaatgatgtatcataaaataatagtccaaccacctgccacatttcagaaacaaaaaaagatttatactttacatgcaatagacatacaaaaaattttaaattctgagggaaaaaaatgaaaatgccccacacatttgagtcatttatatattaatctggaaagaaatgctatctttctgtaacttctgttttatatttttatttcagcattcaccctgtgtgcatgagctgtattaaatgtatctgacatacatatatatatatatattttgtttgttttgttttgtttgtttagacagggtcttgctctattgcccaagctagagtgcagtggtgcagtctctgctcact

SEQ ID NO: 247481 - DNA, 409 bp, Homo sapiens
tctttaaacatgttaaatatacttatatattatgtgtgcaataattgcatgatctgaaatcattatgtgtctcattttggtttgttttctttttccttttccttttttttttttttgagatggagtctcactctgttgcccaacctggagtgcagtggtgcaatctccgctcactgcaacgtccaccttctgggttcaagcaattctcctgcctcagcctcccgagtatctgagactacaggtgcacaccaccatgcctggctaatttttgtattttttgtagaaatggagtttcaccatgttggccaggctggtctcaaactcctaacctcaagtgatccacttgcctcagcctcccaaagtgctgggattaacaggcgtgagccaccatgcctggctggtttttttt

SEQ ID NO: 247482 - DNA, 608 bp, Homo sapiens
ccctgtggataggggggaccattgtacagacatctcctgaagaacaagtgacagctcagcccccatgacatctgaatccaaccagaccaaaccgatgtttctccgcagccaaagccgcagacccagtgaggcattgttctggctcaaatgcacacaacagtttacatcaccaggcagaagagttagctaggcctctaaaatgtctgttccaatttgtgtggctttattggtttctttaagtatttttattatttaagtttacagataacattgtatgtttctatcacatatataatatgatccagtgtgtgtgtgtgtgtgtgtgtgtgtgtgtttgtgtatacacacacacatcttggagaatatatagtacatatatacatagtatatatacacattggggtcgctttatgtacagcgcgatactcccaccattggggagtcgccgaacctagcttgtttatcttttttcattttccagaaattcagtatttatgcgataccttgtagtcccgtggcttaaatataacttccttaaattttattgccgggcacgtcaccggtacttttcattccttggacaatttggtcggcatttatggatcaag

SEQ ID NO: 247483 - DNA, 442 bp, Homo sapiens
acatttgtgtaaaattagatgtgggagagtgctagggtctgaatgtttgtatctcccccaaactgatatgttgaaatcctaactgtcaaggtgatgatattaggagggtattaagaggcagagtcctcatgagtttttgcccatttttataaaatagatcccagccgggtgtggtggctcacacctgtaatctcagcactttggggggcccaggagcacaacacttgtgctcaggagttccagaccaacctggacaacatggtaaaaccctgtctttacaaaaaatacagaaattagctgggtgtggtggcataggcttgtagtcacagctactcaagaggctgaggtgggaggattgcttgagcctgtgaggcagaggttgctgtgagctgagatcaggccactgtattccagcctgggtgacagagccagaccctgtctc

SEQ ID NO: 247484 - DNA, 471 bp, Homo sapiens
tgtggttcttgctttcactttgcagtctcttgtagtgtcctaattgccctttcggcatataaaagtctctaatctcttcttcagtctcttggtatcattcttttcctaaaatatacatttgataatgccatttctgtgtttagacacttgaaacgattcttcagtgcctacagagtaaagttcaaagccttctatgatctatcccaccttgagtaactgattttactttccagtgtattctttcacttttcttctttaaccctcacctcctgtatgtacacattttgtcaacatatgctatcctgaaaacacatttttatgctattcgtttcatcctgctgtttcttaatcttagaatgctctaattgttaatttctgcctgctaaaatgtgattcattctctcaggtaaatattaaacaccatctttttcccaaaagcttcccataacgctctatgaatcatgagacttc

SEQ ID NO: 247485 - DNA, 574 bp, Homo sapiens
cagaaggagctctggtcctgcctgccagccccagagggcactcaaactttggaggccagccacccggatgaagtgaataaggcctgaaaattgcttgtttgctcgtattgtaaaataataataattaccattattatttttaaactgtctaatttctctagggaaagtaacatcgaaagcctaaaacagacgccaaaaggcccatagaacacagagggccctctctgcctctggccaccacagcccctaggccaggcatgggtatttattcttaggtatgttgcttttaagaagatgtaatcagcatcttgagccgggcctccctttgtgaggcttctgtaactatggaagtgtgatttacgcagatttgtcggggtcagagacgtctttccctgagcactgtgtatatttagacaggactcggtttggtgttaaaaagtgtatatgttgaatggattcacacacagtagccaacaatgaccacattgtcggcccgtgtacaacgcgtattgaaacgcagcgcccagacttcaactaatctgccctcaataaagctgaaataattatcctaaaa

SEQ ID NO: 247486 - DNA, 525 bp, Homo sapiens
tagtagagatggggtatcaccatgttggccaggatggtctcgatctcctgacctcgtgatccacctgcctcggcctcccaaagtgctgggattacaggtgtgagccactgcgcctggcctttggctcatttttttaataaattatgagttgctgagcatctcattgggtagcagggtttttgttgttgttgttgttgttgttttgttttttttgtttttttgttttttagtagagatggggtttcaccatgttggccaggatggtctcgatctcttgaccttgtgatccacctgcctcggcctctgaaagtgctgggattacaggcgtgagccaccgcggctggccaagggcagcaggtttaaaggaagagagaacacagtcatgacactggtgctgtggctgaattctagaaggtagtcctcttcccaattttactaactgagaaaagtaacaaggtaaggctcacttgtttaagaacagcaggttagcaacaacatagtgccaaacgttctgacattaacatc

SEQ ID NO: 247487 - DNA, 394 bp, Homo sapiens
cagtagtcatcctgacagaaaatggggaaggtgagcactaagataaagataagtatcatgaacagaaagaattaaatttttgtaacagaattgttagaactggtgagatataatgatgagggaaggagaggagtcgaacatgatcttgaggactctactcttggaggcttaaaggaatgtgttgtctgtaattgtcacagggaatcaggaaggaagagccagttagggtcaagcgttagaatatgttaagcttaataggctttgacactcagatgtgcccatcaagcagttaggaattggattattttgtttggaagaggtcagaactagtcaagagatttcatagtccttggtaaaaatatggtgtgaaaacactaaaagggatgagttcgta

SEQ ID NO: 247488 - DNA, 398 bp, Homo sapiens
ggagtggtcagcccacccaagccccgcctctgggcgggggcccaagcgatttccgagtgctgaaacctgggatgacagagcagcccagggaaagcgcgtgttccagtttactagataccacagaagtttttgcatttctgacaagtggatggccccaccctgactcatcaacctggggatccacgaaccaactcagtgcaagaggacagcttctacttcttatgatttcacctctgacccaaccagtcagcactccccattccctggccccgtacctgtcaaactatctgaaaaaccccctaacctctgagcctttggtgagatggatttgagtaacaactctgtctcccacgtggcatggccagcctcgcgtcaattaaactttctttactgcaatg

SEQ ID NO: 247489 - DNA, 830 bp, Homo sapiens
taaaaatataatgaagacatagacattatcaaatacaacagatagcactaaccttccctttgaaccgtccctaaacatccacactcacatgtcctttaaatacaaaccacttttctccaggcttcctaacttggtaaatccaggtaccttcccaggtcgttcagagaattgggagcctcgttccacatcacttttccccagcccagcagcacaaaaccaatcagctgacaaattcatttccacttctcaaggcctctcatattaatccctcctttccacacatatactgccctagctcagaccctctcatacttcttaaactgacacagacaacctcacttggaggctaactggtctccttatctttaatcccaaaatacacctatttaccacacagatccaaaacctcgtaactcctttctcaaaatcctgtaatgccctgtcaattgcattcagaagaaaaccaccttttcatcctttctccctttaagagcacattggtaagagtgtaaatcccagttctaccacttagtaggtttatttcatttgtaacctctatctcatttgtaaaaaaaaagaatcatagtactctcttctcaataaaactgttctaaggaaataattaatactaataaagcactgagaacaatgcctagcacatagaaaatgcccaaaaaaggttattattgttatccaaaccctatcctgcctcaccctacagactacttgtacttttataagtatttattctacagatttattgagtccttatgactaggagatgaagatacaaatatccattaaaaaatgttccgcattatctggccttc

SEQ ID NO: 247490 - DNA, 320 bp, Homo sapiens
tgttgcgtccagccagagcagttccgcaatgagaaatgaatgcagcttatgtttgtctcaggctcagtccacacaaccatatgactcctctgagtctaaataaattcagttccttaaacagatcagcaagtcttgatcattttttaaaatggaatctcaacgttcaataagttcaatgtcttgtcacattaagaagaaattagcaagaaatgagatgagatgggtctataacggacaaaacagacaaccacttaacactattgattatgtatgtttgccctaatatatactgtcctgttaaatttatatgagtggataca

SEQ ID NO: 247491 - DNA, 157 bp, Homo sapiens
ttagggttaagtttatctcatgttctggtcccataactttagcccctgaggagaaacaagacccagcatattaagcatccatcagggagtctgtataccaagatccaatttgagtaagtctgttgcaggatcaccttatcctaacactcatgcaaac

SEQ ID NO: 247492 - DNA, 625 bp, Homo sapiens
atattgttgcttgcatattcatgcatagttcaataagtttctctgttatttgaaaatttcttgttagtagtcagttctggcaagattatatgagatggtgtatctttcatcaggaggcacataatttcgagtctctcttcttttctcttagttctttctcttttttaacttttaggttcagaggtacatgtgcaggttagttatgtaggtaaattgcatgtcacaggggtctggtgtacagattattgcatctccccagtaataagcatagtacctgatgggtagttttttgatcctttccctcttcccacctttcaccctcaagtaggtcctagtgtctgttgttcccttctttgtgtccacgtgttctcattgtgtagctcccacttataagtgagaccataggtaggtggttttctgttcctgcattagtttgcttaggataatggcctccagctccatctatgttgctgcaaaggacatgatctcatgaagttttttgagaagtttttcagtatggttttcacgtttgttgtcaaacaaaacaagcatgcccttccacaatacattccgtgatgtttcctgctgagagacatgggatgctaattggaacaaaacgtcgatc

SEQ ID NO: 247493 - DNA, 350 bp, Homo sapiens
aaaatcactatagaataagtacataattttctcttggctgtaattctgtattaattatttttatataatgctgagaatatagtagatgttcaatacttatctgctttaatgattgaattaagacttttgggatacctgaaatatttgtagtattggaaaacagctaaaaaagatgccaaacaagaagtctacatagtgagctttgtttttttaaactctataatagtattcatatttggaccaatctctgttctgatcatatctcctgcatcataccactatatcatattctcaaggcaaattgcagacacaagatttttatagttaatggttttcatgacatatgagag

SEQ ID NO: 247494 - DNA, 696 bp, Homo sapiens
ttttttttttttctctcaaaatcaaacaaataccaggcctctgttggtcagttaagagtggttagtgcagccaccagatctgtaagactcagaggacaggcttgctggagagtattttgtcaatcccccatcgcccttgggtgctgggaatgtcagctgtgttccaatccagtttccattcatggaagacctagccatcacatagggttggaaggaggtcctgggacaactgaaggtttctggttgaggctacacctcagtgttatctgaaggaccccgaactaactccagttcctgacagcccatcacggtgtcggcaccaggacttccagtctttcctatcacattttcttccattctctcctttgtgactatcatgtctcctatcccttctttgtatgctatgctgaaggtgtttttagaccctgggaatataattttgttgggatagaatcagccagtgccttagtaaccaggaaagtaactcaaagaattgctgtttttgtgatttcctagaaacagggagaattcaagatttcagtctaaattttcacctagtaaggacctttttgtcccccaatgataggcattcatggcactgtatgggaggatatttcaccctcagtgaataccctcctctccatttgggctttgtgcccagcactgcccagtgaatcttttttctttctttctttc

SEQ ID NO: 247495 - DNA, 372 bp, Homo sapiens
agcggcccccgcgcgtgggcgcgggctcgagtggcgacgtgggccgcggtcctggcgggggagaagcacccggcgggcaggcgcggggcagggaagccccggggaacccgcagcccctccgcagacccagccagggggcgcgcgcccgaaaacgccccgtgtgcacgcgcccgcccccctccccgcgccccgcgcgcgcccctcgcagcctggagccggagcgctggctccgcgcggcctggagaggcggagaggcctgtccaccgccccctctgccgcccacgccccgctgcgggtcggaggagcagctcccgctcgcaggtgctcggagaggccgggccgcggctcccacaggtgccgggaagcggccgc

SEQ ID NO: 247496 - DNA, 184 bp, Homo sapiens
ccaataaatattatcccttttcctaattcaatagttagcaaaccgtgctcttttcaaacaaacgttaacatgtaaaacaggtagaaaacctctctaaggtttttgtttgttttgttttcatgagtggcaaggctacacggtcctttcaaaaacaatgtcctaagaaacacacattgtttgcaaa

SEQ ID NO: 247497 - DNA, 461 bp, Homo sapiens
tgagactatttttagataaatgaatgattaaagagtacagtgttattgcacaatgtgtttttatacatttggtatttttaaaaaatgatttcttcttttatgaagaaaattactcctcagtttctttgtagatttgaaaaatgtagacatttttgaggtgttagagctttttgcccccaaattaaaattattcattatagaatgtaagcaggaatgacctccaatgctttaacaatgtgtgtatgaccctttaaatgcttcagttattcttaacgaagggaatttgggaatattcttatttgatgtgatttttcaatgaataatgaatgccaatagaaatttcctgggatatgtgtctgcattcaaaatgtgaaatgtgaaatagctaatttaagactgcctgaatataaatgcatactttttttaatccaagagaagaataaatttagttgtgaaaatga

SEQ ID NO: 247498 - DNA, 572 bp, Homo sapiens
tttcttgtctgtttttccaccagtgtcagttcccaatacctgaaaagatctaagtcagcttctgggagagtatacagaaggatctggagggattcagaagagcctatgccaccagcacactaacttgctcctatcacccagcccaacttggagctaggagctctgaaggctaccaaagaggacttgtggagaggggagggctcagggatttaagaacagctctctccccttggtggcagctggaagaccaagaattgagaatggcatcacaagatggaaggagctggatccctgagttactgcatggagagctgccaaggaaagcagctcagccctcatcagatgttgcacaagcaaaaaaaaaaaaaaccaacaaaaaaaaaacgttcattgtgttgagccactgagatttggagactctacgttactgcagcataacctaccatgatcctcaggtaagcccctaggacatgggggtagggtggtttagggacaggtattattactcagcctaaggtaaagtgtctgtgttgtagtgtgatttgaatggggaagaagacattatattaaac

SEQ ID NO: 247499 - DNA, 503 bp, Homo sapiens
cagtaattcagtaaatttttgaggttaatttttttattggagagattccctttatcaaacaggttcagtgtttaatactcacctggcagagaagttttttctgataccagcttctgtgaattttatttgttggtatgatttatctgtaatgcttattaagatttagtatagtggacaatccaacaataaaggtagttctctacagattaagaagttgctaagaaaagttttgtggaccaaaatacttaaccctctgggatgatcactagcccagggaaagatggaattctttttaaaattcttttttttttttttgtaactaagtgctcattatttaagaaaaaacaactatctgccctagaatgtgaaagtttcctgtactcccttttccagaaataactattatttctcatactttaaacaaaatgtgttcatattataaattgttttgtaaattactgtttgtgggcagtgagttaaaatacataaatatttgttactac

SEQ ID NO: 247500 - DNA, 324 bp, Homo sapiens
tcgcctgggtccccgaggccgtccccaggctctcttctcggggacctgttgatgcgcgttccgcccaggctctcctctcggggacctgttgatgcgcgttccgcccaggctctcctctcggggacctgttgatgcgcgctccagggcgagccacgtgacggctgccgcggtgcagaaagcgcccccttgcccggccggacggcccagcccggagcgaacggggagaggagagaagaggaccggagggagcggagggcagtgcagggagcggagaaggaggagaggagagcagcgccgggagcagccgggtctgcacagtcgcgg

SEQ ID NO: 247501 - DNA, 1576 bp, Homo sapiens
ctcctgacctcaggtgatccacccgcgtcggcctcccaaagtgctgggattacaggcgtgagccaccgcgcccggccgccccctgacttttaaaaactagatacgatatagttggaatcgtgtggaaggaagtacatcaggaggcatataagtccatttgggacctgtaatcccggcgactcggaacgctgagacgggcggatcgcttgaacccgggaggcggagactgcagtgagccgagatcgcgccactgcactccagcctgggtgacagatagagactctgtctcaaaaataaaacaaaacaaacactttccacccatggacaccgccaagtctaagtcagagtctcctaaagagctcgtacagctgaagaagctcttcattggagggctgagctttgaaacaaccaatgagagcctgaggagccattctgagcaatggggaacactcgcggactgtgtggtaatgagagatccaaacaccaagcactccaggggctttggatttgccacatatgccactgaggaggaggtggatgcagccacgaatgcaaggccacacaaggtggatggaagagttgtggaaccaaagagagctgtctcaagagaagattctcaaagaccagatgcccacttaactatggaaaagatatttgttggtggcattaacgaagacactgaagaatatcacctaagtgattattttgaacagtatggaaaaactgaagtgattgaaatcatgactgaccaaggcagtggcaagaaaaggggctttgcctttgtaacctttgatgatcatgactccgtggataagactgtcattcagaaataccatactgtgaatggccacaactgtgaaattaggaaaggcctgtcaaagcaagagatggtgagtgcttcatccagccaaagaggtcaaagtacttctggaaactttggtggtggtcgtggaggtggtttcggtaggaatgacaactttggttgtgaaggaaatttcagtggtcatggtggctttggtggcagctgtggtggtggtggatatcgtgcagtggggatggctataatggatttggtaatgatggaagcaattttggaggtggaagctacaatgattttggcaatcatataccaaatctctccctcactaaacgtaagccttctcctcactctctcaatcttatccatcatagcaggcagttgaggtggattaaaccaaagccagctacgcaaaatcttagcatactcctcaattacccacataggatgaataatagcagttctaccgtacaacctaacataagcattcttaatttaactatttatattatcctaagtactaacggattcctaataatcaacttaaatccagcagcagactagtatatctcgcactgaaacaagttaaatgataagaccctttattcatcaacctctcttcctaggaggccggccccgtaacgggtttggccaatggcatatcgaagaatcccaaaaaaatagcttatatcccacaatatagccacataacctcttaacttaattttactagctaattaatcacttataaatatccag

SEQ ID NO: 247502 - DNA, 253 bp, Homo sapiens
agtttcataaagatttcaattttgtgaagaagcttcacttatcagagaatggaattgagaacttaagtgtctcaggatgaaaaactgtttgttttatgtaatcggtcttatatcatgttcttaaataagatcttctgtgtaagaagttcttaccagtcacaaatattcccagttgtcttctaaatttatgattatttgttctaaaattctatattatttaaatattttaaaatcttcttcaaatgaacaactt

SEQ ID NO: 247503 - DNA, 396 bp, Homo sapiens
tcagtaggttgaaatcctcatattgaaagtatttacaacatagaagctggcaaacactccgaatatcagtgattttttgttttggctaggtttgggattgaggttttttttgtggtttttagtgagctgtttgtttgaggagcctgcttaccagcacaaccctgcctaaatcctaagaaaactgtgtttaatgtgcaaatgaagattcaagtctgttaactcatgttcctgccacacgagccagctaaaccctccaaggcagtgataagaagagggagaagactctaagcaaaagatgactccatcactcggatccacagagaccacaggaacatgacactctgcctattctagtccatgtaacaacattgattaaaacagttgaggcaacacgga

SEQ ID NO: 247504 - DNA, 478 bp, Homo sapiens
aaggtctggctctgtcacccagactggagtgcagtggtgcagtctagtcttgactcactgcagcctctacctccctgcaacctctgcctcccggactcaagccattctccctcagctactggggaggctgaggtgggaggatctcttgagcctaggagatggaggctgcagtgagctgggattgtgccaccgcattccagcctggacaacagagcagaccctgtctgaaaaacaaaagcaaaagccaacaaaaaacaaactacagtgagatatcatctcaccctagttaaaatggctttcatccaaaagacaggcagtaacgaatgctggtgaggatgtggagaaaattgaaccctcatacactgttggtgggaatgtaaattagtataaccactatggagaacagtttaaaggttcctcacaatttagaaatagagctaccatataatccagcaatcccactgcttggtatataccc

SEQ ID NO: 247505 - DNA, 500 bp, Homo sapiens
tttattaaatgatgataagttaggtgggcattagataacaataattttatttcatcctcacagcaagatatgaaggatacactattgttatccccagtttacaaataagaaaattgagacttctgcagattagatccaaagtcatgtaatattggtcagttccacagctggagttccaaccttcctattgctagaaggggacagcaatgccaagcaatacaggccacgtggggagggatccaggcaggaaatacagcatggcacaccttgtgtattgcacagttttgccttagctaactaaagaaagggtgtgtgttacaatacttgacagtgtcagaatcaaagggcaaagaaggagactagcccctgatgtttagctcaactcagaaagttggcagtaaggatagttgatgcagcaagtgaagaaaagggaaatggaaaaagaaatataaatctttttcccttcatcttctcatttccaaggttcaaattaactatat

SEQ ID NO: 247506 - DNA, 527 bp, Homo sapiens
ttgacaccagctacccccacccccagcaaaggctggcaggtctgcagcagaagggtgaacaggctggcacaggcagaaaagcgtttatatgtattgatgctcctgccacggacaaaaccctgttaggtgttgggagagtcagaaaggaagtaaatcagaaagaagaaatctggagggagagacaaacatcagggcagcttttatttggatgtagaggtgccttgggataggctgctgtttgggtcctgtccctgcatgtagttggccagtaaggagatctggaaggcctgtgggtggcaaaacaggtctgatacacaagtggctctacttctgttgtagtgtatagtcagtgtctagtcctggaaggccattccagccaagggctgatctgagggttaggtgctggcagaggcacttatttggagatgccgacgttgctgaaagtaaaggagtgttcatactctacaatgggggtacagttggggagccggaaaaggaaatttgaatgtattactgagtggaaaaga

SEQ ID NO: 247507 - DNA, 420 bp, Homo sapiens
tttaaaaggtagatttatatatactgtcaagaaaagatccctaaggcacagtgttgagtaaatagattgtaaaataacccttacagcattttctttttaaaggcccaaactatgtattttcccaatttcctactctgctatatacatacaggcatggacaaaagatacaaagcaaaggattagcagaaagaatgggcaatatcattctgagtactgttcgaaaggagtttagctttgtcacaatgttttaagactgttacaagaaagacgcttgccacaaatgatatttcctaaaagaaaaaaatgtaatatttaacttttcttctgttgaggcaagataagtcaactgcatatatcataaataagattttcttactttacaagaaggaagaactgagatcctgttttttgaatgcaagt

SEQ ID NO: 247508 - DNA, 322 bp, Homo sapiens
cgccgacgactgtcaagagagttggggagtggaactgccggaagtgtctgcgcgccgtgagagaaactttcctgctccggccgcggcccggagcctcgccgcccccgcgttccgaacgacgatgagtccagatgacaacaacctgaggggactcgcgcctcggcccgccgcccgcgcctgcgctcgcctagcctcgggggaggaagactgagcccggcgcaggcggcgcggcgctcggggcccgtttcctccgcgcaatcagtcccctcgcgtcccggcgccttccccgcgatcgcgcgaccccagcgcccgccgcggccgc

SEQ ID NO: 247509 - DNA, 391 bp, Homo sapiens
agaatgaacagaaggaagttcaagagtggtgaaaagaagaaaggcagggagagaaggagaagtaaacttttcttctagagatttgtcttaaaccttagcttggctggacactgtggttcacgcctgtaatcccagcactttgggaggccgaggcgggtggatcatgaggtcaggagatcaagaccatcctggctaacacggtgaaaccctgtctctactaaaaatacaaaaaaaatttagtcaggtgtggtggtgcatgcctgtggtcccagctactcaggaggctgaggcaggagaatggcataaaacctgggaggcagagcttgcagtgagccaagatcacaccactgcactctagcctgggcgacaaagtgagactctgtctcaaaca

SEQ ID NO: 247510 - DNA, 507 bp, Homo sapiens
atagcttataatatcaagtgcctgttcaccattctaaatacttagaacagggtcaggcacaatgttagtgttcaatagatgtttaatgaataaaggaattaaatatcaggaatttcaacgttataccttttactaagtatgtaccaagctctaaaccacaattaacagcagtatgcaaaatatgacttttctttatttctacatgtgaagttcctaaaagcagagtagtattaactgttctctttttatgtataaaagagtggttaaaagactgggttctagcaacagactccctggctgtctcatctattatctgtgtgattttaggaaatttagaagattgtttcatgcctcagcctcctcatctgtacaattgctgccataatagaatctacttcatagtgttgttttgaggattgaatgaggcaatttatgcaatgtatttagaacagtgcctggcatatagtaagctctcagtaaatgttagtttttgttattttccagata

SEQ ID NO: 247511 - DNA, 583 bp, Homo sapiens
cttttctccattgttaactgtttgtttaaatagcaaacagaaggcggcaatggaggtgtggaaaactgaggatccgatgtcacttgaaagtaatgagatcacataacattgagggaatgtcctaagaggagtggcagggcataaatagaaatgaataaaagtgttttcaagtgccatttagtgggttctgaatttgaactagagattgagatatccagttatggagacattaactcaaattaacaaggtagtgaatgggaaagcacaaactataaaagactgtatcaatgtatggtattttttcccagagctgttttgacttaatggcataatagatatgtttaagtttttataacctcacgattatcattccaaatcttattttcctcctagaagcctctgtacagaaaagatgaacttaaaattactcgctttgtagaaacttaatctaaaagttcaaaatgtttaagtagcaatacctaaaacaagttgcagagtaaagaatcctctttttttctttttttcaacattaagatttggttaaataaaacctttgcaaacgtgttgccagctggaaccaaca

SEQ ID NO: 247512 - DNA, 362 bp, Homo sapiens
ccgggaggcagaggttgtagcgagccaagatcgcgccattgcacaccagcctgggcagcaagagtgaaattccgtctaaaaaaaaaaaaaaaaaaaaaaaggatgcatattttagggatacacatgactggattactgctgaaaacagaggtagtttgaaggcttggctcttcaggttttctctcaagggtttcatgggccaaatgttgttctccagttgcacctctgcttctttaagcccatttgttttgtttgctccctgccacccatctttgctaactttagtttgcggtccctcataatttcagcatgctgtggctcatctgattccaaatacacccgtggcataccttgattcagcc

SEQ ID NO: 247513 - DNA, 463 bp, Homo sapiens
ggacttcccggccctgcagtgcgcccagcactgattccgaccagggcacccccttcagagctagggacgaacagcagtgtgctcccacctcaggaccttgcctctgcggcctccacttggaaagttctcagttccctccaggcttctagaagcatctgggccagggctcatggctggataatttccctaggcttaacaacccaagcaagcttcgcctcctcgttttattttttgttaaacttatgagaatgtgttaagaaagagtgcagctcgagagacattcagagatggaacacaccagaccccagatcacaaagccaaccatgcccagcccctcccaacacccccagccccacgaccatcgttctgaattctgacgacgccgtgagcctgcctttgtactttaaactcatggaaggataaccaccttcacgttttgaaataaatgtttcctgttgaaatg

SEQ ID NO: 247514 - DNA, 575 bp, Homo sapiens
tagatgatttgatttaaaaatgtgttatatgtgatacatttataacggaatattttttgctaaaaagaaatgagctaccaagctataaaaagatatagaggaaccttggatgcatttttctaagttaaagaagccaatctgaaaaggctataaaactgtatgatttccaccatatgacactctggaaaaggcaaaactatggagatattaaaaagatcagtggttgtcaggggttaaaggggaggaagggataaataggcagagcacagatgtttagggcagtgaattattctgtatgattcatattggtggatccatggtcattatacatttgtcaaaactcatagagtgtgcaacatcaagagtgaactctaatgtaaactatggactatgggtgataatgatgtgtcaacataggtacattaattataacaaatataccactctggtgcccagtgttaatactgggggaactgatgtgtgtagaggacaatggtatatgggaactttctgtaattttgggaactgaaaactgctcttaaaagaataaagtgtattaaaaaggatcacaccaa

SEQ ID NO: 247515 - DNA, 422 bp, Homo sapiens
cacattcaattttgaacaactctggcctaaagaactttctaagccaagaatctgaaggactcaaactaacccatttcactctctgcgttattgtgtgagaatctgaggtatttattgctaaccaccatctccattatcaggggcccatggcaggtatgtctaatagatcacgatatactttcttgccaatctcagcctcagctatcctaacttagttctccaggcagccacctccaactatctgaagtggcagagagaaaaagcctttttatggtaccaggatcttaaaaccaggggttttactttttttttttttttttttttttggagacaggatctggctctgtcaccaggctggagtacaatagcatgatctctgctcactgcactccagcctgggttcaagtgattgtcctgcctca

SEQ ID NO: 247516 - DNA, 511 bp, Homo sapiens
tgtttgaagaagaaagtctcttctgggttctattttaaaattgtagaaatcaggataaaattttaatggtgtattaaaattgtgtcagctatacagcaattgtggtaaagctggcattgcctgtgcatgctcattaattgttcagtgttccacagcgcatgcctggagagctgttaacacctcagtatttcagttgacaaagtatttgagaataattagagggagtttgttgtttgtaaactttcctttgacatcctctgacaaggtcaaggtaacaccattattaaaacttgtaaaatgatgatatcatgaggaagaaattggatgtgaatatgagatattaagacaggtaacctggtttcttcaccaagtcaactgcatgtttaaaaaaaaggaaaagggctgtacttgatcaaagaagacttaagagagaattggcagaccttgctgagaatatgatttgatgcacgctgaagtatttaggagtgggatttgccataaagtatatcaa

SEQ ID NO: 247517 - DNA, 335 bp, Homo sapiens
gcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactca

SEQ ID NO: 247518 - DNA, 605 bp, Homo sapiens
tattataaaaatgcataaaacatgtgagattagcactgagataatcaaataggccaaaggaacaaagtagaaagtccagaaagagacccacacatatacagatcttgaatacataagagaggtggcattaaaaacagtgggaaagacaagcgattcagtaagcagtgtgggaaaaactgactacccttaagaaaaataaaataaaaactagatctccccctcacaccatacacaaaattaaattctggacattaaagattcatattaagaaaagcaaggccttaatacacttggaaaaaaattaaaggagaatgtactttaagacctccaaggttgggaagtatttcttaagaaaatttaaaaagcaaaaattgtatggaaaaacattgataaacaggtacctcaaagaaacagaaagatgttcaatatcactggtaatcagaaatacaaattaaaacagaataatgacagcatctgtattatagtgctggtgatgacatggaaaaatagaagctctcatttactatgcctagaaatgtaatttggtacagctactttggagaacactttgacagtttctagagttgcaagtaattgtccaacaa

SEQ ID NO: 247519 - DNA, 388 bp, Homo sapiens
attgttttatttaattttatgtaatacttgggtacaagttgtttgcctcttttcattaggaaacccttatatggtaaagtaatggcaatatagttttttttaagtagtattatgctctccttgctttgctgcatgttgtttttaaaaaatttgttgcttctgagtaatacttattttgtttaaatttttaaaattaaattattcttgttaatattatacaatataaaatatttacctatgctgcttaggtcctacttaggaaaattaaaaatagttacatgctaaagccagaatgagaaatattttaaaacaatttaaattatactaatatttttattaatgaaattggggctgaacaggaactatgtcaggaccagaattgtgaaga

SEQ ID NO: 247520 - DNA, 477 bp, Homo sapiens
tcacttcaaagttgaatccactgcatacgcagcagccttgtgacacagttataaactcttccctactacaagctcatagggcatcccattaccctgtggacccattaccctggggacccaacaaaaggagatctgtacctcctgaaaccagtttataaaaaattaaagagctgtttgcttcttcaaatttatagacaccagggtaaggctacatggttccattgtcaatgtttctattttaacatagcagtgaaagtactttgcagaagaattagtcaagaaaatgaccctaaaaatgacattcaaattgaggaaaagaattaaaatgttgctgtttgtaggtgacatgatcttatatatagaaaaccataaacaatacatcaaaaactaacaaatgccctcagaaaattggcaatatataaaattaacatataattatcagttatgattccatatgctaacaacaaaccacctgat

SEQ ID NO: 247521 - DNA, 368 bp, Homo sapiens
ccgcccccgcactgtgctcaggcctgaaccaagctgagagaagttaaagagccccacctctttctcttatcacagctggttcaaggttcaatttgagtctacaatgggtcaacactgccagagaagctcagtgtcttgggttgcatatataaaggtattctatcatgaattagggaggtgccatactggtcctgtcagaggaattctgacatcttcaagtacgtgaaggggctcgcctcctaaagagacacttgatttgcttagggttactccaaaggcctgaacaagtctaacaaaatgttatggcttgtatgcgccatagggtcatgattgtccggtcaataaagaaagatacacaatagctggaa

SEQ ID NO: 247522 - DNA, 384 bp, Homo sapiens
aaaaaaaaaagagaaattaaaaattagccaggtctggtgcacacctgtgatcccagatactcaggaggctgaggtggggggatcccttgagtccaggaggtcgaggctgcagtgagccccactgtattcccacctgggtgacacagcaagaccttatctcaaataaattaagctgcatgatattctattaagtgttttgttagatgcataggttatcatctaccttttggagggtggcttctactgaaccactggaaggtttggttggccataaagtccaagattttccccaatttatggatctgttctgaattccacactaccagcaccctactaccaccaagagcaagccctcaggaaccccactggaacctttcctcagta

SEQ ID NO: 247523 - DNA, 559 bp, Homo sapiens
ccaagctgtcagtgctgctgctgatgcctgctgacgttaccatgaaggctgctgccacccaaagcttttcatcactctaaatgtagtctgttccacagaaactggacagaatgatagcactgggctccactcaggaacacatctcctaagatattgacgagcaagctgtgccgcagtggggtgagggttggaagagggaaggctccagagcccgggcttcattctctcacgcgaagaaacaacagggagaggacactcttggaaactctccagctccctcactcttctctaagaaagagagttgctttatctcgttgacaaatttggaagcaaatactgggcatgagcagctcagctcctgcccatacaggactcaagctctggtgtattctccacatgccaaagctcaatggcacactctgtccctgcagcgggagcctatggcattgcctgtgattgggggtgaggttatctattctgagattcaagatggaagcctccattgcccctcctaagccatgctttccagcactgtaataaaactggatttttttccctc

SEQ ID NO: 247524 - DNA, 727 bp, Homo sapiens
taagcactttacatggattagtattatagtaatagctgtttgctgttaccaatattatcatcaattcaatccatatcctttgtatctctgtgttcatgaattctttaagaaacctgaaaaccccttaatttttgtatgattttcgtatcctcattttcttaggtagttatttaaaacatttttttcaaaatttgaaaaacttaaacagaaagtaaaatgtttcataatctcacccctataaaaacataaagtgagaagtaaaatctctgcctactcttccaattcctttttccaataaaccaccatccatccacactgttaaataaaaaactattcaatgacacgtgttaaaacacagtaaggcagattttattcaggatcattgcaatgagcacagggaccacagcaacgggattttggagtgggggagagagattgggctcacttgcaagtacaacatgggtaagtgggaatttatagccatggagcaaggtgggggcagtggatgctcgggggtaaggagtattttggctaaaccaaccccacaggattctagctgaaggccacagggtgaccaaacatcgtccaggagaggatgaagaacctgatcagatttgagggtgatcagattttgaggatggaggttcttgctaacctgacttagatgagttttttgctaaaccggattttataaggaaggtttagcaaagagcccagaagaggccag

SEQ ID NO: 247525 - DNA, 515 bp, Homo sapiens
cagaatgaaaacattagacaccctctcgttctctttctgctcctctcacaatgcaggcccattcagaacacaattgtgatactcctggacaggacgtgaaaaaggcaccggagccgctacgtgcacagtaatgacatctcaaaggccaacagcactggctggagaataaaggcgttttaaaggtctaagaacactggattgaagagccaaggagaacccttgatggatgaggaggaaggcagagcccagcaaatgacaaggcatttgtgaccaggtttccaatgccggagtgaggtagaacaaaagtactgaagagacaggagcttccgttcctgccccggtgccagcttgtctttcccgtttcccaggaagctcagctgactacaagcctacgggggtacggccctcctcttatttctgttgcctcttgttagttgagaaatgttagtgtctcaaattgttttagtccctcaaattgcctttaaggataatggtaataaaatgatttaagctac

SEQ ID NO: 247526 - DNA, 770 bp, Homo sapiens
cataaattagggcataaatacattgatcagctggctactagcaaaccaccagaactctgccgctatctggaatgataacctgtgggatacagtcaactttctgccagagctccatttgagcttgagcctgtcatactcagctgatgcccaagtgaccccttctctcatctttcattcatttttcatgcttacattttcatactaccctgctttgttcccttgccacctcttacttccctccagaggtttacagccataagtcaatggcaaaaaaaaaaaaaaaaaaaaaaaaaaatgccttacaatacagtgcctcagtgtaagatttagaaaaagctagaaagatgacaagttgaaaagatgttctcacccttgtaatgggctgactcctgaatctgtgttaccttcttgtacaattcactgacctatttttcatttgtttcttaacttggttttaactttggcctattattctaaagttggcttccagaatccaatctctattctagttattcattctttactcaaatatagttttaaggcccagtctttgcctagcacacaattgaaatgttgaccataatacccccttgatatctttctcatgctttattctctgtgaagaatagcagcgtgcacctttgtttattcctcatgaataaaaatatcaataagaatatatgagtgagagcatagtatgtattttataacacattgatttgtcctgtgaccctaggcaatatatattttattaaaattatacaacaatg

SEQ ID NO: 247527 - DNA, 528 bp, Homo sapiens
taccatttgtcttctagggtagctttatcccatgagtcagttcatcagtgaatatgttttgatgtttacaatgagcctgtcactatgttcggcattaagaaaggaaatagtgaggtcagaaacattttctattctcaataaactcacagtgtaatgtctgattctaaaaaggaaacgagttattataggtcaatttaatgaaacacagaggctactagaaccttcagaaagaccacagagtttagcctttagaaaatttcttgaaggaagtggtgtctaagctgaaatcacaagaaatcaagaagctaaggagatgagaaagggaagcagcaaaggggaacagcatacacaaaggaacagcatatgcaaagcggaagtagcaagggggagcagcatatgcaaagagggaacagcatatgcaaagggaaagccttcagaaatttatttttcctgtttctattagatttttctacaggagagctggcaagagaaatcacactcagtaaacatgtgtaatgttttaatacc

SEQ ID NO: 247528 - DNA, 168 bp, Homo sapiens
aaatattaccagaagcatagataaagctcaaatgcaacacatcatatggtgaataattcagaagataagaaaaactgatttctaatctcaatttttttaaagcctcttggtacagtcacattcatcaagaaatataatcaacctaaagagttaaaattttcttttgta

SEQ ID NO: 247529 - DNA, 313 bp, Homo sapiens
ctaccagacagcctcttgtgaaaggactgcctaattaaccctgtgctaattaacaatttaaaattacacagtgcgactgttcatgtttcattctccgggagctggagcaacagcaggagccccctccccttcgtcataactgcacccctcccaccccagcttccctgaaactgttgcattttacccagttctgcctcaagggaacaggataaaactgtcatcagcacatgtttttaaagagggagatgaacgttttgattaatagggagatacagggtaacagggtagagttttatccttttaaacaatcttt

SEQ ID NO: 247530 - DNA, 400 bp, Homo sapiens
atcccagcactttaggaggccaaggcaggtggatcacctgaggttgggagttcgagaccagcctgaccaacatggagaaatctcgcctctactgaaaaaaaaaaaatacaaaattagccaggcatggtggcgcatgactgtaatcccagctactcgggaggctgaggcaagaaaattgcttgaacctgtgacctcaggtgattcacgtgccttggcctctcaaagtgctgggattaaaagcgtgagccactgtgcccggccaagattttttttttaaagacagagtctggatctgtctgtcaggccagagtgccatggcacaatctcagctcactgcaacctctaccttctgggctcaagccactctcccaccccagcctcctgagtagctgggactaca

SEQ ID NO: 247531 - DNA, 897 bp, Homo sapiens
gaaacaagcagcaggctacattgggtccacagcctgcagcatgcttacccctggcttagatattcagaaccactggtgaatgaagaatgtattttgctttagaattttgtgatacaacttttttctaagaatatatatcctaatttctatgttatatgctgtatgtacattgatcttttaagatttaaaaggaaaatctgtcgactgaaattgtcttatatacaagatgtgcaagcagtcacaccctatcccacctctctgtgtttgtctatgagtgcgaaaaaacacagcagacccagtattttgaaaccaaattagagcagcaatatttgtgatagtgtattcagtggaatgcaggtaaagaatttatttttctgttctatggaaatgaaaattcaaagatcatacaaaaacagaggtgctaatgtgtttcacgttttaatagtcttggtttagctgcttcaaacccaagtcatattttggcggacctgaattgtaaggaataaattaagacagctttttgaaacagaccacttagaagtttatttcagactaacttttactaatactttagcattaacttgtagacagctctagttttacttccaaataatgtagtgatatacggatttttaaaaaattatgtgtaacattttatagaactctgctgtataaagcatggacacttgcattgggagatttattttagtgcttctggtttatttgcacattggcttgggtagtaggttctgttgacattcagaagctgtcagaatgccttaccatttttcttgggggaggggtgggagaaggtggttagtgtataattgttccctcttaaatttaaatatgggacaaggaaaggaggtaattgttgtgcttttgaattccagtggg

SEQ ID NO: 247532 - DNA, 894 bp, Homo sapiens
  misc_feature (831)..(831): n is a, c, g, or t
  misc_feature (834)..(834): n is a, c, g, or t
  misc_feature (849)..(850): n is a, c, g, or t
ctgaacaagattggagtacccacaataacctgtcagtatcctataaaaagctaacttatcatactgaatttgggtgtttgacaaacttttagttttgccataaaataaatgtattcattgctgggcgcagtgagagaaatgaaaacgtgtccacataaaaaccagtaaacaaatgtttatagtggctttatttataatagccaaaaagtgaaaacaggtcacaaatccatcaactgatgaatgaataaacaaaatgtggtataatagattatttttattgctacaaacgttgaactagcaaatcctgaacctttgctcctagaggaaaacacacggttaggttcctgtgagcctctagtcacatttttgtcagtagatcatcagtacacaccttcttttttatgtgtttctgatgaaagacaccttatttatttacttattttaaatttcaatagccttagggatacagtagttttgggttacacagatgaattatatagtgttaacaccttacttaaaatatatgtaaggccaggcgcggtggcgcacacctgtagtcctagctacttgggaggctgaggtaggagaggcacttgaactctggaggtggaggttgcaatgagtcaagattgcaccactgcactccagcctgggtgacaaagtgagactccatctcaaaagaaaaaagctccataggagaaggaaccttgtctcttcaccacataaactgtgtttggattcgcaatcgagttgggaaaaaaaaatcagtctggaagagccacaccaaaccgctaacagctactgtctctgggaatagaacaaggagtttgntangcgcgatatgccgcnnctgacctctagccacaataaggcttattaatgaccagacgacgt

SEQ ID NO: 247533 - DNA, 400 bp, Homo sapiens
aagttgaaagttctacactcagatgattctagactcatggtctagatgtagatgttctggactggtggttctcaaagtttggtccctggaccaaccacatcagcgtcacctaggagaaccttagaaatgcaaaactcccatcagcaacccagccctcttgggtcagaactgtaggttagcaagatccccaggggactgtctgcatattaaaatcaaagaaacactattctagactattattccttgcggctggggctttgttgatctttgtggcaccagcactaagcatagttcctggcacacagtaggtgctcaacaaataggaggaatagaaaacagtaggcactcaacgaatgcttactatttttctgttttctttctcttttcttttttttttttt

SEQ ID NO: 247534 - DNA, 454 bp, Homo sapiens
ggttaacacctggtgcaacagggatcctctagtattctggcatccactataatgccagaatggttggtgcctgtagcataacagttgttacatgtatcaaacctctcccctgttaataacagaagatagtagcagaagctttgagcttggagttatagaggctacattacaacagctactatctgcataaatcactggacccttctaaaattccaacttcctccttttaaatgaagttcttactagctacctagtaggactgtttgtggattacatgcaatgacatgaaagtgctgattagcacacagtaggcatatcattcactttgccttactagaaaaatagtaaacactacatgaaaaaattagtaaaagatgtagtattttacaaacaagttgtgtttcaaacactcatttttgaagtcagtagtctggtaattagaatgcattttccc

SEQ ID NO: 247535 - DNA, 518 bp, Homo sapiens
aaccgtagaatgtcctgttagtactcagcctgtgtatgagtgctttcctggccttgatcattctcccaagtggtgaaagctgctgactggtgtgcttcagtgcaaaaatctggaagaaggcagcacacatggtgagagctttaatgtacgctggctcactgaaggatggtcggaggctgggaggcagttctgaggaacaagtggtgctgcgggccccgacgttctttctgccacatttagctagtctccctcctgtgccttcacgtgcgacgatgacaaactgccttacaattttgagtgcggtaggaggaggagaaaaagctgattgatttctcacatgcagaggttgtgttggaattttacggtttgccttccatgtgagccagttctgcatctgcagattcaaccaattatggattgaaaatatttgagtgtgaaaaacaataaaaaattattaaacattctacatataacaaagtttcatatgtaccccatgcatatgtacaaatataattaat

SEQ ID NO: 247536 - DNA, 541 bp, Homo sapiens
ggatatcagttttcccaggacaatttgtggcataggcgatcctttccctgtttaattatcttggcccttttgtcaaaaaccaatcgactatatatacgcaggtttgttccttggctctccacccagtcccactgatttatatgtctcacgatatccatgccacctttcccctacaaagcgttctctcctcttcagtaccctgtcccacaggtttaaaccttatcagcagccctaatctctaatctctgcctccttaggtcagaggagtcccctcatgctcttttttctctctacctagtgatgtcatagtctagcaattgctcccagatagagagccagggcaaatggggcttaccccaggcattttcttttcctcaaggatcacaatcctggactgtcttgtttcatgcctgaaaacagttgcctcatatgtttcatctagttttatgtttgtttatggcaggaagcctagtccagtgccagttattgcatcttgaccagaattagaagttacagctttggctcctaaccataagttgta

SEQ ID NO: 247537 - DNA, 2260 bp, Homo sapiens
attgggaggaggataagctggggaagaggctggccacactggttgctataaccaccaccacttccggtccgttcctctttacggcccacctcagcgctgcccgcgcgaaatttgtatccctctgcttgtgtccactggctcctggggagcagcgcagggaggaggaggaggaagatatcaaagagccctcccattgggggccccagatcgccacttccggtgaccagaggtagggaaggaaacaatcccgacccggagtggacaggtgaggaggggaggacttgcctcgccgaggccgctgcgaggagcgtgcccaagggcgaaggtccagggaacccggctcccgcgcaccgaagacggccgccatgccggcccgttgtgtggccgcccactgcggcaacaccaccaagtctgggaagtcgctgttccgctttcccaaggaccgggccgtgcggctgctctgggaccgcttcgtgcggggctgccgcgccgactggtacggaggcaatgaccgctcggtcatctgctctgaccactttgccccagcctgttttgacgtctcttcggttatccagaagaacctgcgcttctcccagcgcctgaggctggtggcaggcgccgtgcccaccctgcaccgggtgcccgccccggcacctaagaggggagaggagggagaccaagcaggccgcctggacacgagaggagagctccaggcagccaggcattctgaggctgccccaggtccagtctcctgtacacgcccccgagctgggaagcaggctgcagcttcacagattacgtgtgaaaatgaacttgtgcaaacccaaccccatgctgataatccatctaatactgtcacttcagtacctactcactgtgaagaaggcccagtgcataaaagtacacaaatttctttgaaaaggccccgtcaccgtagtgtgggtattcaagccaaagtgaaagcgtttggaaaaagactgtgtaatgcaactactcagacagaggaattgtggtctagaacttcctctctctttgacatttactccagtgattcagaaacagatacagactgggatatcaagagtgaacagagtgatttgtcttatatggctgtacaggtgaaagaagaaacatgttaaaaactcaacatcaaatgctctgatgtgctatagattttcaaatctttactcacataattatctctttgctattgtaaatctttcacttcaagataatttgacagttgagtatcagcataatttgtttagctctaaggcaaaagtttgcttgcttgccaacacaatgaagataatacctacccacaaacatccctattctctactttcacctttttttttcttttaatccttttggtagaaatcaggttacaaagcaaaaccacaatatcagcaacacttcctaatcaaaattaagcattgaatatttgtttaagcttagttcagaagcaacgctcctacaggacttgacatttgctagttagaatatccctactcttctaaataatttgaaagtatagagcagtaacacagtaacagtgagcacagccaagcctgacactactaaatgatttggtagtgaagccaggacatctacccttgactattttttatgttatttatttattagtttgtccatttgtaacatgtatagatctgtcctgtgagcatttctgatgaatctatggttcttacagaaatttttcaaaggaatcaatttagagatagagttttcatatacttacattaacttattaatgaaatctgtttgcatcagtgcttactgcgacacattaattagcttgattaatttagattagaatcattaacatcatgaaaaataaaagtactacatttctaacgtattcccattgcaggtgttaggtattttttctgtcaacacctctcttttgaattctacatttgagaaataagcatggaaatattagctgccccgtctgccattcaccaggaaaaatttctatggcaattttgtaccatgaagtaaactgttacaatagtttctgagaagcatactataactctgatcttccattgagaataacaaaaataaatatcaattttacacctcatatgtcttcttagttctgaatgattagaagaacttgcatgtatttttatcctagaaggtttaaataatacatcaaagttattttcttccaaatgtaattttatgtctgctttaaggaaaataaaataaaatattaataggaaaaaaaaac

SEQ ID NO: 247538 - DNA, 1040 bp, Homo sapiens
taaacagagtctcactctgtcgcccgggctggagtgcaatggcatgatctaggctcactgcaacctccacctcccgggttcaagcaattctcctgcctcagcctcctgagtagctgggataacaggtgcatgccaccatgccaggctaatttttttttgcacttttagtagagatggggtttcaccatattggtcaggctggtctcgaactcctgacctcgtgatccacctgcctcggcctcccaaattagaggcgcgagccaccatgcccggctaaattatctacatattttctatgactgtatcttgcttttaaagcacatgtactgtctgtccagattacctctgctgccttgaatacaaagcatttcatattgctgtcactcctgcgtagtgcaaacactttccaatgaagtagacagaacttcagaaaataccctaaggagccatgttaaaaacgaccaagacttgttcaactagcaacaaagatggcccctaacgctgcaataagtttaaactttgatccttagttctaagtgaatcaatcccaattaaaatgcaggacttcatctactgtattttattaacatagttgagtatcttaatcctagctgtgaactaaatattcagcaccccaaggctgaatatggtattcagtttaaaacacctactccacaacagaagtctccttgctttcacattggcttccaccaaattgtaaaattaaatgacaagcataaagttatacaactcagcatagataactatccaagtgatatgcagtatcattcaggaatttaggctcctttgtgggacattttatcatcttttaaagcaagttaagtttagaggcaataaagacaaaatgccggggtttaaaccctactgctgcctttttttaagacaggctcattgcagccttgacctcctgggctcagttggtcctcccacctcagcctcaccagtagctcggactacaggcacccaggttcgagtgcagtggtgcgatcatagctcactgcagcctcactttttaggct

SEQ ID NO: 247539 - DNA, 862 bp, Homo sapiens
caactatggttgctaacacaagaatcggcactggtgacttttgagccatcaatcatcctttcctaacacatgaatcttttggaaaatggtctcaaatagtcaagaccccctgctgggaggagcttctatcctgctctgtggaagaaatgggcatgccagatgcctggaagatcagaggctcacattccagttcaaagttagagaaacctgagaggggtgtactggtatgaccacccgagatcccatcgctgagaaagataatggccctggagacaaagactgatgaagaaagacagtatccagctgtgatgcagatgaaacatgcggcatggttgcactcactatgcagccaaggctggaagccactctggatccagccactctggcacagcgttcttgctctaggaagaacaactgaacatggccacacaggcctcacagctggcatatggaggctgttaataagctgagcttgaggcttcaaaggactcttgtagcctgtgctggatctagcagtgaccagtatgccagtggccatggatgcccaggcccatgttcagtagtgaagcaggtgctagcagcagaagcaatagaaatggaaactgggagatctgctgtggatgaatctcattatcttctttctctgaccctctttggactaaataaactcccagtattcttgaccaacagaggtagggttggaacagaacctcaaaagtcatcattagacttcctactaatagggcattggaagttcaagcgactaactaggaaacaggttagtatttgtacccctacactgtgcaacagattacataccatttgctctatttggcatcctttccttaggctagattcccag

SEQ ID NO: 247540 - DNA, 725 bp, Homo sapiens
aagagcaaggccataggagagaagaaactaatattcaaagcttcctcccacagttcaaagttagagaaacctgagaggggtgtactggtatgaccacccgagatcccatcgctgagaaagataatggccctggagacaaagactgatgaagaaagacagtatccagctgtgatgcagatgaaacatgcggcatggttgcactcactatgcagccaaggctggaagccactctggatccagccactctggcacagcgttcttgctctaggaagaacaactgaacatggccacacaggcctcacagctggcatatggaggctgttaataagctgagcttgaggcttcaaaggactcttgtagcctgtgctggatctagcagtgaccagtatgccagtggccatggatgcccaggcccatgttcagtagtgaagcaggtgctagcagcagaagcaatagaaatggaaactgggagatctgctgtggatgaatctcattatcttctttctctgaccctctttggactaaataaactcccagtattcttgaccaacagaggtagggttggaacagaacctcaaaagtcatcattagacttcctactaatagggcattggaagttcaagcgactaactaggaaacaggttagtatttgtacccctacactgtgcaacagattacataccatttgctctatttggcatcctttccttaggctagattcccag

SEQ ID NO: 247541 - DNA, 764 bp, Homo sapiens
cgtgatctgccccctgcagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaaggtgagaggggaggagagcaggaccagccggctgatgcagctgcagctgagggcctgggggaatcactggggctggtgctggggttgggagatgaacgaagaagccccatagaccccctaggagcttggaagaagaatgtatgcaggaccccaaaactctgacgctttcatagagtccaggggcctgtagcaaaccagagagccataccctggctgaagaggcagctgttattcagcccagccacacgccgccttgcaggggtgcaggcccagcattgccacattgtcacctttttccaagagaagccagaaatctggacttaatgtagactctcgtgatttttagacattgataatcaactcaaaaatttt

SEQ ID NO: 247542 - DNA, 341 bp, Homo sapiens
aaaatttccaaataggattcattttaggtattgacagtggtactcagtggtactcactgtcaatacctaaaagaaaggaagaaagcaatgttctgtgaagaacttgagctaaacttctgaagttaagggttttgcttgtggtcatctgtggtacatgattacttgagatgagatgccacgatggtggtggaggtaaagaagtaccagcaggaagaaatcttcctgtgcttattccttcagagggggtatctgttgaatttttttcattttggtccttcttatgtagccatgaaggttttctaaagaatacctaaaaacggccaggtatggtggctcacgcc

SEQ ID NO: 247543 - DNA, 396 bp, Homo sapiens
cagaaaccatctggccagctccagagaccctgggcactacccttccactcccctcttcctgccatgcccttgaagagggactggggtctgcacatggtcattcctagccatggtttgagcctctcctctcctcctcactcacctcccctggcttatgttctgaaagggtgagctccagctccagagaatttgaccttggggtgaagacctagccgcagtgaggtttgcaggtggactgcagctggccctgtgcactttggggcaaagtgctccccggggtctgttctgtctgccgggaacagatatgtgatgtggcacttcccaccaccccagggatgggctactgtccctcctcagagggaccatcgggccctcatcaacatcacctccacggtc

SEQ ID NO: 247544 - DNA, 168 bp, Homo sapiens
ataaaaagtagaagaaaagcctatttttagaaaagaccaaattaatagctcctaacagtgtcagggacatttatttgttcatcagttgagtctgcatagacaatctttgaatcaccacagctgtttgagcaaacctggattggaggacaagctatgcagttaactctg

SEQ ID NO: 247545 - DNA, 387 bp, Homo sapiens
cctgtaagtctcagtgtttctctaacttctgtgagccactctagcaaattaattgaaccaaaggaggaggttaaggacagcatagtttacaaaatgagccctgtttctgacatctgaagtgggggcagtctagtgggcctgacctcttaacttgtagaaacattctttctttctagatgactagtgaccagaattaaattgaatcctaggccacccatttattgtcttctgcagaattggcgagaatggagaggaatcctcacctatcggtgaccagagatgaaatattctgaattgagagtttaaaagagcacacttagaagagatttagagtttagtttttcctgtcagtcttgcaatagtgtcaacatacgttaaaatgatctg

SEQ ID NO: 247546 - DNA, 363 bp, Homo sapiens
ggaaatggagtctcactcttgcccaggctggagtgtggtagtgtgatctcagctcactgcaacctccgcctcctgggttcaagcgattctcctacctcagcctcccgagttgctgggataacaggtgtgcgccaaaccacacccagctaatttttgtatttttagtagagatggggtttctccatgctggccaggctagtctcaaaactcctggctcaagtgatccgcctgcctcagcctcccaaagtgctgggattgcaggcaggagccaccacacccagccaggggatagtaatttgttatcgtttcctatttctgtgctgtggggaaaaacccaacatgtcttttgtaattaaaaagaga

SEQ ID NO: 247547 - DNA, 742 bp, Homo sapiens
tgaagaaaaagacttattaaaagctgaaagatgccttcttgaaacactggcattagcaccacatgaagaatatattcagcgccatttgaatatagtcagggataagatttcctcatctagttttatagagccaatattcccaaccagtaagatttcaagtgtggaaggaaagaaaattccaactgaaagtgtaaaagaaattagaggtgaatccagacaaacacaaatagtaaaaacaagtgataataaaagtcagtctaaatccaacaaacaattaggaaaaaatggagacgaagagacaccccacaaaacaacaaaagacatcaaagaaattgagaagaaaagagttgctgctttaaaaagactagaagagattgaacgtattttaaatggtgaataacattaatatttatcgtgacaatggtatcaaagaacatcaatccgtatcatgtgattgcttttactgggagctttgaaaaaaagttcaagggttcctaatggtcaatcatgagctgccttgaagtaggatcaaaataagattttcattaaagacctgtattatcccaggatgtatattatgtatcgctgttttcagagtgtgggtgaatatagcagaaatattacagcggaagtgacaaatttacaacttttattatagaaagaaggtgtttctggcaatgtaatctttactgctctcaattaaaaataattttgaggcctgaatgataatcccttgaggaca

SEQ ID NO: 247548 - DNA, 191 bp, Homo sapiens
tcaaatatacaaaaagttattaatactaggaagaatgaacagtcaatagaaaaacagtcaaagaacatgaaaagggctgggcgcggtggctcacgcctgtaatcccagcactttgggaggctgaggcaggcggatcacgaggtcaggtgatcgagaccatcctggctaacacggtgaaaccctgtctctac

SEQ ID NO: 247549 - DNA, 781 bp, Homo sapiens
cttttatgtagctctttatgacttctgaaagaaagatacactttttctagaattattttcactaactgataaaggtttagtctagactgtgagtttcagggacctgaatgaacataggataggtttaagaacaatctgatttcaaatgttagtgaaaataattctagaaaaagtgtatctttcttttatgtagctctttatgacttctgaaactttgtttttattgtttctagcaaaaacctagaaacaacttaaaagttagtaagtaggtgattggctaaattaatgttgacatatccatacaatattatattgtgccactgttacaatgaatggtttagcccagaaatggattcataggttatgcaggcaagggttaattcagctagcatgggttactcatatccagccattcccaaaaaaggcctcttttcaggactgcccttgcctggctcctgggagatgagtgctgggccctgggaatactctgcctagtaagggtgttatatgcctgaggacttgagccacaggtactggtttgatcagattgtttatgcaaacagtgtgatttatggtgaagcctatttttctctggggatctggggactacaatctaaatagctgaggtcatctgcatgcaggcattgcatgcctagtgactgaccctcaatagaaatgctggacattaaggcttgagtgaactttcctggttgacattactttgcatgtgttgtcacacattgttgctaggacaattaagcacatgcatgcgactccactg

SEQ ID NO: 247550 - DNA, 683 bp, Homo sapiens
tctttacctgcaccccagaagcctgactgacccagattacctcaaatagcacatgcctagagtggcctctgaggtctcagttcttggggtgggggtagtaaagggggtggtgtgatccgagtacatttcaatcaacatccagttggctctgagtcctggggtccacctgaaaccaagccaggctggcagaggccatgagcccatctctgggcctgaccatcagaggcatccccagttgatttcgaacagcctgagataccctctgggaagggagtgtgggtgccaggagtctgtaatgagataatcatcacacagtgagaaggagaggtcatcccagtaagcacctggggggcttgggatgctggcacagtgcaagaggcctgtccctcggggattcttagcgaatgagccttgtcacttgaaaatgaatgtgccattgtaaagaactcaggcaggggcagtggttcatgcctgtaatcccagcactttgggaggccgaggcaagcagatacttgaggtcaggagttccagacaatcctggccaacatggtgaaaccccttctctactaaaactacacaaaaatggccgggtgcggtggctcacgcctgtaatcccagcacttcgggaggtcgaggcaggtggatcacctgaggtcaggacttcgagaccatcctggccaaca

SEQ ID NO: 247551 - DNA, 383 bp, Homo sapiens
aagaaagcaagaagcttcgttaacatgataaaataaatcttctaatatataacacccagcgtcatacttaataagcaaacactgctgtcagggacaagatagatccattctaactactattattgaacagtgtcctgaaaggataatctaaccaatgcagtgaagcaggataaagagtatactactggaaagcagacaggtttgggctacaagctaagtatctacctagaaatctgaagataataaattctgaaaaatggtcagacctattaagagaaaggcacaacgatgttcactaaaagatacattttaaaactttgaaaatagcttttcagtacaggtaatagccatttgtgattgggcgtacggggagggtaccgagc

SEQ ID NO: 247552 - DNA, 496 bp, Homo sapiens
aaatttgtcagcctcccaactataaatatgaaagcagcctatcatatttacatttctttaatataccatttcaaaactgcagatttgtgttacagttatttcagtatatgtcctgtccctgttaatgtgtaggtttgtaatagggagatacatttcatatcttctttgttttatccatgctgcctgccagacagtcttgtacatggtagatactgaataactatcaaatgaataagtagttattaagaccaagatacttttcagagaaaactttaccaacttctctaggactaggaccccaaatctgtgctcagagctgctagctttgagctgtatcttaactaggtgagaggcaggataaagtgatatattagaacccattttagagatacgactttatgtgaaaagtatctagttaagaagaaacacaatatagagaccttttatgtagttttagccttccttacctaatagtgacgtaatccttcaacagaaa

SEQ ID NO: 247553 - DNA, 1313 bp, Homo sapiens
  misc_feature (68)..(68): n is a, c, g, or t
ggggaaactcatttccatttcttaaccatattgggcctgagcctcagttacctacctcttctgtaaantgtaaactacctcttggggtccttgtgaggattaaatgaaacttgagcctaaaggggctgagctgggtgctttgcaaataacccaaccttagcatgaggcacggtatcatcattacggctgtggtgtttgtggtcacctatctgcaagtcacgctttcatagatatggtagagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgtttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtggataagttctttagtggtgatttctgagattttggtgcacccatcacctgagcagtgtacattctacccattgtgtagtcttttatctttcactcccctcccacttagaataatggtctccaattccatccaggttgctgcgaaggacattatttcattcctttttatggctgagttgcattccatggtgtatatgtatataccacaatgtctgtatccactcattgattgatgggtatgcaggctggttccatacttttccaattgcgaattgtgctgctataaacatccatttagagcacatctcaggggtcctcatagaacagctaga

SEQ ID NO: 247554 - DNA, 387 bp, Homo sapiens
atgacaaggtctagcagaccaacacaccctccattatgtgtggcaaatgcatagctgggtgggccggtcactagatggccaaattgttcatgcgattacacttgtagagctctcagagatctcgttgaagtaggaagatgagtcatgggaggaagtgtcacctatgagtctttgtaaagtccctgattacagtcagtgttagagaagggctgacatcccttgcttctcagggctatgtatggaactccagtatcccctgctcctttttcatgtttgacttgcaaatcggagtatttttgcttaaattccagttcctaagattgttccttacaactttgagccaaattaaaaccttaaaatttgtttccccaacttttttttaatgta

SEQ ID NO: 247555 - DNA, 434 bp, Homo sapiens
aaaaaattgttttctcatgattgagtttgcagagatgtttgtatagtttcagtacagtgctttatcagatacgtgtctgtgcaaatatttcctcagactacagcttgtattttcattgtttttatagtgccttttgaaatgcagaaattattaattttggtgaagtccagtttatgaatgttttctttcacagatcttttaatgatgcatctcagaaatctgtaactaatttggatctcaacgattttatcctgtttagaaacttggcagctttatcctgtacatttaggattatgatctatctcattaagctttgcaaattgtttgtggggtatgaatggaaattggagggtggaatgaacatccagttgtccaagcattatttgatgaaaaaactgccctttctccaatgaattactattgtacctttgtga

SEQ ID NO: 247556 - DNA, 1621 bp, Homo sapiens
  misc_feature (1107)..(1107): n is a, c, g, or t
  misc_feature (1197)..(1197): n is a, c, g, or t
agaaatttctatttaactcccttcaagatggctaactagacacagacaggaagagtttctcccactgagaggccggaccatcaaaaagatgcacaatccaagcagatcttctgaaggaagtaatagagaatggaaggaggaaggactcagatcctgggttgaagggggagggagcagagaaccctgcatgtggttatttagtagcaagacccattcttggtcctgtgtgcttcctggagaaggggtgagttaaataggcatggtttgtggcccacatttgccacagacctccagaatcctagcagcaggagaccccatgacccctgtggacatttaggctgggagagattgctgcttggagagtttgcagggtcacgactcagtattatgaagcccagagagtttggtgtgggaactgctacagtggagtattgccagttacactcacgcctcaagactcgccaaattcctctgggtggctttggtctttgttgactgttggttctgttcagaacagggctatcttgcccatgggattgggccaatctaatctgaatacccccttgtctgccagcctctctcagtgtccctgtctggccacaccctcttgcagcacagcctcagatgttcatatggggcacatcttaaaagccactaccatagcttttttactgacagaccttggctaaccatcagagatattttgcagatgggccccagccagtgtgtaaccacatgcagcctcccccacaccactttgccagcatgcgttcatctgcagcatcgcccaccagtttgccagcatttgcagaccctgctgctgtacccccactggagcatgtgtatgtgtggaccctgctgctatgccagcgctggtgcacatacatgtacatggactcaactgccaccactctgacaaagcactgttgctgcccaccccccataccccccattggagtgttgttgccagcagactggggacacattggcccctccagtgatagcaggtcagagaacaaagccatgggtctagtcccagcacctagggttagagcatgcagaccaagagtgctaaactgagccttggccccctgaaatcattgaganatgaagccagttgatggaacccaacttataccatagtcaaagggtcaaaataatcaaaaaatataaaagcaaaaagcttcatccaaaggncagcaacatcaaagattaaaggaacatcagcctaacagatggaaaagaactagcacaggaatcctggcaactctaaaagccagtgtcctcttcctccaaacaacccactagctccccagcaatggttcataatcagactgaaatggctgaaatgacagatatagaattcagaatctggatggcaatgaagatcattgaaattcaggagaaagttgaaacccaatcccaggaatctactgaaatgatttaaatgctgagagatgaaatagccattttaagaaagaaccaaactgatctaatagaggtgaaaaactcactacaagaaattcattctatattcgaagtattcacagcagagcagaggtaaggtgaggtaaaaatctcagagcttgaagattaattctgtgaatcaactcagtcagac

SEQ ID NO: 247557 - DNA, 1452 bp, Homo sapiens
  misc_feature (938)..(938): n is a, c, g, or t
  misc_feature (1028)..(1028): n is a, c, g, or t
agaaatttctatttaactcccttcaagatggctaactagacacagacaggaagagtttctcccactgagaggccggaccatcaaaaagatgcacaatccaagcagatcttctgaaggaagtaatagagaatggaaggaggaaggactcagatcctgggttgaagggggagggagcagagaaccctgcatgtggttatttagtagcaagacccattcttggtcctgtgtgcttcctggagaaggggtgagttaaataggcatggtttgtggcccacatttgccacagacctccagaatcctagcagcaggagaccccatgacccctgtggacatttaggctgggagagattgctgcttggagagtttgcagggtcacgactcagtattatgaagcccagagagtttggtgtgggaactgctacagtggagtattgccagttacactcacgcctcaagactcgccaaattcctctgggtggctttggtctttgttgactgttggttctgttcagaacagggctatcttgcccatgggattgggccaatctaatctgaatacccccttgtctgccagcctctctcagtgtccctgtctggccacaccctcttgcacatcgcccaccagtttgccagcatttgcagaccctgctgctgtacccccactggagcatgtgtatgtgtggaccctgctgctatgccagcgctggtgcacatacatgtacatggactcaactgccaccactctgacaaagcactgttgctgcccaccccccataccccccattggagtgttgttgccagcagactggggacacattggcccctccagtgatagcaggtcagagaacaaagccatgggtctagtcccagcacctagggttagagcatgcagaccaagagtgctaaactgagccttggccccctgaaatcattgaganatgaagccagttgatggaacccaacttataccatagtcaaagggtcaaaataatcaaaaaatataaaagcaaaaagcttcatccaaaggncagcaacatcaaagattaaaggaacatcagcctaacagatggaaaagaactagcacaggaatcctggcaactctaaaagccagtgtcctcttcctccaaacaacccactagctccccagcaatggttcataatcagactgaaatggctgaaatgacagatatagaattcagaatctggatggcaatgaagatcattgaaattcaggagaaagttgaaacccaatcccaggaatctactgaaatgatttaaatgctgagagatgaaatagccattttaagaaagaaccaaactgatctaatagaggtgaaaaactcactacaagaaattcattctatattcgaagtattcacagcagagcagaggtaaggtgaggtaaaaatctcagagcttgaagattaattctgtgaatcaactcagtcagac

SEQ ID NO: 247558 - DNA, 354 bp, Homo sapiens
tgttactttatagaggtcctggagaagctgattgaggccacgtcaatgttgcaaggagacatgagactcacatcagagttctatggcttaacatgggggatggtgtgaaaagaaacagagatcgttggagaaatgtctgattataagatatttctaagcctggtgaagaaatatataagagaagcctggagaagaaccagtaataccagaaatcagggaggggccctgaagagaaaaggataacaaaaggatgaagacctgtccaagggacccagcagctaacttgaaagagctctcaatgggtaaagctggagcaatttcaacaacaaaataaataacatatcactggattat

SEQ ID NO: 247559 - DNA, 471 bp, Homo sapiens
tactgcctgtaccacacctgggcccactggagctgaacctggggtggtcaaagactgctgcaccagaatgctgggaacagagctttggggtggtactggccagcgagtatgtgggtcctgtgggcacctatggcccctttttgaaattattctgtcccccaggtcctggcactctgggcctgtaataagaggggtatccctggtaatctccaaaatgcctttgggatcattcttccatagttttgatgaatagaacttggctgattcatattaatcttatcaaatgttcacttggttacaccattagtattctctcccaaacatgctttctcatttgttacaatttggagaggctgagagtttttcagatctttaagttctgcttcatttttttatttaaaattccatctttaaattatttttctattttttacattagaagccaagttgcaccttcaacactttgcttaa

SEQ ID NO: 247560 - DNA, 388 bp, Homo sapiens
caggtgcccagcagccccacgtggccagtggccaccacactgaagcgcagctcggaggactctgactgccctgagctgagggaggtgacgggtctgaaacactcttttctgccagaagttaggggacacctcctccctcccaacagctctcttcaggcccaagagtgagagatggtgcctctagagggcaggggctacaagaacaaagtgtccacaggtttccctgctgcccacctgctgcccatcgtctttccagagatcagaaaatgaacaaaggatgatggggcccccaaaaggaggaaacccagtgtcttcagatctgtccacagccttgacctacgaagtttagatatggagggaatagattaaaggcacacttactttgcta

SEQ ID NO: 247561 - DNA, 456 bp, Homo sapiens
ttttttgggttaaatttttcttggttctgagtaccttctaactctgatgttctataacattatgctctgattgaggggcacaggcaggtaagaaagcacttacccacgaaagcttggattgaataacaggtatggagaaatcactcataaactgttcagtcagaatccacctgggggaaacctgctggacctgctcaaccttaaaaactcaagtgtatgctgtgaaggtgttaatggaaaacccaaactgtaaaatatcttaaggaggtttatgcggagccagtatgattgaccgtggcctggggaaaacacaaacccaggaagccttgataagtggtcctgaggcagttagggcacgactctgtcttatgcattttagggaagcagaagtcacaggcaaagtcatacattagtacactgcactccatcctgggcaacagagcgagactctgtctc

SEQ ID NO: 247562 - DNA, 236 bp, Homo sapiens
tcttatctataaactagtaatactggccctaattaccttaggagctagttttcaaaatccagcactgtaatatatgaaggtattgtgggctgggcatggtggttcacaccatgtaatcccagcactttgggaggcctagacaggaggattgtttgagcccaggagactgcaatgagctgtgattgagccactgcattccagcctgggtgacaatgagaccctgtctcaaaaaaaaa

SEQ ID NO: 247563 - DNA, 476 bp, Homo sapiens
tgtttttacaggattctgatacgtgtatgacagaggtggcattgtaagttggtaaagaaatgaggggctgtttattaattggagctgcaaaattggtcaccagtttgggggaaaaaatgaaatcaggccccttgcgccattcacaaaaatccttgtgagatgactcaagggcttaaatgtgaaatgaaaaacttcagttttttagaaggaaaaatatatgtgaatatctctctggtttggcatgaatagatttctggctttggataagtaaggattttttagataagatacagaaagctccaacaatgaaaaaaataataataaattttgtcatgttagagtaagaatttctgttcatcaaaagataccttaaaatggaaaagaggatgcagtgggcggaagatatgtgcaacagttagttgtccaactagaatgtgtccaacacaagaatttgcatccagaactcttaacaacga

SEQ ID NO: 247564 - DNA, 468 bp, Homo sapiens
tcaaaatgtgtctttgcctgatgccctgaaggacttttcccaggaggggaaaacgcctttgtaagacgcaagctgggtgatggcttttgtgtgaggacgtcttccaccatccacccttccccatcctccttctgtcctgggaggctggttgcatggaccacagcaatgggctcccttctctgctgcttccaagttatgttccctgccagtggttggaggtcagggcagggaagaataaagttgggctccatctgtgggatgacccagggtggctgcatctctctcaggaaggtcacagctccttcacattctacacagcctctcctgtctccagattctggaaacctctttcttctctaactctgcacagggccccactaaccctagagagctgcactatcctttgtggctttctttacttcacccacacctttataaacatttcctgtattaaactttcttcgaatt

SEQ ID NO: 247565 - DNA, 417 bp, Homo sapiens
aggcacctaccctcacccactctggcagaagaccttctggaaaacttattccctgtgggttctagatttaggaagactagttacagtgaagggtgggagtgagaagccataatggaaaaggaaaataagtgcaagtcctcattgagagtggggacattgagcccctttccccattcagctccaggcatcacatctctaccctttctacccctacaacacacagcctaggcgggagattgaagaattatttcctaagaaaattaaccagtacaaaagaaataactaaaaaaaccccaaccactggagaccccaaagagatagtttaatccctgcctggttgccccaaagtgaaacatctactcaacatgccctgcctatgcacatttaacagctttcatgcttcactcgttaacaaaa

SEQ ID NO: 247566 - DNA, 343 bp, Homo sapiens
aataccaaatggtctgtgatttcaaggtgcctacggcgttttcaaaataaaaataaatgaaaaagactaatagttacttaatatatgatccagaaactttatatgcattgacaaatagccttaggaaattagtagtagtatcaccatttgcacatgaaagtaagtacattttccaaaatcacggggttagtatagaaatgctttattccagatcctatgactgtggccgttctgttgctattgaagtgtcaactgaaagggtagcaaaaccaggagtggaaaaagtgataccaagtcactatgatattgtttgtgtccctggatccaaccatggctagacttt

SEQ ID NO: 247567 - DNA, 601 bp, Homo sapiens
acggagtctcgctctgtcgcccaggctgaagtgcagtagcaagatctcggctcactgcaagctccgcctcccgggctcacaccattctgctgcctcagcctcccgagtagctgggacgacaggtgtccgccatcacgcctggctaattttttgtatttttagtagagacggagtttcaccgtcttagccaggatggtcttgatctcctgaccttgtgatccgcctgcctcggcctcccaaagtgctgggattacaggcgtgagccaccgcgcctggcgaagatttttttttgttattgttgttatttgttttagaaaggtatgtttccactttccttgccaagaatatgctcccaaaccaattgctcatttgtttatgtgcaagtatgcactcagcctttcggtggaagtgcttgacaaataagcgatttttctaaattagaacaataaccacttttacttaaatgactaaaatcctaactctgaagaacagtcatccagatacacttaaaacacatgccttgaaaagaaccatcacatctataattgtgaccatgggctaacacggcagcaccataagtgcgggttcttcaaatgctaag

SEQ ID NO: 247568 - DNA, 349 bp, Homo sapiens
aaacagatatgaaatccagtgatttcttaggtcttcccttatcactactttactgtaagccattgtcttttctcaacaggattgctgcagtgctcttcaaatgaactctctatcccttcccttacttgttcatatactactctcaatgcagtcgcccaatttgtttttttaaaacataagtcaaattgccatttcagaaacttccattatctctccttttcacttagattgaagtaaagcacttagtgtgggccacaggatcctcccgaatctggaccaccactacttctccgatctcaaatcctaccctttggctaatttaatccacaataaccatctgcggtcctgg

SEQ ID NO: 247569 - DNA, 532 bp, Homo sapiens
cagagtcgtttacacacaagtgagtggcgctgtaatgagcaggaggaacagtcatgtcccatctgcgacctgtcgcatcaggagaatatctgtagtcacccattctgcccggggccccaaatgcgccaccagcagtgtcgccccgttttttcattgtctcaggtgtccagaggatgatgaccaggtctttgaagttgttagtgggattaatgggtacagcaaactgggctagacatctggtttgaattaggaaaaagcattgattaatctttgagaggtgtccccaaagcagaacctttcccctcctcttccagtccccttgcttaagcctcactatcttctttttttttaagtcacactgcagaatagtggcttcgcaataacatccgtgtgaaagatcgaattgttttctattgctcagaggtggggtggagtgggggttgatcaggaattctgagatttgtaagcgctgctttctttaacggaaattgagctctattttgagggaaattagttttgcagacttcgttta

SEQ ID NO: 247570 - DNA, 411 bp, Homo sapiens
tacttattattttactatttgctttttatataaggactttactttaaaatagtgttaatacttctgtgttcttcatggtctcttcttctgtctcttaaggaatggtatttaaatctattagcaggctgggcgcagtcgtcacgcctgtaatcccagcactttgggaggctgaggcgggcagatcactaggtcaggagtttgagaccagcctggccaccaaggtgaaatcctgtctctactaaaaatacaaaaattagccaggcgtggtgcacccgcctgtaagcccaactactcaggaggccgaggcaggagaatcacttgagcccaggaggcggaggttgcagtgagccgagatcatgcccactgcactccagcctgggcgacagagcaagactccgtctcaaaaaaaaa

SEQ ID NO: 247571 - DNA, 485 bp, Homo sapiens
agatgttgcagtgagccaagatcatgccactgcactccagcctgggcaacagagcaagactctgtctcaaaagaaaaaaagaaagaaagaaaaagcacttggatttttttttccccttgctatgagataagtaatattcaccctggggtcttcttgtccatgcatccttggatacacatggaggagagcttcagaatagcaaaattaagggcggagcactggctcttgcctataattcaagcactttgggaggccaaggtaggagcatcacttgaggccaggagttcaagattagcctgagcaacagagcaaaacctcgtcccttcaaaataaaataattagccaggcatggtggcacgtgcctgtacgtgggaggctgaggtggaaggatcacttgaggccaggagctcaaggctgaagtgagccatgattataccactgcactccaggctggacagcagagcaagaccctgtctcaaaaaaaa

SEQ ID NO: 247572 - DNA, 318 bp, Homo sapiens
ctaggtgtgagatgatactaaactaagcagagaccaggaaaccaagctgtgcgtgtttttctcagtgatgaggcagccccactcataatgtgcttgtggcgtaacccctgcgtccttccgcctcctccacaacagtcactctgagtcgtcactgtcatacctctttactccaggagccttgtatgttcatgcataggggccagctctcacgagggtcagcttcccggcctcatgccctggaaatctaggttgcatttgtacaacgggacagtcaagatgctctgaggcatcatgattataaacacaatttttatgaaa

SEQ ID NO: 247573 - DNA, 787 bp, Homo sapiens
tccatgcttattgttacaagtgaaaagatacacagacttagaaacagtccctccaccctgctgcctcctcacagcccatccgcacccctctggaagcggggctggttcagagttgcttcccacgtgctggcggggctgcacccaccgggagagagctcgctgctccggagccattctcaggcttacactgccccctgctttcagaagttgcaaaggagtgtttaaaaaattggagacagaaaatgttgactgctagatttatacattggaaaagtactagtttaaaatatcagtaaacatttgcattctgattattcatgtagaatggaaatgttaggaatcgagtacaggccactgagttgtctgagctaccttttggcgtctggctgttcatttgcttagcaaagcagcccctcctttctgacagtttgacactgatgacccatcctccattgctcgaatctgctctgaaaactcccctctgtgggaggcttcttgttgacactcacttttggggagtaaagaaaggtgggtttgggtgattgcagggagctggggaccctcccctatgggaggctgcggctgtggagccctgaccgccctgtagccagcctctgcacctgggaggatggagctttcaggagccgttcttctgtttgttgttttgatttctgagagatggggatctgggttgcctgttaggattatttactctggtctctatgtgactttttccatggacttctgaggactggggtctctgcagtgcctggctttgtgaacgtcc

SEQ ID NO: 247574 - DNA, 301 bp, Homo sapiens
tccagccatacctgaagccaccactccactgttcaattatatgagcaatggattccctttttttcttaagctactttgtagatgctgtcagaagggcctctgtgtcgtaagggactaggggctatttatgcgggtaaggatggggtggaggctatgatcctatatgccattttattaggaaaacatttggtgtttagctctctgggtagggaagagatgcatctttctgccccctgagaaaagagaagtaggaaggtcatggagggccatggtgacccacatggcaggacgtcttcagagc

SEQ ID NO: 247575 - DNA, 425 bp, Homo sapiens
ttaattcattagaggttgtaaagaagtgatatactccaggttgagcatccctaatccaaaaaaccacaaatctgaaatgccttaaaacccaaaatgtttgagtgctgacgtgacaccacaaatggaaaatttcacacctgacctcatgtaatgggttgctgttaaaatgtactgtgagtcaggaatggtggtgatgctgaacagccacagatagtccacatgggtggccaaggtagtgatacctttgctttatgatggttcaatatatataagctttgtttcatgcagattatttaaaatattatatgaaattactgtcaggctatgagtataagatatatatgaaacataaatttatttcatgtataaacaggttccatccccaagatatgtcattatgtatatgcaaatattccaaaaatctg

SEQ ID NO: 247576 - DNA, 378 bp, Homo sapiens
agtttgtcaataccctaaatgttctgtggttttaagctacagagtttgtaattcatttatttattcaataaatactcagtggcaggcactgttttagaaaccttggttataactttgaatgaaattaaaaaaaatccttgccttgtggaggatgcttatgtgtggggagttgggtggtggggtcaaacaacaattacattaaaatagaaaatagtgacataaataaacctataaatattgcaacccagagttatattataaatgtaagtagtgactaggactctcatgcagatatacctctgtgctgggacaaatgaaagtttaagtgtaatttcccatatgcaagtcaaaataaaaagtgacactagaaaacacaaa

SEQ ID NO: 247577 - DNA, 495 bp, Homo sapiens
tagctgtgttaggttttgaaagcaatggaatataatctccaacatggctcttttttgaggatcttttgcaaaggtaactttggctctgtaaggttttatcttttgcactgactttagaatctaatccttggctctgatgagattctattgcgatcctttaaaaggggtaagaattaggatcatcaggactaatatgacctaagtttgtattgagttagtattgagagcattggctgaagtttagggtttgtgttgccatggggccttttcttatcccattcgtttattgcaaattcccttaaaaaagatagacatgtcttccaacttagggacaaaatgcagtaaaaatccagcctgaggaactaaatattccaggtggactgtctgccgttttttggtcaccaaaaatgtcatgcaatttcaaagtcagtttggcaaatttattccaaaacagggatgaattcgaatactgggaatctgagggagaagttaaaa

SEQ ID NO: 247578 - DNA, 373 bp, Homo sapiens
tttaaaacactttttaaggctaaaaagtattttgagttgtgtatgctctggttaaagtttcagttgttccttttctggatttattgctattgttagcaacagttgcagctatttacagcttataccagggagtgtatatttctgtagctgctctctcattttgagttaaaagataagctacacagcaccaggtctgttcctgagaaggtaagatcatcttagcttacttaactgcccagtaatgtaaatatcatgtttttgttttattgttttgttttttgagacagagtttcgctcttgttgcccaggctggagtgcaatgccacgatctcggcccactgcaacttccaccccccatgttcaaacaattctc

SEQ ID NO: 247579 - DNA, 4603 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (11)..(11): n is a, c, g, or t
  misc_feature (4175)..(4175): n is a, c, g, or t
  misc_feature (4208)..(4208): n is a, c, g, or t
  misc_feature (4220)..(4220): n is a, c, g, or t
  misc_feature (4226)..(4226): n is a, c, g, or t
  misc_feature (4252)..(4252): n is a, c, g, or t
  misc_feature (4258)..(4258): n is a, c, g, or t
  misc_feature (4290)..(4290): n is a, c, g, or t
  misc_feature (4374)..(4374): n is a, c, g, or t
  misc_feature (4377)..(4377): n is a, c, g, or t
  misc_feature (4495)..(4495): n is a, c, g, or t
  misc_feature (4523)..(4523): n is a, c, g, or t
ttngngnaacnggggggacccagcgaaatggaagaagttaggtgtccagagcacgggactttctgctttcttaagaccggcgtccgcgatggcccgaataaaggaaagagcttctacgtgtgccgggcagacacgtgcagcttcgtgcgggccaccgacattcctgtttcccattgcttattgcatgaggactttgtggtagagcttcagggtttgcttctgccacaggacaagaaagaatacagattgttcttccgatgcattagaagtaaggcagaggggaaacgctggtgtggaagtattccatggcaggatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgggagccccctactctttgactcgactctggacttagagacgaaggaaaacctccaattccctgatcgaagtgtgcaaagaaaggtgtctcctgcctcaggtgtttccaagaaggtagaaccctcagacccagtagcccggcgtgtctaccttacaacacaactgaaacaaaagaagagcacactggcatcagtgaacatccaggctcttccagacaagggtcagaagttgatcaaacaaatccaggagctggaggaagtactcagtggtcttaccctttccccagagcaaggaactaatgagaagagtaacagtcaagtaccacagcagagtcacttcaccaaaactaccactggccctccccacctggtgcctccccaaccccttcctcgtcgtggtacccaacctgtgggttctctagaactaaagtctgcctgccaggtgactgctggaggatccagtcagtgctatcgaggccatacaaaccaagatcacgttcatgcagtgtggaaaatcacaagtgaagccatcggtcaactgcatcgctcacttgagtcatgtcctggtgagacggttgtggcagaagatcccgccgggctgaaggtccctttgctactacaccagaagcaggcattggcttggttactatggcgagaaagtcagaagccacaaggaggaattctggcagatgatatgggcttaggaaaaaccctgacaatgattgcgctcatcctgacccagaagaatcaagagaaaaaggaagaaaaggagaaaagcacagctttgacgtggctctccaaagatgactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtcctctctacatatgacatcgtgatcactacctatagcctcgtggccaaggagattcccacaaacaagcaagaggcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctagaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaattctgtgttgcctttntttttttagctgatgatgggagaaccagttaanaccttttttaanacaggntccatcctattttttcattttttctngccagngatgttgcacctgtaaccatttttttatgggnggagcagagagtcaatccctgcagccaccctgcagccagccatttttgcagttttttcagtgcaggcagtttttcctttcaggntgnagatcaaggagatgctttgtagatgaacagatgcagagtatctgttatcattgtattgtttagtgtcagtgtatcatttagtatttgtatcactgtaccatttagtgttgtatatcantcagtcatttaatattggttatcaccanacagtttaatatttgtatcatttggttcattgtatcgtttagtatttgtattataagatttctatttgtagtatttgtat

SEQ ID NO: 247580 - DNA, 1512 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (11)..(11): n is a, c, g, or t
ttngngnaacnggggggacccagcgaaatggaagaagttaggtgtccagagcacgggactttctgctttcttaagaccggcgtccgcgatggcccgaataaaggaaagagcttctacgtgtgccgggcagacacgtgcagcttcgtgcgggccaccgacattcctgtttcccattgcttattgcatgaggactttgtggtagagcttcagggtttgcttctgccacaggacaagaaagaatacagattgttcttccgatgcattagaagtaaggcagaggggaaacgctggtgtggaagtattccatggcaggatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgggagccccctactctttgactcgactctggacttagagacgaaggaaaacctccaattccctgatcgaagtgtgcaaagaaaggtgtctcctgcctcaggtgtttccaagaaggtagaaccctcagacccagtagcccggcgtgtctaccttacaacacaactgaaacaaaagaagagcacactggcatcagtgaacatccaggctcttccagacaagggtcagaagttgatcaaacaaatccaggagctggaggaagtactcagtggtcttaccctttccccagagcaaggtaaagtggcttatgcctcagaactccgggtttgcatcgactttacaagagacattcgggaagcccttttaataaagaatgtgttgattcaaaaa

SEQ ID NO: 247581 - DNA, 4449 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (11)..(11): n is a, c, g, or t
  misc_feature (4021)..(4021): n is a, c, g, or t
  misc_feature (4054)..(4054): n is a, c, g, or t
  misc_feature (4066)..(4066): n is a, c, g, or t
  misc_feature (4072)..(4072): n is a, c, g, or t
  misc_feature (4098)..(4098): n is a, c, g, or t
  misc_feature (4104)..(4104): n is a, c, g, or t
  misc_feature (4136)..(4136): n is a, c, g, or t
  misc_feature (4220)..(4220): n is a, c, g, or t
  misc_feature (4223)..(4223): n is a, c, g, or t
  misc_feature (4341)..(4341): n is a, c, g, or t
  misc_feature (4369)..(4369): n is a, c, g, or t
ttngngnaacnggggggacccagcgaaatggaagaagttaggtgtccagagcacgggactttctgctttcttaagaccggcgtccgcgatggcccgaataaaggaaagagcttctacgtgtgccgggcagacacgtgcagcttcgtgcgggccaccgagatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgggagccccctactctttgactcgactctggacttagagacgaaggaaaacctccaattccctgatcgaagtgtgcaaagaaaggtgtctcctgcctcaggtgtttccaagaaggtagaaccctcagacccagtagcccggcgtgtctaccttacaacacaactgaaacaaaagaagagcacactggcatcagtgaacatccaggctcttccagacaagggtcagaagttgatcaaacaaatccaggagctggaggaagtactcagtggtcttaccctttccccagagcaaggaactaatgagaagagtaacagtcaagtaccacagcagagtcacttcaccaaaactaccactggccctccccacctggtgcctccccaaccccttcctcgtcgtggtacccaacctgtgggttctctagaactaaagtctgcctgccaggtgactgctggaggatccagtcagtgctatcgaggccatacaaaccaagatcacgttcatgcagtgtggaaaatcacaagtgaagccatcggtcaactgcatcgctcacttgagtcatgtcctggtgagacggttgtggcagaagatcccgccgggctgaaggtccctttgctactacaccagaagcaggcattggcttggttactatggcgagaaagtcagaagccacaaggaggaattctggcagatgatatgggcttaggaaaaaccctgacaatgattgcgctcatcctgacccagaagaatcaagagaaaaaggaagaaaaggagaaaagcacagctttgacgtggctctccaaagatgactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtcctctctacatatgacatcgtgatcactacctatagcctcgtggccaaggagattcccacaaacaagcaagaggcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctagaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaattctgtgttgcctttntttttttagctgatgatgggagaaccagttaanaccttttttaanacaggntccatcctattttttcattttttctngccagngatgttgcacctgtaaccatttttttatgggnggagcagagagtcaatccctgcagccaccctgcagccagccatttttgcagttttttcagtgcaggcagtttttcctttcaggntgnagatcaaggagatgctttgtagatgaacagatgcagagtatctgttatcattgtattgtttagtgtcagtgtatcatttagtatttgtatcactgtaccatttagtgttgtatatcantcagtcatttaatattggttatcaccanacagtttaatatttgtatcatttggttcattgtatcgtttagtatttgtattataagatttctatttgtagtatttgtat

SEQ ID NO: 247582 - DNA, 3416 bp, Homo sapiens
  misc_feature (2988)..(2988): n is a, c, g, or t
  misc_feature (3021)..(3021): n is a, c, g, or t
  misc_feature (3033)..(3033): n is a, c, g, or t
  misc_feature (3039)..(3039): n is a, c, g, or t
  misc_feature (3065)..(3065): n is a, c, g, or t
  misc_feature (3071)..(3071): n is a, c, g, or t
  misc_feature (3103)..(3103): n is a, c, g, or t
  misc_feature (3187)..(3187): n is a, c, g, or t
  misc_feature (3190)..(3190): n is a, c, g, or t
  misc_feature (3308)..(3308): n is a, c, g, or t
  misc_feature (3336)..(3336): n is a, c, g, or t
tgctctcagggcctctaatgagcactgttgcagctgggtcctatatccctttgtgtgtactagcagtatgtgtaagtagcacaggcacacacacgcagagatgaggggccatggtataaacaaaccatcactaattggttccaaaccaatgtttgcttattttttaaaaaaggtttctgtacttaattttaaggtagaagtacattaagttatgcttttcagaaagtataacaatactccatacgcctctataatgaatcaactcaagaggagttaggaaatgatccagctttcacttccagccactctgtgaaagcacattgctttttcacactgaggtcatgtgccacccactttcctccccctgtttagcctctctttctgcctgtacttttagtggagaaaataagtaatcaagtgtttcagtttaaaagaccatttcttccatttcctacttcactataggctctgtatagaaataagagcaatggttaaacatattaattgaaggagtaaagtcagtcaagaggaagaggtaatgcctttaagttaaaggccggtcaaacacgatgactcacacctgtaattccactgtgggaggctaaggcgggaggatcacttgagcctaggagtttgagacagcctgggtaacacagcaagaccgtgtctccatatattaaaaaagaaaagttaaaagccatttggtgaatgtaactaggcactgatttttttcccttctcaagactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtcctctctacatatgacatcgtgatcactacctatagcctcgtggccaaggagattcccacaaacaagcaagaggcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctagaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaattctgtgttgcctttntttttttagctgatgatgggagaaccagttaanaccttttttaanacaggntccatcctattttttcattttttctngccagngatgttgcacctgtaaccatttttttatgggnggagcagagagtcaatccctgcagccaccctgcagccagccatttttgcagttttttcagtgcaggcagtttttcctttcaggntgnagatcaaggagatgctttgtagatgaacagatgcagagtatctgttatcattgtattgtttagtgtcagtgtatcatttagtatttgtatcactgtaccatttagtgttgtatatcantcagtcatttaatattggttatcaccanacagtttaatatttgtatcatttggttcattgtatcgtttagtatttgtattataagatttctatttgtagtatttgtat

SEQ ID NO: 247583 - DNA, 409 bp, Homo sapiens
ttttacaagagtcatagtaaatgtcttggacctagatctcaaagtaaagagcaagtgctagggttctgctgaataaggaagataaaggagccattaaggtaggcacagagtagtgacggagtggcactgacagagaacaatggggaaatgtctgccagtggtttctcctcttgaactagggttgattatttgccctaagcaattaactctcttaattttgcttttattttctagcagatgatatgggcttaggaaaaaccctgacaatgattgcgctcatcctgacccagaagaatcaagagaaaaaggaagaaaaggagaaaagcacagctttgacgtggctctccaaagatggtagacagaagtgccttaatagcctgccattccctacgtcatttgagccacccaa

SEQ ID NO: 247584 - DNA, 420 bp, Homo sapiens
taggacttcatgacagggtccagacatgaatgcagctgctcccaaagtaagcaaaatgctgatgtgagccctgaaaatcaagggcattgctctgagtgagctgtgttccccataaaaatcatatgttgatgccctaacacccaacgtgactgtatatggagacaggatctttagaaggtaattaaaattaaatgaggccacaagggtggagccttaatctgataaaattatggcctcataaaaacagagagagatctctcctctgtccctccaccttgtaagaacacagcaagtcagccatctgcaagccaggaagagaggtctcaataggaatcaaatttgccgacaccttgatcttggacttctcagcctccagaagcataagaaaataaactctcgttgtttaaaccacccaatcca

SEQ ID NO: 247585 - DNA, 554 bp, Homo sapiens
caatgtctcaatatacctcctacactaagtataatagtaaatatctgtatttggtggcataatatgttcttagtataaaccaaaaacacatgctgagcattggacattgtccaatgtttaattcatatgattcattctgagtttctgactgagatcattctttcagactatgtctatttgtcctgggacccataaaatatgcagccctaacatgatttcatttttgtttcctttcctggaaaaggagaaatcattcagatcagctttcatattgccttatagacgatgacttcaaaatagtttgaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaaaa

SEQ ID NO: 247586 - DNA, 347 bp, Homo sapiens
tattttttagtagagacggggtttcaccgtgttacccacgatggtctcgatcacctgacctcgtgatctgcccaccttggcctcccaaagtgctgggattacaggcgtgacgacctcgcccggccttgagaaagtgcatttaagctccttcctaaatgaatgattatttagtcttgcagtgtccataatttctttaggtcacttacggaagtctcaaacttgtctgtaacacctgataataacttccagtactattctaaaatgtagatttactttatcacattttcttctaacttctacttgcccctgttgtaacaatcttcattcttcttttgtacttatatttt

SEQ ID NO: 247587 - DNA, 138 bp, Homo sapiens
agacagatggcaaattatgtctatattatatataaatcatcatttcccattacattcagattatatatttgtcatttactataatatatataaattgatgtttctacactatcctatatataaatactgatacaatga

SEQ ID NO: 247588 - DNA, 6513 bp, Homo sapiens
atgtaggagacagatttcaatgtctgttgaaggcccccccacaccctccttcagtgccgggggcatggagggatatcttgggctcctgctgttttttaaaatgatgcgagctcatctcctgtcctgggtgtgaacgagtatatcttaccagggatgtaactgaacatttttttctgcattgtgttcctactgagcaacccaagatggccaggaactgctctgagtgcaaggagaagagggcagcacatatcctctgcacctactgcaatcgctggctgtgcagctcttgcacagaggaacaccgacacagccctgtccccgggggcccattctttcctcgggcccagaagggatctccaggagtgaatggtggtcccggagacttcaccttgtattgtcctctacacacacaggaagtactcaagctattctgtgagacatgtgatatgctcacttgccatagctgcctagtggtggaacacaaagaacacaggtgcagacatgttgaagaagttttgcaaaaccagaggatgcttctggaaggtgtgactacacaggtggcacataagaaatccagtctacagacatctgcaaagcaaattgaggacaggatttttgaagtgaagcatcagcataggaaggtggaaaaccagatcaaaatggccaagatggttctgatgaatgagctgaacaaacaggccaatgggctaatagaggaattagaggggattactaatgagagaaagcggaagctggaacagcagttacagagcatcatggttctcaaccgtcagtttgagcatgtgcagaatttcatcaactgggctgtctgcagcaaaaccagtgtcccttttcttttcagcaaagagctgattgtgtttcagatgcagcgattgctggagacaagttgtaacacagatcctggctccccttggagtatcagattcacctgggagcctaacttctggaccaagcagctagcttctcttggctgcataactactgaaggtggacaaatgtccagggcagatgctcctgcttatggaggcttacaggggtcatcacccttttatcaaagccaccagtctccagtggctcagcaagaggctcttagccacccctcacacaagttccagtctccagcagtgtgctcctcatctgtgtgctgctcccactgctccccagtctcgccttccctcaaaggccaggtccccccacccagcatacacccagcccacagcttcaggcagccccctgagatggtgccccagcagctggggtctctgcagtgctctgccctgctgcccagggagaaagagctggcctgcagccctcatccaccaaagctgctgcagccctggctggaaacccagccccccgtggagcaggagagcacatcccagcggctggggcagcagctgacttcccagcccgtgtgcattgtccccccacaggatgttcagcaaggagcccatgcccagcccaccttacagacaccctctatccaagtccagtttggccaccaccagaagctgaagctcagtcactttcagcagcagccacagcagcagctaccacctccaccaccacccctcccccatcccccacctccccttccccctcccccacagcagccacacccacctcttcctccatcccagcatctggcttctagtcagcacgagagccctcctggccctgcctgttctcagaacatggacataatgcatcacaagtttgagctggaggaaatgcagaaggacttggagcttcttctccaggctcaacagcccagcctgcaactgagtcagaccaaatctcctcagcatcttcagcaaaccattgtggggcagatcaactacatcgtgaggcagccagcacctgtccagtcccagagccaggaggagaccctgcaggctacagatgagcccccagcatctcagggctcaaagccggctctccctcttgacaagaatactgctgctgccttgccccaggcgtctggggaagaaacccctctcagtgtccccccagtggacagcaccatccagcactcctctccaaatgtggtgagaaagcactccacctcgctgagcatcatgggcttttccaacactctggagatggagttgtcatctaccaggttggagaggcccctagagccacagatccagagtgtgagcaacctgacagctggtgccccccaggcagtaccaagcctgctgagtgctccccccaaaatggtgtccagcctgacaagtgttcaaaaccaggccatgcccagcctgacaaccagtcacctacagactgtgcccagccttgtgcatagcacattccagtccatgcccaacctgataagtgactcccctcaggctatggcaagcctggcaagtgatcaccctcaggctgggcccagcctaatgtctggtcacacccaggctgtgccgagtctggcaacttgtcctctgcagagcatccctccagtttctgacatgcagccagaaactgggtccagctccagttctggccgaacttcagggagcctgtgtcccagagatggggctgatccctccctggagaatgctctgtgtaaggtaagtcctggggaaatgctatccaaacttcctttgttcatcattgggcaaaagattggccactgggacccttattctgaccttagcttaacagttctgagaccactaatgacaaccatgtctgagttctttgattcttgtcgacatttcacttttgaaagatggaaagtgaggattccactcgcttcactgacttactgggacaaggtcccatagtccccggtctggatgctcccaaggacttggccatcccctcagaactggaggagccaattaacctctctgtgaagaaacctccactggcgccagtggtcagcacgtctacagctctgcagcagtaccagaacccaaaagagtgtgagaattttgaacaaggagccctagagctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaaggtcagccaggacagactgtctgaggccacccaggccccaggtctggagggaagaaaggtcactgtcacttctttggctgggcagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccaccccagaggaggtggtatcagatgtgcgcctcatgttctggaactgtgctaagttcaattatcctgactccgaggttgcagaggctggccgctgcctggaagtgttctttgagggctggttgaaggagatctacccggagaaacggtttgcccagccaaggcaggaggactcagactccgaggaggtgtctagtgagagtggatgttccactccccagggcttcccgtggcctccctacatgcaggagggcatccaacccaagaggcggcgacgacatatggagaatgaaagagcaaaaagaatgtcatttcgcctggccaacagcatctctcaggtgtgagagccaaaaggagactgggcactctggcagctgttgtcccatactgtcgaccattcctccccatcttgcagcttatcctcttcagagtgtggatggtagatgagtcttgttgaactgtgtagtgctcttctttgccatttgcatctacagcatttatttgggagctgtagtacatccactacagagaagatttcagtaataaacaggaaagaggaaggtaaatattattaccagagtaatcagatgtataggctccacttgacaagaccacacctggttaggctcgggaaaacctactttccttggtgaatttttttctgcctgggaaagcagacccgtctaaccttttagtgtccagggctcaggagccatgtatacatctgaactcctcctgggctcagaagtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgttgggggagctatgaacctgacatgtcagtggccaggactgagacagctctccctggtcctgtcattgcatggctaatttcaggggagtctgaggtcatggctttatttttgctaacagatgaagttcaaggatgttcttgtttgtagggcctttgctaatgagcagttttttaattagaaaacatttcttctctctttgtgagttgatggtattgctcatttccttctctacccaacctgagagatcatcttcactttaaagcaaaccatgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttacacacctgcctctcgctggcttttcctttagacctagccaccagtgttttgaatcatggttttgttttgtttttgcatgcaaaaaccagaacatgacttagaaatt

SEQ ID NO: 247589 - DNA, 2662 bp, Homo sapiens
atgtaggagacagatttcaatgtctgttgaaggcccccccacaccctccttcagtgccgggggcatggagggatatcttgggctcctgctgttttttaaaatgatgcggtgagagtgtgtgcctggcatctgcgtgctgcagcagtgtggggctgacagagtgtgtcaacttgagctctggctgtgcaggcaccgctgctgcgtgagcctgttattccattctggattgctattttgatacccagattgcatcattcttcctacgtataaacagggggtccccagggtcctgcagctactcacttcaccaccaacactgttgttgtgatgagctctatttaaatgagctgccggatcggggcaggttccagccacacagtgctcttctttgccatttgcatctacagcatttatttgggagctgtagtacatccactacagagaagatttcagtaataaacaggaaagaggaaggtaaatattattaccagagtaatcagatgtataggctccacttgacaagaccacacctggttaggctcgggaaaacctactttccttggtgaatttttttctgcctgggaaagcagacccgtctaaccttttagtgtccagggctcaggagccatgtatacatctgaactcctcctgggctcagaagtgggtaaaagaagggagagaggtttagacatatggcaggactgtgatccctggcccagcacagccaaagactgtcactgtttgcctttgcttgtcctgtctggatagaggcacctgccatgtgcagactagtggaggcttctagaggccataggtctcaatttgtgcctatttgggttctaacggttttcagggtatttgttttgcatagtcactttcctgatgttgacataggtggctgctgtgaaaatgctgtggatggtgtgacattcttgactgagctgggtggctgtggagagaccacttaaatcttctggttcagatttcacttacagacttagtaagatgtccacttcagagcccgccctctgtgctacttactctgggctaatcacacttctttagggtgagaacctgccttcctagaagtgactgttggtgcttgtcagtggccatacccttcatcatcctcattcagaggtatggatcgtgagttctgcttgtgaatactgtgagacagctgctgtctgcttcaggtccagagttccatgggtggagagagtaacccacaaccagctcactcctctgggcctctcctcctgcttaaagattctagttctcaacctctccaagttcatgagccaaagatcagaagtgagtcttctgaccagcccgcctccaggctgtctacagccccaaaaaagccaacacttttctggcagccctttttgttggaggttagagaaggcctcagggaccaacaggggccagatctagacattcctgggggaagtttgtctaaggtggacagggggaaaaatcaagaggcaaaaagccagtgtcctttggtgaccatgaagcaacctcagagccttagttctcctagaatgcagagagaagcattctggaagccatgggaacaggagctcgaggctgcatcctgaatgcatctgcatggccctcgcagggtgtttgtgaggatactggaggtcaggctacctcccaagcaagggcttggttgagaaggaacccattgctcatattgttgggggagctatgaacctgacatgtcagtggccaggactgagacagctctccctggtcctgtcattgcatggctaatttcaggggagtctgaggtcatggctttatttttgctaacagatgaagttcaaggatgttcttgtttgtagggcctttgctaatgagcagttttttaattagaaaacatttcttctctctttgtgagttgatggtattgctcatttccttctctacccaacctgagagatcatcttcactttaaagcaaaccatgccccttggcttgccattctttcagcagcacatgccacgttctaagcagatgggcttccgtgatcccgttttctagtttggggtaactgagtcttgaatgctttactagtccggcaatctttggacttaggcttctgccctttgagactcacatgactttctggtttggggtctggtcatttccctttcaatttttgaatctccttctctgttcagttggcttggcaaagtaccctctgttctcatgtcactaattcctgctctaggtcatctttcctttgtgcagcccacattcccaccatcctgtgaactttgttgtacttggtgttgggcaactggtgagtgttgtgacaggctcagacctgatccttcctcaggagcaattggagaccacaaatttaaagcagaaatacctgttaaaagcttggctttccttatatgagtgaggctcccagcttgggtgtggcctcctgggctcacggatcagcttgctgggccagagggggtcttagtaatgtgctagagagacacatgctcccttctcatcgtagagagcctgcatgctgagaggctccctttacacacctgcctctcgctggcttttcctttagacctagccaccagtgttttgaatcatggttttgttttgtttttgcatgcaaaaaccagaacatgacttagaaatt

SEQ ID NO: 247590 - DNA, 450 bp, Homo sapiens
atttaaatatgatttttaactcttaaaaatgtttatgttaatgtcagagcgcctacaaaactcttaaaataaggatgagagcttgaatcatgcatgaggcagattttaactgaggtgtaagtagacagtggaatgcatgtgtttaattcaaaaaaggtttgctggccgggtgtggtggcttgtgcttgtaatcccagcactttgagaagccaagggaggaggattgcttgagcccaggagtttgagaccagcttgagcaacataaggagaccttgtctctacaaaaaataaaacattagctgggtgtggtggtagtagtcctgtagtcctagctatctgggaggctgaggcaggaggattgcttgagcttgggaggttgaggctgcagtgagccatgactgtgcatggcattccagcctgggccacagagcaagaccctgtctcaaaaaa

SEQ ID NO: 247591 - DNA, 454 bp, Homo sapiens
gagcccaggaggtcaaggttgcagtgagccatgattgcagctctgcactccaacctgggtgacagagtgagaccctgtctcaagacaaaaaaaaaaaaaaatcaaagcacacagaattatacatttttagaattagaaatgacctcaaaagctaactggtctagccttctgccattaaaacaggtaaaatagtatgatcctactttatatgcctagtattgaaaagtgtgacattggcatttacagggacatgtctactgaggaaattttgctctaagtacaggaccgaagcagttcctagtgtatatgacaagaattctatatatcctgccatttctgatatgtattctgaccactagaacacaaatacttacagatctttttactttcatttcctttgtttccttttctactcctttctcttgccctacaaagatacttaggtttctctgtt

SEQ ID NO: 247592 - DNA, 671 bp, Homo sapiens
ctcaaaactttcctgtacccttctggcttgttctgggaaaacaatgcttgcacagctttatttcttccagctttaaacctctaagacttcccttagcaatttttgtctcatcagaagtcttcacatatgctggctaggaaggaaaacattggcattttttttcaggaagaagaccgtgttaatgagctacactaaactcacgtctccattccatcttgcatgtactccttaccccatatttgagaaatatcactcaaattatgagtcagaacatgattttgatacaaaagattggtttgttcatatgatgttgttatataaagctccatgtacaattctttcataggttaaacaattttataaagcttttatactttattattttcagttcaagtgtgaattcagataatgatattgggaggccaaggcgtgaggatcacttgaggccaagagttcaagacaagcctgggcaacatagcaagacccctatttctgcaaaaaataaaaatattagctggccatggtggcatatggctgtagtcctagctacttgggaggctgaggtgggagaatcacttgaacccaagagtgtgaggctaaagtgagctacgattgcatcattgtactccagactgggcaacataatgagactctgctcttagaaaaaaaaa

SEQ ID NO: 247593 - DNA, 220 bp, Homo sapiens
ggcgaggtcctggctcctccctggcgtttgggccgtcactttcccaggtccgagagtgtcgacgctccttttgtcgaccgaggatgtggacgctcccccaggatgcggccaggcagcgccacctcacgccggcagagggtgccggcgagacgctgagggacactggagtttctgagccgaacctgcgactttaagatagggaaactggtaggacatccaa

SEQ ID NO: 247594 - DNA, 349 bp, Homo sapiens
aattcagttgcttgtggatgtgggactaaggtccctgctttctgaaagctgtcagcaaggggccccactcagctcccagaggcccctgcagttccttaccatgtggctgtcacaggccctttcacaatatggcagctgacttcttcaaagcctgaagaagaatctctctgacttctaattccttttatacaaggctcccctgattaggtcaggccctccagggataatatatttttccttaactcaaactcacctgattggggaccttaattatatctgtagaagtcttttgcaatataacataacctaatcaatataatcacctttgcggtataatataacctattca

SEQ ID NO: 247595 - DNA, 452 bp, Homo sapiens
atgggtaacctttctttttttttttcgtttgagatggggtcttattctgtcatctcagctagagtgcagtgactcactatagcctggacctccagggctcaagggatcctcccacctcaacttcctgaatagctgggaccactatgggttcataccaccacacctggctaatttttgtattttttggtagagacagggtttggtagagcccaggctgggtaaccttttgatttaaaatttattttgaattttttttggaaaaaagcatatttttacatttagatataatattgtaattgactattcataaatacagaacttctaagtataagaccaaaaggtccgttttaaaaagaaataagacaattggccgggcgtggtggttcccgcctgtaatcccagcactttgcgaggccgaggcaggcggatcacgaggtcaggagatcaagacc

SEQ ID NO: 247596 - DNA, 516 bp, Homo sapiens
ccatgcccagccaattttcagcctttagagcaagaaatcctaacaagcctatgcccattaatcataaatctgccccacttagggcactggatgtgtggctgtacagactgagttttacccatctttataaatgatgctacactactaaactgtgatgcattggacatctctcatttttctgtggctgaccagcatgcaaacattctttatatttggggcactccatcactgtgagagtcttaggaccttctttcccaccgtggagcataagggggccacatacttggtctcccaacccctcacagctagggtggcgtgtgatctggccaatgagattctccttttgggaactgtgaatcttgatcaagtggtgcaaagacagagacacgttaaaattcatcttggtggtcgagtttctagagactggtagtacctagcaatcatggtggaaccagtgacagtatcctttttattccgtggtacctgaaatccttacaataaattcttccgcttcaa

SEQ ID NO: 247597 - DNA, 312 bp, Homo sapiens
tctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaa

SEQ ID NO: 247598 - DNA, 255 bp, Homo sapiens
tatgtctttttctgtctttgacaagttcctgtctgtcacccaatgccaggcattattttctggtaaaaatcaggaaggattctttctagcattctgtgactgtttctggttttatcaagagcagattgtgtctcattctgggatgtggagtatcacactgtctgacttggggaatttgttgggatataatgaagcactagaacttacattgggaaaatgtcagctttcctttgtggcaacagcttatcacagttc

SEQ ID NO: 247599 - DNA, 823 bp, Homo sapiens
ctgttggtgcttgttgctacatgtcttcagcagatcccaccaggcccctgggtgagcacttgaccctgacgggacgcaaaacatggccacattctgcccccatctccaggtccttgtgggggaagtgctccagatagtggtatttgggtgctgggcttgtctgacctgaggaggtggctgcagaagccagggccagccctgagcccgtgaagtctctgctcctccccagcacactgtcctgcctccctgcccttcccagccacagctgcgcagcatgtgccactccaagctctgctgctccctcccccaacttcctgttgctggggacagcaaggggtgggggctaagggtctgccgttgctcaggcgatctgtggctaatctgggaataatttgaaactaaatcttaagctctttggaagcctctcatgaaatcattgcaagtttattaacaacagctgtggccacacatgacctggatcccagccccaacccacccccagaatctcagaggggaagcaccagtcgacttgcaattcccagtcagctttctaaggggaggaaaagtgcaatgaagaagaaaagccacccgttcttcccccatggtcacaggaggctggccagcaggcacgtggacagccagccctggggaccagaagtgttggaaaaaaagtctcaaaaggaccgtaaaggctttggcaaaaatagttttgtgccaagcgctcaaatggttattttgggaacagtcagcctgtggctgctgattactgttcatatctgatttgtgaaaataaattgaatcttttccccttaaaaaaaaaaaa

SEQ ID NO: 247600 - DNA, 433 bp, Homo sapiens
gatactatagtttcctgaattgaagagtctataataggtgacatgtcgtgaatgaaagatagatggtgtaggcagaatatgtataatgtttatagtcacaaccccgccccagaatctcagaggggaagcaccagtcgacttgcaattcccagtcagctttctaaggggaggaaaagtgcaatgaagaagaaaagccacccgttcttcccccatggtcacaggaggctggccagcaggcacgtggacagccagccctggggaccagaagtgttggaaaaaaagtctcaaaaggaccgtaaaggctttggcaaaaatagttttgtgccaagcgctcaaatggttattttgggaacagtcagcctgtggctgctgattactgttcatatctgatttgtgaaaataaattgaatcttttccccttaaaaaaaaaaaa

SEQ ID NO: 247601 - DNA, 217 bp, Homo sapiens
tttttcttttttctaccctcaattggcattgttaccgatcatgggttcttggactctcaatgcaatagaaattgatatgaggccaaaagcgctttcatagacaaagcttcactggagcttatgcccaaacaaaagggaggcagcacaagagagagagaattcccgggcttccttctgaaaagagtcatagggctttcttattaggcaaagtgcagga

SEQ ID NO: 247602 - DNA, 408 bp, Homo sapiens
actttagtcaatcgatattttttcagttaattaatttaaaaaattaatatgtattattatcctagcacagtacctgacacacaataggtacttaaagatgaactgaatagatgctttaataggttaaaaccttattacatcaaccctagatgaccaattaaatattcttttgtgctatcattttgacatgacatatatttcccgaggcttaccatgatatgtatttgttctaacaagaataaacttacattaagtttctatttaacgcattgatgcataaatagatgaagctggccaactaggatgagagtaggggaaggaaggaacatactgatttaactctcaaaggctttctggataacccaagctaactcattaaatggaagctgaaaaactacataagccact

SEQ ID NO: 247603 - DNA, 432 bp, Homo sapiens
agaccactaaatacagagtctcctagttccatctattattctaaatggctgaaagacacacttggacaatcttgtgtgagcctgtcctgaagtttctggaacccaaagtgactggggtgggggacactcaacccagtagtgataaaactttgtttccagtttaatgtccttctttaactaggtgtaggatctcaggtccaccatgaaaccctaggatgcctcattgctaaggaaggggatggatcataatcccagctctacccacgccagaaggcaaaatgaggatctacaatagcgtaaacactctttgacatttcacaggttgatgcaggagtcaaaaggccagcaaagctggcgaaagcccagctgcaggaggctgaccattggccctggttcgtaggcagaggggataactgtgttttgcaacctcac

SEQ ID NO: 247604 - DNA, 171 bp, Homo sapiens
caagaattctcaaagtgtattcaaagaattaatttcattagaaattaataggctaggcaccatggctcacgcctataatcccagcactttgggaggccgaggaaggtggatctcttgagcctaggagtttgagaccagcctaggcaacatagtgagacctcgtctctataa

SEQ ID NO: 247605 - DNA, 504 bp, Homo sapiens
aaatatagataaaattgtcagctttcagtcctcctattccaacaattatttttattttttccatgcttgccaactgcagtagaatttttctaaatttttcttaaaaggtgcacggtttgatggacccttggcttgatacagttttgatttctaaaaatgatgattgtgctgggtttgaatttcacaagaaactgtttggctgtagtggagtgactatagaatgagagaactcctagagttacatagtagaattctagatcgtcaagactatagcattcccctgcccccaccaaatacggaataagttatttcttgcttgtgtgcatactgtccccatattctttaggaagcaatactgcaacaaggatatttgtgtccttttgtgacatttgaggatgtgtcatgctcactaggtgccctctactgtcatgttcaccatggttgagggcatttttaacctctgcctaaggcagtaacaaatgggttgttggcttctgaaacagg

SEQ ID NO: 247606 - DNA, 516 bp, Homo sapiens
agaacattcatgagttggatgactttgtatatgatctgtcctgctctccatttcaaaggcaagaccaccaaaattcacaagcttattatgttgtcactaatgtgtaagccaccagtttttctgcaagttggaagttttctcaacagtcaaatattcccccttctcactaatcttaaggttttaaagttatagctgcaaatctaaaaaaaaaagaaaaagtaaataaaacttattgacagaatgcctgatagtttatttacaggtttttgtttgtttgttttttgtttttctttgttttttattttgacacaaggtcttgctctgccgcccaagccagagtacagtggtacatcaaagctcactgcaatctcaaacacctaggcacaagcagtcctccctcctcagctacttgggaggctgagtcaggagaattgcttgaaccccagaggtagaggttgcagtgagccaagattgagccactggactccagcctggacaacagagaaagactccctc

SEQ ID NO: 247607 - DNA, 436 bp, Homo sapiens
gatgcatgctaccatgcccagctagtatttttatttcttgcagagacagggtctcactttgttgcccaggctaatctcaaactcccagcctcaagtgatgctcctgcctcagcctcccaaagtggtaggattatacacatgagccaccaccctcggcctactttacaatttgatgcaccttttctttacgtgactgtgatgcactttaatgggcaatcactagaggtcaggggttcaagaccagcctggccaacatggtgaaaccccgtctctaataaaaatacaaaaattagccaggtgtggtggtgcatccctgtaatcccagctacttgggaggctgagtcaggagaattgcttgaaccccagaggtagaggttgcagtgagccaagattgagccactggactccagcctggacaacagagaaagactccctc

SEQ ID NO: 247608 - DNA, 391 bp, Homo sapiens
gtttatctcaaattaaaatatcactgggtaccctgtattttatcatatgttcgagtgccttctgtcagaatttggtgaccctttgagtctgttttaaaaaggagcatgtttggccggacacagtggctcacgtctgtaatcccagcactttgggaggctgaggcgggcagatcactagaggtcaggggttcaagaccagcctggccaacatggtgaaaccccgtctctaataaaaatacaaaaattagccaggtgtggtggtgcatccctgtaatcccagctacttgggaggctgagtcaggagaattgcttgaaccccagaggtagaggttgcagtgagccaagattgagccactggactccagcctggacaacagagaaagactccctc

SEQ ID NO: 247609 - DNA, 667 bp, Homo sapiens
actgaatggcaggactgaaagagctgtgacataaacagggctgaaacatgccttccagctcaccaggttgcaggcaacaggagagaagagcagtggcccttaagggagctcagacctaggggctcccagagccagggctgtaacaccctttttggggctctgtggcttatggcatctccaagcttttgggtgccatggcgtctcccctgtccagacctcagtgcccacagtggaagctgcttgccttatgtctggtccagccatagccttgcatggaaccagagctggtgccagtgctggtgcctggagctgcccactaccacagcagctggcatgcctggctgtgcacagtggccagaccccacactcacttgctcacctacccctggccactctgcacctggatcgcccttggaggcatgggatctaggacagtagtatggactgagtgcagcctgctgggccgagtggcccgagccacgggccacagaggtttctggttagggaactggcaccaaaaaaataaatcctgtgtcactaagagtgctttcacgagtgttagaaatgagagaggagatgaaaacatttcttcaaaatgctgataaggaccatttctgtgacatggagaggcatggtcaagaggaatatctcaggcatacatgtattt

SEQ ID NO: 247610 - DNA, 373 bp, Homo sapiens
ctggaacacaactgtaatgctcaagggtgaccagcaaataggtgtaaaaaatagttctatattatcagagacaggccatcagggctacaaattctagtttctgttgtactaccatgccagctatttgaagagaaacatcgtttccatacatccatctacacagttgttcttcaagacatttggaatcacacttttccattccttgttacttagacttcttacgtgtgttcaatctgttaccatatcctgttggatttgacagtaaaatcaattgtgagttagtgccacttcactttatttttatggccactgctccaatcaaaaagtctccatggtatctccccaggataactttagcctcttcccaaacctc

SEQ ID NO: 247611 - DNA, 872 bp, Homo sapiens
tttcagcttgaggtggtcacctagtagttcactccaggcaggctgtaacctgaccatccgtctaatctcctatcaaagatgtctgtcttccagaacacttagcaattatacagctcacatggctttaggcaccttgattatgtatttccaggtgtgtgtttgtttgtcttggaactcctggagagatggggttctgactcatttgtttccaaatagtactagtcatgtctgctttgggcctttttccaatcccacaactgacaaatcatacagctttcaaagctttcaattaactgggaccatttttcttgtcctactgtagtgacaggtgctcttcaaatggtaatcttgattatcagtaagaaaaggatcttaggacttggaaatgtttggttaaaataaacataaaacaggttttctttagaacgtttctaaggctttcatatgctttttccaaatttatttgaccaatacagttttcttttgaggcatcagaattaacatcccccagccactgaaccatctcagaaatgcagatctaagccatagtggggaaataccttgttttagggtaaggaagttctttcctgtacgtaattatagtttcaaaaatagatttatagaatatcagcaagatgttggagtagacaggttcaaacacccatccttccagagaggggaacacccctgaacccactttgtcagagctctggaaaacaaaggttactgtaaagcaaccaagtaaatctggattaagaaaaaggaaacttaatactggtaagaaagctttgtgtcatttttacttgcccctcccagcatggcagtggtcttgaatacagcagcccacagaccctggtccttggttccagagg

SEQ ID NO: 247612 - DNA, 821 bp, Homo sapiens
agaatgagaagcatattaaatttttacattaatcatattgccagagacacaccaaacttctgctattgctgttgacaagcacagttgtggaggtgtttgatttttctgaagcagcattagcagaaacctcagtgtctagccacttgtcctgtgggccttgacagacgggacgtaggatatgcatggcactggtgcagatcatagtgggtatagtgtggttctagggtcagcggtgcacgcagctttctgatggtggtttcctaggcatggcagcagcagtgtgattcagagacgtcatttcctgatcatagaagagtcattgcttccttggtggcctggttctgggaagactttgggactcattcctgaaaaactaatctagagcctatttaatcaaccctcccaagtattcaatatctttgtgtttatactagctaaaatggattctattttccgcaaatgaatcttaactgataccacacattgtgtacaggaagaatagtggctgcagacaataggatctcaggaatatgggaaagtagaattgcttatctgttctcgtagagtttgaaagtagcaataattatgctagtactagaaaatgagacactgccactctgtggtgcacaatggctaagactgacctatatacattttctaatcttgtccttgtgtatttcgtgatctgctggttcaacatctgtttgtacgttaaacacctcaatcttaatattctaagaacgatgatccttcccattgagcctactaagacccccattttagcaaggaccaacactgagttgctcaggttaaaaaaaaaa

SEQ ID NO: 247613 - DNA, 511 bp, Homo sapiens
ttctatggacaacgaatgctttctttattaaaggatcccagtataactggctacccattcacaagaagataaaagtagattttcttcatgacatattaaaataaattctaggttaaatatatacatgcaaaagaaaaaacaggaaaaataaaaaacatttaaaaatttaaggaagtatttgaaatactgtataatcttagaatggggaaacattttgtgtaggacaggatgcaccatataaatgagctctgtcccaaaggagttcataacctagtgccacaaataatataaatatgttagaggtagggatagaatatgctatttttgagataagaacaaaaacagtgaggacctagaggacaattcaattcattctatgatgggcactggggaagggttcacagaagcagcattgagctgtttttaaaggagtgaatgggtgtcttctaggtagtttgtgaaaaggccccaaatcattaaaggacctggtatttcagtgccagtgagaaat

SEQ ID NO: 247614 - DNA, 665 bp, Homo sapiens
ggtgccccagggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgccgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaagggcgttctattaaacatgaatctgc

SEQ ID NO: 247615 - DNA, 375 bp, Homo sapiens
gttaatcaaaaagtggctacttttgaagaggtaatgaccagagtagattaataaaggagatttctagagagttggtcatgttctatatctgtacttctcaaaattcagtctacatatagatctccttcgagatctttttgaaatgcagattctgattcaataggtctgggtgggagctaagattctgcatttttaacaagctcctaggcaatgccaaggctactggtaaatgaatcacactctgagaaacgaagtttgataccttctgaatggtgtatatgcaagtttatttgtaaaatatcatcaaactatatgtttatatttatgcactttctttgtatatgttttacttcaataaaagatctatttaaaacc

SEQ ID NO: 247616 - DNA, 686 bp, Homo sapiens
gttcttccaacctccaagtctcctcagtccatcctcacttcccaattccccatcccttccctgttcgccaccatttcccaacccctgatccaaccccaatgccctgaatgtcatgagagtctaggccttacccaagattctggccttcaaaggaccccaggcccttcaaaagactccagagttcccaggaatctggaccttgcccaaaacccagacctctacaagaacccaggccttacccaagatccaggcctccacgagaacccaggtcttgctccaaatcaaggcctacatgagttcccaggccttccccaagattcttatctctgccagaatccaagcccttctcaagactttggtcttcacaagaattcaggcattactcaagattcccacccccaaaagaacacaggtctgactcaagaagctggtatccttaggagcccatgtctcacccaatcccctggcctccacaagaaaacaccatttacccaaacttctgatcttcagaggagctcaggctttacacaagactctggaatctataggaatcttgaaccaaaccaagagactgtgatctacaaaaatcaagatctctcccaagcaactgaccaccaaaagaacctaggctcttctaaagattctggaggtcacaagaatacaggcaatgtccaagatccaggagt

SEQ ID NO: 247617 - DNA, 674 bp, Homo sapiens
tcactagtaagtccccagatttctgggataatttggattaaagtctgttctaatatgaaactagattggtcttctcatgagattgacatcctagcaggcagtgtaatgttgaaggtttggaatctgacatcccttggtttgaattttcactctaatacttaatagctgtgtgtctttgggcaaatgacttaacatctctcggcctctgtgttttcacttatgaatgtagatgataactccacacagagtagtttgtgaggattaagtgatatagttcatttcagtgctcagtgcaaggcctggtattagtaagtgctaaatatcagttatctgttactattttcattactgcaactaacttcacctaggccacagcttgggctcatccatttatagaacatttatgaacaggctttttactaggtgctggtgatacagaggagaataagacatgaccctgtccttagctgacagtctgatgaaggaaacagtcatataaatagctaactatatttactagttgcataaaaaattattttaccaagtaaaatggaacacattctgtgatagtggaaacacacaaagagctgtgagcacaggaccaagcataaggttgtactggtcataaaggagacctagtgagaaagagctcgtgcagatcaagaatgcccagt

SEQ ID NO: 247618 - DNA, 621 bp, Homo sapiens
tcactagtaagtccccagatttctgggataatttggattaaagtctgttctaatatgaaactagattggtcttctcatgagattgacatcctagcaggcagtgtaatgttgaaggtttggaatctgacatcccttggtttgaattttcactctaatacttaatagctgtgtgtctttgggcaaatgacttaacatctctcggcctctgtgttttcacttatgaatgtagatgataactccacacagagtagtttgtgaggattaagtgatatagttcatttcagtgctcacattactgcaactaacttcacctaggccacagcttgggctcatccatttatagaacatttatgaacaggctttttactaggtgctggtgatacagaggagaataagacatgaccctgtccttagctgacagtctgatgaaggaaacagtcatataaatagctaactatatttactagttgcataaaaaattattttaccaagtaaaatggaacacattctgtgatagtggaaacacacaaagagctgtgagcacaggaccaagcataaggttgtactggtcataaaggagacctagtgagaaagagctcgtgcagatcaagaatgcccagt

SEQ ID NO: 247619 - DNA, 279 bp, Homo sapiens
gtatttttttatagcagcaggaacagactaagacatcctacttctcagcttaaacgtcacctctgcacagagcccttcgtgatacatctgaacagattcttttctgtgactctccatccctgcactgtatttgctctttcagggtgctttttcacatttgtgagggtgtatgcatctcctcttccaggctgtaagcttcataaagtctctgttttgttcataactagaacaagccctagcacctagcagtgagtgttcattaaacatatgaagaatgaa

SEQ ID NO: 247620 - DNA, 599 bp, Homo sapiens
cactttaaaaatatgctttattttttaaactgaaatcccaattgtccataagcatacaaatggagggtttcaaattgtttactggccagagtatcaagccatttagcaggcccttgagagaagaggtatgttctggcagagaatcagagaatcatgagcctgaatgtacacaaaggaggcatgaccagcaatgaaaagacaggaagggacggagattggagagaatggtttggtccagggaaggttgttagaaatttctttcacttcacaagcttgcaaaagacctgggtctcaacttccagcaaatcgagatggagaattttttaaaaccataattaggtactttaaagaaatcttcaagttttgctttagctattggcataatttcctctattctctgggttgctgcagtagtgaggatctgcaaacaaaaaggcactcttcatggaaacaaggagaaaataaacggttctttatatcggcactattttttttcctctctgacttattcattcatgggtttctccaactgtctgagtctctgggaaatggtgtgtttgcccattaatcaaggaatacctatttctccccttcctgcg

SEQ ID NO: 247621 - DNA, 417 bp, Homo sapiens
gcatatagtagacattgaatagtgaatagcagctgctactgctgtcagtgtaaactaagaaacagacctacagaggtcatctgtcctgctggaggtcacaagggaaacagccaggactggaaccacggtcccagaccttgtaggccgtgttcttccattcccgggacacttctttccccttccctgatcaggtgggcgctgggcagacgctggcaggcaggcaccaccgctgtccaggacgcatttatgcctgaattgtaagttgtgggctgtgcctggcctcagacatgattatagggtgctgacaaaaacagcaccccctgattaagacgatgagcgaaaacgcacccgggcttttgttcactgagcaactccattgtgtctttctccccttttccacccctccctttatctact

SEQ ID NO: 247622 - DNA, 310 bp, Homo sapiens
aacgaacaaacgaatgaacaaggagacagcaggactcctgctcaggtcaaggcagagtgcggatcgcaactgtggaaggtgcacagagtcccagaaagaccaaccacacagggaggcacaaagcatcagacacggagccgggcccagagcgcccagaggtggccgggaggcagcagctgcacctcggggggtgcgggcgaggcctctgtcggggtcagaggtcatgttgccaggtgaggggcagatggacagcagtgtctgcagatgcggggcccgggaggacccaacaccacctgtatggcattctcct

SEQ ID NO: 247623 - DNA, 469 bp, Homo sapiens
taatgcggtgtctccaggatgggaatcgccttcccctcacctgactcccgcgtccggccccgcaccacctcgctccacggcccagccccgacggcgttgaaggcctgcatctgcagctcgtattccatccactcctccagctcctcgatggtgaattctctctccagccggtcactgacgacttgggccactgctgaggactggaggtctgagcgccagtacttaatcctgtagcccacggactcggggttcccgttgtactgagaatccggcaggggctaggaaggaacgaggagtcgcgatgagctgacatctcagaactgccaccctcacgggttgtaagggatgggcctgccctgtgaggccaactccgtggaggaggtgttcctgggggaaatagtcttagaaggatctactttattcttccctgaaacttttgttctgtgaattaaatgaaaccctgtcagta

SEQ ID NO: 247624 - DNA, 217 bp, Homo sapiens
caggtcactgaagtgaagagtttgatgttcttcctagatcttcatagacgtagaattgcctgtgtaatctccttacctcactagtctgccctgtcttccttcttgctagatgagaaataaagaaaacaagaaaagcaagggaaaggagagaaaaaaggagggatacagcaagagggagaaagaaaaggacgagaaaataaattactaaagggagaaa

SEQ ID NO: 247625 - DNA, 568 bp, Homo sapiens
ttcactcttgttgcccaggctggagtgcaatggcgtgatcttgggtcaccgcaacctccgcctcctgggttcaagtgattctcctgcctcagcctcctgagtagctgggattacaggcatgctccatcaccccagctaattttttatttttagtagagagagggtttctccatgttgatcaggctggtcttgaactcccgacctcaggtgatccgcccacctctgcctcccaaagtgctgggactgcaggcttgagccactgtgcccagcagcagagtttgaaaatttttatcttctttgactactcttaaaaaattttatcttaggttttatatatttgatgttaacattattataagtttcttctttaaatttcttcattcctattttggttctagagttttatcttatttattttatctttattccttttatcttttcatgctctctaaattcattcccacttttattggttaatttataagtttcattgcatcatatttttttaaactatatgattccatttatatgaccttctggaaaaggcaaaactataaggtcagaaaag

SEQ ID NO: 247626 - DNA, 391 bp, Homo sapiens
caagagctgtgccactcgtgaagatcctctaagagtacaagcatgggatgccatgaagaatggcaagtgttttaaatgcacagaaagaaaacacatattcaaatgagattttggctatgttggagaaaatttattagtataaatattcattctagtctcctctaaacagaagtccctgtacttacttctcgctgaggacagccagcttctcagaggcactgagtcctctgaagaggtaacaccacagaggcagcagcctggctggtggaaatgtgcttcattaagccttcggctgcatggagaatcctcttccacctattgagaggagtcagcgacttctgcctcactgggtctttttaataccagatatttatacttcatacaggttgcc

SEQ ID NO: 247627 - DNA, 280 bp, Homo sapiens
agtgcagggactacaggcgtgagccaccgtgctggacctgtacagttttttttaactacatttccaatatatagtcaatgcttaacctaaatgcatgcattttttcatgttctgtaaaagagggaaattcttatgatatcaacatcataatctcttatcagagttcataccaaatacatgcacgatgaggccatataatgaaaaattgctgctggggagctctattttaagaaacagtctcagatgtgacaagtagaagcagcagcagagtaaggtgatc

SEQ ID NO: 247628 - DNA, 227 bp, Homo sapiens
ttaaggtattttaagcactgaaagaataatcagcactaaatattgattattgttttaccaaggagttatagaatatttgtcctattagaaaactttatctgctgaaaatgtaagccttagtggtatctccactattatcagaaaaatttgaatttgcttatgaactccttaaagcctgattgtgagaatcatgccactaaaaataaagaaataaacaagaaataaac

SEQ ID NO: 247629 - DNA, 435 bp, Homo sapiens
attgtgaaatggacctactccagcccatttccacctttgagtcataggttcagaattcacattccatggagcaagagtttggttggccaagctggtgttctgtgccatagtaaagcaaaaacaaaacaaaacaccaaaatgggaaagaagagagaaagttgtcatatgttcatttcacctccctgctccttaaacaaatgatcagatatttaaacacacagacataaacacacacaatgcacacacaggatgtctatattgtttttgctggaaaacagtccagatgcactggggtaccatgaaattaaactcccagagggccagaatctctgttctgttgtctcctttccaatgtgtctgtaagggagcagttttatacagcctggaccttatgatgctataagtcagtcccaagtcaatcttatatctaaaaaa

SEQ ID NO: 247630 - DNA, 448 bp, Homo sapiens
agtagtctcactctgtcacccaggctggagtgcagtggcaccatcttggctcactgcaacctccgtctcctgggttcaagcaattatcctgcctcagcctcctgagtagctgggattacaggtgtgcgccaccatgcccggctaatgttttttgtattttgagtagagatggggtttcgtgatgttggcaaggctggtcttgaactcttgacctcaggtgatccacccaccttggccttccaaagtgctggaattacagacattagccaccacgcctggccagattttgcatttctaataaactcacagatgctgcctgtgctgatggtccactgatcccattttgagtgcaaggagttagactatgtcatcaggagaatatcagctgaggctccttcaggtgtttctgtgtgagggctgtcctgtcctccatatagtatatagcttc

SEQ ID NO: 247631 - DNA, 471 bp, Homo sapiens
tttacaaggtctcactgtctttgtgttgcccacattggtcttgaactcatgggctcaagcagtcctccttcctcagcctcccaaagagctgggattccagacgtgagccaccgtgccctgctgtcattaacttttgataagggaaattttatgtcaggaagtttgatctgacaaaatggttacaatggataggatggatcagaggctataagacttattcacaggatgttgctacagatcaggttgggccattaacagcctgaatttgtgatagtgtcacacaaacataaggtaggtagataaaactgtgtgcctaccttgcacagatatctgtgagtattgaaacgtttagactaggcgcagtggctcatgcctgtaatcccagcactttgggaggccgaggtgggcggataacctgaggtcaggagttcgagtccagcctgaccaacatggagaaacccatctcaacta

SEQ ID NO: 247632 - DNA, 774 bp, Homo sapiens
tgtgtctcaagcattaggagtttcaaaaaaccctatgagtcctgatttgggttagttttatcttcatgaaagttagaaaatagcatttcttttctggatattatttgtctttatcctgaattctgcaaaacatgttataacaagaattgttggctattaatatatgttactggttttaaagttttttatttattattaacaagaattgttggctattgatatatgttagtggttttaaagttttttatttattatttatcttatttgattgtgttttagagacagagtctcactctgttgcccaggctggagtgcagtggcatgatcacagcgcactgcagccttgaactccttaggctcaagcacttcacctgcctcagcctcctgagtatctgggactataggtgtgagccaccaaacgtgtctaattcttgtttacaatttatttctgtagagaaaggatcttactatgttgcccaggccagtctggaactcctggccttgggcaatcctcccacctcggcctcccaaagtgctggggaccactgtgcccagtctattttctcctttaaatagtgttttttttcctcctttaaaaaaaaccaaacctttagatgaggaggaaaaggaaaggaaacatgatgtttatggagtgattgttcagcatccagtcttacgctgggtgctttacttagtttatcgcaatgttagttccatattacagatgaagaaacaatggcattttgataatgcaaactgcatagatctctaatt

SEQ ID NO: 247633 - DNA, 456 bp, Homo sapiens
gcttgctttagaccttccaagctcaatcagatcaacgttagattattgcccctttcttttatttgctggatcttattatttttaagacagggtctcactctatcaccctggctggagggcagtggcacaatcatggcccactgcagcctcaacctcctgggctcaagtgatcttcgcaccttggccttctgagtagctgggactacaggtgcttgccactgtgcccagcttttttatttttattttttgtatagacagggtctcactgcattgcccaggctggtctcgaactgctgggactcaagtgattctcccacctcagcctcccaaagtgctgggtgaaccacgattcccagcctcggatcttattttttatttccctctgaaaatctctacctcacagacagaagctttgattgtatgacagctgtagtatgtgacatttgctaaaactta

SEQ ID NO: 247634 - DNA, 467 bp, Homo sapiens
ctgaagctccagattgagcttgtgaataaaacaacaggccagagcttcaactagcctgaactcccttcttctttatcatataaattggtaagaaaaagactgcaatctcctcccaccaacaaacaaatggacaaagcatataaatagacaatgggaataaggaaaaaaaacctgttaggaaagaagcttataaagacattcaacctcactggtaatcaaagaaatgcaaggtagataacaagacccatttttcacctattaatttaggaagaaaactggaaatagccaatgttggtaaggctgtggtgaaaccagtattcatcctgcactgccgaaggaaaagtataaattgacacaacctttttgaaaggcaatttggcaagcattaaattatgttcatatccttgacccagaaatcctacttctgggaatttaaagaaatatgcaaaaataaaaaataaaaaaat

SEQ ID NO: 247635 - DNA, 496 bp, Homo sapiens
ggggaagggatggggcatggggtgaagtctgaattcttccccatcttctgaaaagtgaggggaatcagctccttcacccgcaggcctggagagactgagtcaggagtgcttagcgggtttcctttttaagtgtgtgctgatgcttcaagtgggtaagtggctgaggttatcagtagagactctagaaggtgcagttctcttggaatctgaagtatttgaggacagaaaatcatgctgctttctggtggagtatggtaagaataatcaacacggagagttgggcttgtttggggattgcagtgagtgaggcatgcctggttaatgcaaaatgtgctgctccttcccaggcagtggctgcaaggcctctttcctttcctctgtgcagtgcagcgaggctgcccattgtcccatgttgttcgtagccaggcgtgtcttgccaagtactgtgggaagccccaagattttgctcaaatacacccggagtgggtcaacctga

SEQ ID NO: 247636 - DNA, 475 bp, Homo sapiens
ttttgtgggtgattggtttttcccctttgtctgtttttaaggtcttttaagatattctcttattctttaatgttcttcattttgcatggctaggcatagatttctgttttttatcctgcttgagaactttagggttcctggctttgcaaatttatctctctcaacaattttggaaaattctcagatagtatttgttttatctattatttcctcttcctcacttttccagtatccttttatggaattctgatttttctgattttattacaattttagacttttcactttaccttccatgacttttatcctctcttttactctttttaaaatcatttttccctatagaatgaattttggataatttctttagatttatcttttagttcactaattttctcttcaactataggtaatgtgatataaaatgtaatcattggcattttatcaatttatcaattattattttttccttttc

SEQ ID NO: 247637 - DNA, 456 bp, Homo sapiens
aaagttccttcttttagggtcttctgataacaccagattggaagttctttaaagcaagggcctcgtcctaccatcttcacatccccaacagcccccagcaaagtagtctcaggcactgctaaaatcttacttcaagaattaaggaatcaatggccagcgctagagacaacagtgaaaaaaggaagaagtgaaatagcccgggaccctccaggcaagaggggtaggagatggttccttcactgttttcttactcgcgtctgctccctgctcactaggaaaggtgttcgcctccactaagcaaaggtgaagtgggctgggacaggggaactccaagccagcttggaatgcgccctgaaatgagacctctaggctttctctaaaaagcccctttgtcctgtccaccctgctcccctcccccactgcgccctccacatccaggctggcccgagactttgc

SEQ ID NO: 247638 - DNA, 390 bp, Homo sapiens
tcaatcgcttccccgggtcattctaaagtacagccagagttgagaaccactgttctagaagcctgggatggaaggtgggtttccttgtggtttgtgcccctgcctggcagctcagggatcccatttgacccaggactcctaaggtcatcatgatttttgtaaaaaattgagtaacccagaatatggaaatggagtgaaagagtatcgttcacgatgggtgggatggtatttgtgaaggtgaatggatttacctcttcctaaaagcagagccaggcactaacttgttagacacctgataatgggtgcaggcttacgtcttggtccctgccaggcaggcttacaaggtagagaggacagttgacagagtgtttcttcccaaaggacaggctg

SEQ ID NO: 247639 - DNA, 254 bp, Homo sapiens
cggtgtaccagcgcagctgtgggaagaagcaagtgccctcttcccatgcagcctggctgtggcagtgtgaggctctacgactccagcaatgattaagaagcaggtcttggccaggcatggcggtcacacctgtaatcccaacacttttggagaccaaggtgggatcattgcttgaagccaggagatcaagaccagattggacagcacagcaagaccctgtctctaccaaacactttaaaaaataaactttgtga

SEQ ID NO: 247640 - DNA, 1563 bp, Homo sapiens
aatgtgactgagaccactacaatggccatgcctaataattacttatttttataagtgctggatgcgttttacccaacataatagcagatacagacttttaagcttaaaacctaaatgtcatagctccaaacatttggttgtatgttgaaataactctcaagcaaaaattgattttgaaacgagagctgtaaataaataaaataaatgacataaactcataaatatctggaagaaatgcttataaagaggtcagccttaaaaatgtcatgaggtctaatgtgccgctcttctatttctatggatagtacttggacaggacaaggactcaagggtctgctggtccatctctgcaccttgaaacagtggctagggcaccaggagtaatgcttccagccaaaaccatgtggttagtgtgaggagtccctccgggttaaggagtgtgtcagcataatgtgacctgaagaagaggtatacctcataggcgcccaggatcaaggtctccggcacacattgaaatcccccatgcccaggtgtggtgaagtgaatccctcagctggtgctgggcttccaggtgaggcatcctggagaggatgtgcggggcgaaggtcatatgagcacctgcagcactggaatggggtgtcactggcctgttaggccgttgctcaccaggacctctcctgagctcctacgtggcttagtggtaagtgtcccatctacccgaccccgcagcccgggtttctcctccacttacagacccgtgccctcttggggagaatgccagcctccctggagactcaggccctgcaggacccacatgctgtcgtctctcatgggctagacactctctggtgcacagggattcccagacagtgaatcccaaagccctgcaggttctgttgcttcttccctgaatgcctgccttccccgaccgaacacacaggaagacacaggtagctactaggttttatttccctccggatgtcatttcaggtccatgacatctcctttaggtagttcgcccagccactcttttcctcctacctctgccattcatgagaactgtgaggactcttcgtgtctccccagcgggcaggcttcacgggtcctgaagttggattgtcaaacccagtggtcccctgcttgccagctcaagagctgcgtttgaggcacacctgtgggtgggagtgtgggccccacctctggccaaacaaaggtacacaaggggaaacaggtgcaggtgtgtacaggcgtgcaccagctcaaacatgcaggctggaacgtgcacacgctcacattggtaccagggaaactgggtgggtgtctgggtgtctacaccaatactcagatgaaccttaatgctcagccacattcccttgctggacacacacagaaggtcccctgccatttaattgatcgtctacagtgggatttatttttacttttatacttttttaacttaccaaagtatgttgcattctttcccccatcatgaaaaagactttgatataagtaaggaggaaaagcattttttataataaaatactttatctgcatctatactat

SEQ ID NO: 247641 - DNA, 809 bp, Homo sapiens
tttttttattcaataactagacaaaagatctaagataatattaaactcaaaacagtttgtttcaaagaacaattggttaataactcagctggcacagggattcatacacagtttttcaataaatatttaaatgaacaattcatgtcacacaacttgcttttaccctagtactgagtctcacatcaaagaaatttgaaagatctataacctatgtgaaatgaagtctctgctttaccagaataatatgtggcaggtaataaatatgtaaagtacaccaaatgaaacatattttgcatagataacagtccatatcactattataattaaagaaatatatgtacagacatgtaccaatccttttaattaattttagaagatgaacagtgattcttagaagtgagtaattagactccttttagtcttatgctgttagatctttgtggaccagctgagtaaatgaatcttcaaatcaacctttctttttctgctgctcttagagcagatttataaaaatcctaagaatgtcttcaaattagaaaaatttactacattttaacctacctcatcagtttctttgtgataatagctgaaaataactcaaactgtacccatcttagttaggctatatctctgtgaaatgaaaggaaccacttaattttttttatataaattagtgaatcatttgctggagcttagaaaatattaacataccaaaatttcattatgatgatatttatattgctttttgacatgccaaaggtacatttacatattaccatatttggatgacttacatagtctggtgtaat

SEQ ID NO: 247642 - DNA, 285 bp, Homo sapiens
attgcactccagcctgggcaacaagagtgaaactccatctcaagaaaaaaaaaagaaagaaaaaagaaaacatgaatgtataaaagtttgtatccgtttcaggaattcttgctatttttgagttccagagggagtttgggccagcagagagatggcccaaccaggaacccaggaactgaccagctcccgatctctgctcacgacattccctgaagggcccgtcctctgggttcccagtgctgatctctgtcctgatccctatcttctggcatcccagggagccag

SEQ ID NO: 247643 - DNA, 741 bp, Homo sapiens
caaatacttgatttttggatatctgttctgccttacagctgtgccttcatgttaggccctagaagctgcatgcttccttggccctgtttcttaaaaggctccagcctaaagccagtaagccaatttttaaaaatcttcaaggaaatcacatttaagtgtgtctgctttccttggccatcttaactgaacttttacaccatttttttttttggctttagtaaaatataaatcctccatcttgtttcacatgagtcatctctttaaaaatgcaaatttagaattgcctcactaataactgtttacagtagggaacaagtattcaaaagacgaatgtgctaaagtggagaggaaaaactggcaaatgaaaaatcttttgaatccctaagatctacttctgtgtgcctatatgtctaaatatttatatgaattatgcatgtaatgtttgaataccaaaaatatgtgaaaaggctctaattggctttttaaaaagttcttaaatattgtatcagaaattagaaattagaaacttattcccaaatactttttcaagttttggttaaaaagaaacttcaagatgtcttcacaatagttagcatacattattgtttagatgtattggtccagtggtttttttccttttttcttttttttattttctggtcaagtggttttattttatatcttctagctactataacatgtcaaaatttgccacaaagttacaaactataaacccagacc

SEQ ID NO: 247644 - DNA, 955 bp, Homo sapiens
taatgagatagtacccctttgcccctaccctgcacctgactcaactgggtgctgcagccaacagattgtggatagaccctctcctccatccccatgatgcaataatgagccagaataccatatcctctcaattagagagctgaaggaggattactgagagggttagagggaagaatttttataatctgcatatgaagtcctggacagatccctgaacagacaatgcatgaagctgaccaaaatcaaaacagcaaacgctttaagaactcagcagtggtatagaataactcccggattttagattgacttcgggataacacataagtggggcagaccagaagcatgttggaaaggctttgagaactaaactgacatttgaactgcagcccacaaaaataagctaagaaatgtatatgcaacctaacaggaagtaaaaaaataggaagaagggtgtcataaaataatatgtaaaaggtacaggataccatttaaaactacttgtcatattgagaactaggaaaatttcaattccaatgaaaaaatacaattaacatatgccaacactaagatgatatagatgatgattaattccaaatattttaaagcagttatcattaaaaggctatcactttagaagtaaaaaatgcaataaccaaaacaaaaaccacactagatgagctcaatagcaggacaagatgaaataggaaataaactataaacttgaaacctgagtaataccaattttaaaatctgatgaacagaaaaaacaaattaacaaatgaaccatcttggatactctggcagtacaaaggaaggcagggagagggggagtaaaatacctaacatatgtgtcctcagagtcccagaaaaaaagaacagtacaaaactaaaaaaaaaattttaagaaatatgagcaaaagcttcacaaattgggggaaagtcataaacatacaga

SEQ ID NO: 247645 - DNA, 682 bp, Homo sapiens
agaaaaagcatgttggagttctgtatgttttgcacttgtactgaatagcagtttttgctatgtgtggccttttagagttgagcaagtaaataattgtatgcttgttgttgagcgtggtggtactggaatgtcacagccgctggggaggggcaggggaatgtcacactgcagggacagtctagcagcctttctctttctgagccgcctcctctctcctgtgactgtgggtgacaacctcaaaaagcctcatcatcactggctacttttttctctgcttctcattgaaaactcttgtttctggagatgaatgctaattagcttcagggcagtgcggtcatgtgtcatgcattccaggccgcctggcagctgtgattgtgttttccatttagcaaatgtattagaataattttcaggacatttccattaggaatgactttttctttctcatccatattgtttttgtctcagaaatgtctgcttttataacaaagcatgagtggaaaaatgtgaaattatcaactgttaaacacacacacacacacacacacacacacacacacacacacacaacttttcttagttgcctgctcttgactcagtgtggaataccttgaaagttgtcggagccgggcaggtttaatattcctgagcagtgcaggatgctggccaatcagctgatctc

SEQ ID NO: 247646 - DNA, 569 bp, Homo sapiens
gagacagtcttgctctgtcaccaggctagagtgcaatggcacaatcttggctcactgcaacctccacctcctgggttcaagcaattctcctgcctcagcctctggagtagctggcattacaggcacgcaccaccatgcccagctaattttttttatttttagtatagacgaggtttcaccatgttggccaggatggtctcgatctcttgacctcgtgatccgcctgcctcagcctcctaaagtgctaggattacaggcatgagccaccacgcccggcctcttcttgttttttatttgtatgttctttttcttgagcagttttgcccgagctttgtctgatttatgatttgtttcaataactaactcttggatttgtccttctctgttgttttgtatcttgatttgtatctttttttctccttgtatcttctaagtttccttcctagtatttttaggctttattgttatttttctataatcttatattgaatgatcagctcattaatattctttcatcttcaaacatatctatttgattgctgcattaaagaaatctttcatatacagta

SEQ ID NO: 247647 - DNA, 362 bp, Homo sapiens
aattaaattgcataaacaagaacaatggattcctagggtgtttaaaaacatcaggattagtgagtattaaatgaaatatcaggcattcttaagataaccttttgcagcataattaacagagtcaaaggggtatctttcaaagaaaattaaagaagatcagatagcccaagtgattaatactgaattttctaccaagtactgacctgtctgcaaacagggttagcatgggttatggagccaaactgctggggttcaaacaccattaaaattactagctatgtgacactggaagttatttgacacatccgtgcctcagttttgtcatctatagattgggggttgcatctacctcatagggttgt

SEQ ID NO: 247648 - DNA, 203 bp, Homo sapiens
taaaaacctagttcaatttatgaaattcacaaagaaatgttttcatgaagttgctaatattttctgcttcacttaaaacccaccgtgcccagcaacttttttaaatgctagcatatttattatctggatatattcgaggaggaacaccatgaaagtaccttcatagcttttaattctttagagttcttggagtataactacct

SEQ ID NO: 247649 - DNA, 384 bp, Homo sapiens
ttgagacagggtctcactcctgttgtccaggctggagtgcagtggtgagatcttagctcactatagcctagacttcccaggctcagatgattctcccacttcagactcccaagtagctggaactgcaggcatactgcagcatgcctggccaattttttgtatttttagtagagaaagaggtttgcacatttcctaggttggtttcaaactcctgccctggcctgccaaagtattgggattacaggcatgagctaccgtgcccatcggctaactttaaaagtttttttttttttaaattggcttgatgttttccaaaaagaagtgaggtgtcatccaatcctaccctataaactctgtgtacatacatatatagtacatataaaa

SEQ ID NO: 247650 - DNA, 629 bp, Homo sapiens
gatggccgggatgggcatgaggtggccaaggatgctgtgtctgtagggctgctgcaggcactcagtgagtctggggccaacctcctgtggtctgctggggctgaggcaggtagcatggttaaacagtgactccattctctctccacaggcagcccgaatgggcatgcagagcctgtatcaggccccaacccagcaaacctgggtggccactatctgacccccaaaggtggggaggggcatgggcccaggcccatcagcctccctgctgggacagggacctatggcacctgggggcagcttaggtttggcttaagttgtggtgaggggccttgccctccccctcccagcccagggtccaacctgacccagttatcttccatggccattccttgtcccacccccacccgatcataccttcccccctctgccacagcttagcatgaatcttctttattgtcctgatttgtcctgtttgttggtttttatttgtggggaagggcagctgagccaaaggggtcagaaattctgccctttgcctccaccacatggcattctggttttggtttctgtatagttttgggtctttctatgctggttgtatttatattaaacccctggttagtaaaaaa

SEQ ID NO: 247651 - DNA, 727 bp, Homo sapiens
aaattgtgaagtggtagtaattgcaagtatggctttatagataatatagttaattgataccaccctctcaagcatatacagcacatcagctgctatgagcctgggtgatagtaatggtgtctatggcatttatgatgcattgaggatgacatgagtaaaatgaaaacttagagcactcaccagggtcattctttcatggacatctgatgcccatggtcaagtaaatttttaatgacacatagtcactacacacctttcagccttctggagaggtaagtgtacattgatctgtcctaattagccttgcagagtacttcagacatccctgcaggaagactattatttaataaaataggagctgtttttacacaagctcagcacttgctccttggatagctgtattgtttttttgctcttctctcttttttttaaaactcatatctcatgtctcatgttcgtctttgtctttgacaatgtagtattaatgcagctgcatgaaaaagtaagcaaaattaaggaatgagtctgattatgaaggttcattgctattataagaacccatagagcacacatccattccttccctaatgtatagggtgctgactgcataaaattgcttggaaagacattaaggatatgcaggcaattctgttgaggtatgcagtgggatgcttttatgtttggtgataaaggtggctctggaatatctgatttcataaaaaaaaaa

SEQ ID NO: 247652 - DNA, 356 bp, Homo sapiens
agacagtgtctcactctatcacccagcctggagtgcagtggcataatcatagctcactgcagtcttgaattcctagactcaagtgatcctcccacctcagcctcctaagtagtgagtagctagaactataggtggatgccaccacacctggctatttaaaaaaaatattttagagacggggttttgaacttctgggctcaagcgatcctcctgccttagcctcctgcatagttggggttacaagcagaagccaccatgcccagctcaatgttggatttcttaattccatgagccagtgtttcctagctgcttaagtccatttactttgagtttctgtctcttacagccaaaacata

SEQ ID NO: 247653 - DNA, 354 bp, Homo sapiens
tctctgggcacagccctggaacccccatcagtgaactgcactctgacaatttggagcccagctttcagccttaagggactggactggatattccctgtttcacccgaaatcaactttaaacaggtcaacaaaacaattgaagagaagtgtctggagtacttcatacgaagacagaaatcccctggagtaaagtggaaagagacctgtctctataaacaactgaaatagcttaattttgaaagcaacaaaattattttttatgaagaagaaaagtctccactgcattcttcacaaaataattcctagtatttcttaatgactattaaaaaaatctaactacttatattacaatac

SEQ ID NO: 247654 - DNA, 1111 bp, Homo sapiens
catggtagttcatgtctgtaatcccagcactttgggaggctgaggcaggcagatcgcttgagcccaggagtttgacactaggctgggcaacatagggagaccccatctctacaaaaaaaaataaaaaattagccgagccaggaatggtggctcacgcctataatcccagcattttgcgaggccaagatgggcagactgcttgagcccaagagttcaagaacagcccgggcaacatagcgaaatttcctctccacaaaaaatacaaaaattagccgggcgtggtggtgcaggcctgtggtcccagctacttgggaggctgggcaggaggattgcttgagcccaggaagtcgaggcttctgagctgtgatcacgccactgtactccagcatgggtgacagagcaagaccctgtctcccctcccccagcatatacacacaaaaaattagcctagcatggtggcacgtgcctgtagtcccagctactcaggaggctgagacaggaggatcgcttgagcctgggaggtccagactgcaatagctgtgattgtaccaccacactccagcctaagtgacagagtgagaacttgtctcaatcaatcaataaaaataaaatgaaataaaatggcagagtacagccagcactccgtatccatgatgtagaacctgcagatacaaagagccaactgtaacctcctcaaaaatccactggagaagggaggcctctgaacaaccaactctaatttcaagttcctcacttctttagtgagagtatgaataaaatgctagggctacacagaggttactactcatttatggaaaatagcaaacataaatccttaaaagaaatgcaaaaaagctgcagcagatccacagagagctcatacaggccatgacactatactgaccacagtttaattcaagatcaacagaaggctgggcacggtggctcacacctggaatccctgcactttgggagaccgaggcaggcagattacctgaggttgggagttcgagaccagcctgaccaacatggagaaacctcatctccactaaaaatacaaaattagccaggcgtggcagcgcatgtctgtaatcccagctactcaggaggc

SEQ ID NO: 247655 - DNA, 533 bp, Homo sapiens
tgggaatgtctcagcccaccttggctcccttctccagcaggagtggaggtgtgtgatgtcaaacaggcccagcctctctctcagacccggttctgggcccacacagccccttcttcctgaaagcagaggtggcagtaagaggatggctttggcctttgaatgttctcaagcgatccaagttcagagtatactgttgctgtcctctgtccctgaagcttctctcctactccttggacaaactcacttctcccctcagggacttctctcatgtagcagagtgtacacctgctgccccagcaaggccttcacaatgatccaagcctggcctgttgctccagcttctggaacctcccatggccttcggtctacttgaatgctcctgaggccaggtagctcatcactgccggaggacctgttgccactcacttctagccacaagaaatgtctgcctgtcctgagcaaaacccaccttggaggaacttctttactcccttgttgaatttttggctctaccaaataaacatgaattgctt

SEQ ID NO: 247656 - DNA, 887 bp, Homo sapiens
gtaaatctttatgaccttggagttggcagtagactctagatatgacactaaaagcagaaacaacaaaaaataatgaattggatttaatcaaaattaaaaacttttttgtgtaaaagtatactatcaagaaaatgagaagacaacccacagaatgggagatatttgttaatcatatacctgataagaatctatgctgctgtctaaatgtttatgtctccccccacccaattcatatgtgaaggcctcaaccgcaaggtgatgggattagtgcataaggataaggatggaggcccttgtggccatgtgtggtggctcatgccggtaatcccagcactttggaaggcggaggcgggaggattgcttgggcccaggagtttgagaccagcctgggcagcaaggtgagactccatttttacaaaaatttttttaaaaaaagaaaagaggcccaagagagaaaccccctaccctttctgccattagaggaagtgggccttcaccagacagagtctgccaacaccttgatcttggacttcccagcctccagaacagtgagaatttctgttgtttattagctacccagtctgtggtattttgtaagagcagcccaaatggactaagacattctagtagcacaatatagaaagaacttttacaactcaatgaaaagacaactcagaaaatgggcatggtagaacttgtcctgtgaagaagccaagaccaaaaaaaaaaaaaaaaaatggacataggacttgaatagacattccaaagagtggcaggtgccaacaagcacatgaaaagatgatcagcatcatgaatcgttagagaagtgcaaattgaaactgcagtgagataccacttcatggccagtaggacagccatttcctaaa

SEQ ID NO: 247657 - DNA, 568 bp, Homo sapiens
tatacttgaagatatgttaagtgtgattaaagttttaaattgttacaggaacatttgttttccaaagagatcaaagttgggctttatgcacacatcttaccgcagttgcagtttataattatttatcaaatgtctgacaaggctaatgagctttgtttacattttccagccctcttgctagaattacagtttattttttccacttttgaaggctacaaatatgcataaaatcacaactggcagaattttctcaaatagggggagtttgtcatacagcaaatagcttcacaaaacacctgaagcttaagtttgaagtatctaaaattcaaaaatctcctgtaattatagtttgaattttcaaagaagcataagtttttagatctgggaggttgttatagagattatctcatccaatccctatttattttgtcaaaagacaatattgcagaaaaaattccactgggaatttactcctaatagagcattgacttacaaacgggaggtactaatgaaggggggcctctcactatatagtcatatagatgttatatacccaaatgtctgaccc

SEQ ID NO: 247658 - DNA, 626 bp, Homo sapiens
tgaaaaattgaatcaaaagctattaatctgaaaagaaacaaattagcagggcatattgttttccttgaatgctttaggttatagaacaggttaataacaatatgaattcaacatagtgggtcccaaagaggaaatgatgaaacaagagaatgatctggaaaagtgattttctactgtcctatagaaacaaattaaagaccaaaacaatattatttttttttaatgatactttagttctagggtacatgtgcacaatgtgcaggtttgatacataggtatacatgtgccacgttggtttgctgcactcatcaactcgtcatttacattaggtatttctcctaatgttatcccttcccccgtcgcccaaccccacgacaggcccgggtgtgtgatgttccccgccctgtgtccaagtgttttcattcaaaacgacattattatagaactgataaatagataaaaatcatcaaaaaaaaaaaaaagctgaataggcacaactcaaaataagcttacagacagaaaaaaatccttaagataaagatagaaattgcatgtgaaaagcacaaagcaatttcagcctagttcttaagcctggttgtagacaatctgcaaataggacagacaaa

SEQ ID NO: 247659 - DNA, 334 bp, Homo sapiens
gagagcagaaagactggagaaaaaatataccacaaatatcaaaatgttaactgtggcttacaaggtgatttttattttttatttttggctttttctgtattttgaaaatattctaggatatgttttttttttaaatcaggccaaatgctattaattaaaatattgatgaaatcaaagaatacctcaaaacatataaccagaaaacaataataaagataatagctgtcttactttgggtaccccaagagttgactctgagactaggtgcaagtagtttatttgggaattaaatctaggaagtactaataggaaaagtaggaaaatgagagagaag

SEQ ID NO: 247660 - DNA, 148 bp, Homo sapiens
atggatggctgtcacggtgccaacctcagatgcactgagctttgaaacatggcaggcctggtatgcccttgctctagcagctccccgagtgccctggacgtgctgcctgggggcggctctgccatcacggagagcccgtctcctgcgc

SEQ ID NO: 247661 - DNA, 1071 bp, Homo sapiens
ggtaggactgtactctcctgcttcagaaagaggaaatgatattagagagaggatctagtcatgattgttaacattccatgagtctgtaactgcattggaaggcgtgtatggtgtgcaacaagaaacacttgtctgggaatgagaaaacctaaggtggaatcccagttgcccctaagatccatctatgtcagtaaaaagagatgtttggactgggctagagttgcctaagcttttcgaatatgaagtctccttttaacaacaataacaaaattcagcccctccctcaatgtaatagtagttatatataataactataaatttagtggtgtttctagaggcatttatatttttattcatggaaatttcatgcatatgaaaagggatacatttatgggcaagccatcagtgttgggggagtatttggtgtctttggagtgatggcccctttcacagagtccacgggcttcctggtggcctttttagagaacccctgaactgggtctttccatcttggatctctcctactttataactctaatttaagataaaatatcaggacataatctattgcaatctgctaactgaagacccttcatagaggaagttaacacttattcagtctgcatttcaaaaagaatttctaagctatgtcagatatttcctaaatgaatgtgaataaagacgtatttgttcattttttccctaatcctgtccaacacctttatttaaaatggaacttgtttgccatgactttgatgttcctgagtgattatttagatgttattttggggttgctatcaagtgcttgttaattcttctttcccacacttgacatctctgttgaatatcatttttcatagggaaccaatgaacatgactgcgggtccctttaatcatggaatcatagaaactagagacaatagatggaagatgttgctttttcctcatctagaaaatgggaataataatgttaactattttcactcagtcatcacgcataggaaataagattcctcatctagaaaatcagaataataacattaaccttcctcacccagttgtcatgaataa

SEQ ID NO: 247662 - DNA, 338 bp, Homo sapiens
ataaataatcatagtaatggattataacccattgaataaaaaggaaagaatccatgagtccatactgacataaataaatgggagagaaaagaaaactttcttacagtaggatgccaagcaaaaaatgtagaaggaataacactgttagaaagtaataataataataaaagaggaatggtaaactcacaaatccctttcttcaaaaaggcaaaatgttactggcacacctgtagtcccagctacttggggggctgaggtgagagaattgcttgagtccaggagtttgaggttacgatgagctatgataggtgacagcagagcaagaccctgtctcaaaa

SEQ ID NO: 247663 - DNA, 603 bp, Homo sapiens
tgggtctttaagaaataagttcttactaggcactcccaaaccttgctgttttcacccagcaggcaaaataggtataaacgtgtgcatatgtaaacatgcatattactttaaaacttactgatatcttatagctatttacagttgaagaaatgatgcctcatattcaacatctgaaaggagcacatagtaagaacttatttcttaaagacaaaaagaaaaagaattattggctggtgacagttcttcatgatagacaaattaatttaaatgagcttgccaagcagttaggtgttgggagtggaaatctgcgatttgctgatgaaacagccatgctagaaaaactaaaagttggtcaaggctgtgccacacccttggcacttttctgtgatggtggagatgtgaagtttgttctggattctgcttttctcgaaggtggacatgaaaaggtgtactttcatccaatgaccaatgctgcaaccatgggattgagccctgaagactttctcacatttgtgaagatgacaggacatgatcccataatactaaattttgataaaaacaactaattgggccaatgtttagaataaatttctttctgaaagc

SEQ ID NO: 247664 - DNA, 756 bp, Homo sapiens
tgcatgtcacatctaatactgtaacactttaaatagctttcatgtcagttttaatgttaatgggatttaatttattactaaagtacatttttgttggttaagggcactgcacttttctgttttttaatgtgggattttgcgtaaatattctgtacctaagactttgtgaaagtgtgtctgtgccataatcaacaaatgatatacatcacatgcaagtcaattttatttcaatctatcataagcagtaggcgtgcacgttaagaaaattctctggatattttcataaaattacatgctcccttacctgacaaaacttgttacagctttccaaaccaaaatttccacattttgtttctaatttttaatttcaatttaataattatttaatattctatttgaatttataataaagtgttgatatccaggaattccctgaggtgtcaactgagatttatatactgacagataacccagactcacccgctctctacagtgacttctgacacgatcttccaaacagaagggatttaaattttttcttaagggctttatgttgttattattattatctcacttaattcttaattcttatcaggtggatattattttcctttttctaaaccactgtacttcagtgtagcttattattagaagtcaacattacaatgatcaaatctttgaaagccaaaggcatacgtatcaaaaagtcacaaaaatatccttaaataagctttctttagccattatataccaaaa

SEQ ID NO: 247665 - DNA, 629 bp, Homo sapiens
ctggaaaattggggtcattgattggtcagggtgaggaggatgaaattatcaggatgtggagcctgtgtgctttggtgagtcagcttcttggggggtccttcagacctgctgatgtgggtggttttagtggcatgtaggacgtgaaagaatatctcaaaggaaaacaacatttcataaggttctagttgttatctctagagcagataaggggatctataatcttgtaacagggtctatctgattctaagacaacagacaaacaacaacaaggaagcgcgtcagagaacaggccgacctcatgatccatgctgcgtgtgctgcaagctcattttagtctcatttctctccctcccttcttccctgatgaataaagtttattgggatggtttcagatgctcagcttttccatatgattaggtgagtgatccagaacccttccaaagaaccctgtggactcaaccctctgtttgaacaacatacaagataatatgagacatttatttatcgaggaccctctgagcacctggcactgtgccagattctttcagatatataaaatttcacttgctcctgttgattctggaaaggagcaacggcatcttatgaagctgtagcagatactgtcctgg

SEQ ID NO: 247666 - DNA, 647 bp, Homo sapiens
aggtttacttcaaacagttttgcagaacttgtcagaagtcttataacccttaccgagtggaggatatcacctgtcaaagttgtaaacaaacgagatgttcctgcccagtaaaacttcgccacgtggaccctaaacggccccaccgtcaagatttgtgcggtagatgcaaaggcaaacgcctgtcctgtgacagcactttcagcttcaaatacatcatttaggtgaaagtcagtgttgctgtgcatgcgctgatggagtagacgagtgagcttttccgtgcctctcctccacctctcccttctcaaaatacttcatgaaaggcagtgtgttctgaaaaagccttcaaataaaggtattgcaacacgatttatacattgcataaaatctgtctttgaaaataaagtttcaagagcgcttgtcttgtgctaacagtctgggcctgtcacttcacctttatgaatgcttgctgatggcatagagtgggccaggctctgagttaggctgcagccacttggaaaacaatttaggggggtgcttgtagacgaggtctacttatttaggcaggtctggaggactgaagcttagaaggaagttaactgaataaaaagccgcctagcgatcgcgccactgcactccagcctgggtga

SEQ ID NO: 247667 - DNA, 402 bp, Homo sapiens
catctaggctacaaacttgtacagcatgttactgtactgcataatgtaggcaattgtaacacaatagtaagtatttgtgtatctaaatatagaaaaggtacagtaaaaatttggtattataatcgtatggggccaccatcatatatgtggtctgtttttgactgaaatgatgtcatgtggtgcaggactgcatttaaaatgtgtctcttgtaagtaacatatagttgagtcttgttttttaatagtctgataatctttgtcacttaactggaatattctatttacatttgctgtatttttaaacataactagcatttactaattattaatgtaattgagtttgcatttttataattactaatgtaacgtaattactaatataaataggtttaagtcctgtct

SEQ ID NO: 247668 - DNA, 449 bp, Homo sapiens
ctgtgctggtttaaaataggtccataaattctttgaccctcctccctgcaaaagacggagaataaatcctctcctcttgagcatgggcaggacttagtgacttgcttctgatttggcagaagtgatggtgtgtgtgacttctgagactaggtcataaaaggcatgtggcttcctcgcactttctcctgggttgccatgttgtgagtaagctcaagcagtgccacaaaggggtccacatggcaacgaactgaagcctcctgctacagccatgtgagtaagccaccttgaaagcaatcctccagtcccaaccttcagatgactgcagcccccagtgatatctttgtaacttcattagagatcctgaaccaaaatcaccctgctaagctgttcccagtatccaactttcagaaattgtgtgagataataaacgtttgttgttttaaactact

SEQ ID NO: 247669 - DNA, 466 bp, Homo sapiens
tgagcagtttcatggcttttctggcataactttccaaaccccaaatgccctcggatgcactcagatgcgccgtacacaacaggaagctcagcaggacacgcagtctaggaacatgcacgacccaggagacacccaagacccaggggatgtgtgacccgggagacacatgtgacatcgccacggagcacagcagagacggaacagctgcaaaggtcacggcgcccacccagagctggtagatggggcgctggcgccgcagaggtgggccccacagccttccacacaggggcatctgacccacggcccggccccttgcaaagccaaggccgcagagggggaaggtgcaggagctctgagatgaaagaggtgatgagtttgcggcaatgtaggaatgaaatacatcggccacaggaggacgcaggtgcaaaccaccgaaataaagccattgccacacaggcggacagga

SEQ ID NO: 247670 - DNA, 344 bp, Homo sapiens
cataacttccattagctgtccccaaaagtgtatttcctacctagttattacgcatgaaatctctcgcataatatgaagtaatttctaatacccccaaaagtaaaaaatgtgagagggatctattttcaattcttagggttccacgagggaaacagatgtctttttttccccccaaaatggagtctgcagcacctcctctgtttttcccaaggtgtcccaagctgttaaatattatcttaggtcctctcgtgtgcatcaagaatgtcaagaagacaaaatggagaaaattcagttgactgagaagaaaaaaccccttttccagaaaaacacaatccacgaagagg

SEQ ID NO: 247671 - DNA, 342 bp, Homo sapiens
gtcttgaaatgcatatcttagtcactgttacttcttttaaattgttttaattgtataagataaaaaccaaaacaaacaaaaaaaatgctaccatttcaggagcatacatctagtcttaaaaatatcataaatttgggccgggtgcagtagctcacgcctgtaattccagcactttgggaggccgaggcgggcggatcacgtgaggtcaggagttcgagaccagcctggctaacatggtgaaaccctgtctctactaaaaatatgaaaattagccgggcgtgattgtgggtgcctgtaatcctggctacttgggaggctaaggcaggaaaattgcttaaaccc

SEQ ID NO: 247672 - DNA, 403 bp, Homo sapiens
tgacatttgttctaggtaacaggccacgcttgaaataaacattggtccttgagctgaggcacaggggattagaatcaggcaacaggatgaaaaagaactttggttttcatgatctctaaattcaatgagattatttatttatttatttatttatttatttttgagacagggtcttgctctgtcacctgggctggagtgcagtggtgcaatcacagcttgctgcagccttgatctcctgggctcaagccatcctcctgcctcagcctcccgagtagctgagactacaggagtaaaccaccacacctggctaattttttgtagacacgggatctcgctatgttgcccaggctggtcccaaactcctgggctcaagcgatcctcccaccttgacctctcaaaatgc

SEQ ID NO: 247673 - DNA, 445 bp, Homo sapiens
acatatatatacatatatatgcagttacataactttgagaaatgccaagttaagcaaagttagagttctttactacaagacttctcagtgcctttaatgtcctcctatgttatcctctgggtatattctattttctaaatcaacctacctttttactaggattggtgttccaaggaaaatactggaaaatgctggtctaaatattgttaaaaattgaactcaagtgtctaaaaccagaagtgcccaatcctttactagagtgtgagctccttgaggacaagggtctgtactcattctttgtaatcccatcttgcatataaccaatataatgctcaatatatattattgaatatattaatataaatttaatataactgttgagagtcaatttgtaatgcaaacctaataagctcctgatttgataaagttagttattatgaaataa

SEQ ID NO: 247674 - DNA, 765 bp, Homo sapiens
gaaaaagttaacactcctatacaaacataaaaattcttcatgaaatattatattaaaaaacaacaaagtaacccagtcatctcaaaattgacatctatgaattccagaaaagttaagagtgatgttaaaactagagcagtgaggggaagctgaagtagaaccattcccagggaaaagaaacagagttaggccttcataatgagggacatgaaggagaatcaaactccatctgcagaagacgggaagctagacgccaggctccaaagaagagccaaggttcatacatgactgtccacagtgatgtcataagacatttatcaaccagtttataaagaagactaggactttccttaagggttcagaagtgaataaccttcttccttactgaatataaaacagaaaccaagaggcagcatgggatcacaggaggagaaatctgccaagaaaggagccaaaaccaagaaagcagacgcaaagaataaagagtcccgctcacatttctgagccaccacatcaggccagaggatactggattctcctctcctactcttccttctggtgatgccaagttttgagaactgacttaaaaatactgcttagatcagagtgaattattataatccacttatgccagagctattcatgttgtatgatttttttcccttttatgctgatcttcacttgcttttgcctacctaccataagcttccacgttaaaaatctttgccacatgtatatctctgcaagcagccttctaaaataaca

SEQ ID NO: 247675 - DNA, 924 bp, Homo sapiens
gtgggaggatggtttgagcccaggagctccaggccagcctgatgagatcttgtctctaaaattttttttaactttttaatgatgtcaaaatgatttctaaagaaagattaattctgtgacagcctctggacttcaattactaagttttaagataatcaattttaaaagttaatgttggccactcatctatctttagagatggtagctgattaaactgataacatgctttattagtgattttaagacagcaaaaccattgtagattcactcttacccataatatatttcttttcattttatagttagtctttactttgggcaataatttgtaattcttaccatccataagaatacctgttctgcaatgagatcacatggacacaggaaggggaatatcacactctggggactgtggtggggtcgggggagcggggagggatagcattgggagatatacctaatgctagatgacacgttagtgggtgcagcgcaccaacatggcacatgtatacatatgtaactaacctgcacaatgtgcacatgtaccctaaaacttagagtataataaaaaaaaaaaaaattaaaaaaaaaaaaagaaaattaaaaagtaaaaaaaaataaataaataaatgtaatgttaacgcataaaaaaaaaaaaaaaaagaatacctgttctgatcagttttatagttgagcttgtgtgtctgagacattctcagagtgtgaactacaaactgatacaaactgagtactgaatgaacttttctgcatttgagttgaagcatctcctatcatgagtgtgcactgactcatcttaggactcttaaggtttgataaatactgtgggaggacctaaaataaaactcattttattatcattaattaagtatttcataaatatgaaataaaagtgctctgtgtaag

SEQ ID NO: 247676 - DNA, 459 bp, Homo sapiens
ttaattggaaccatgaacatttttcagcaagtctccaagaagcagaagtaatacaaactcaggaagcacagccaggggataaacatgcctttggcaacctcgttgagtgtattttcccctgaggttcatttgtatcacacggaagtctttcaagtttgtgtagggtgacggcatatgacaatatttatgctttgtccttagtgggttcaaactgtaagaatcactttgtaaagactaggacagggttctttgccttttagggaaggactaggatggccacttaattatgctgtaagtcattattaaaacaagaggaaaaaaatctcttagtacaactaatatttgacatccactctatctatggatatcagacataattcacttccacccataatcctatcccacattcatgtatattacagttttataaaattaaataaaaagtttcttccagccagc

SEQ ID NO: 247677 - DNA, 189 bp, Homo sapiens
gagaaaaggtttcactctgatgcccaggctggagtacaatggtgcaaatacagctcactgccacctcaacctccagtagtcctcccacctcaacttctttagtagctgggaccacaggcgtgccccaccacgcttggctaagttgtttcttctcttctttgtagagatagggcctcactgtgttgcccg

SEQ ID NO: 247678 - DNA, 523 bp, Homo sapiens
tcacacttgtttcaggtgacttaaaccttttcttatgctaagttttttgcttgtcctattcaactatctaaggacaaaaaagcccacccagcatccagttcctatgtatcattacagttcagggctatccttatcaagctcatagctcataggaggctctggagggaaaacatgcagagaaaggtcagagacgtctgacactcttttggaccccatagggggacgccctgaggatcctccgaatctcaacctctccaaagggggtgctctcggcagaggttttgaggtctagtactaagccccccttagaattttctctccggtttgcaatactgtttagccccagtatagtttggaatctggagtttcctgttgaatgggaaagtgggatggcattgcatgtatccagcctttgttgctgctgttctaagcagggggcctggttaacatgtgacatgctccttgggtgctgtttggccccagtgttctttggaatctggagaggtttggtcttgaaaaatca

SEQ ID NO: 247679 - DNA, 483 bp, Homo sapiens
ggtccactgttgttaacatttttgctcacctaggtacacatagagagctattataatctgatgtaaacaaacgatgaggagctaacacacaatgtccatttattttttttccttttcaaagacacttctttgtcatcaaggttgggtgtgcttaggaattaaggtatatatataaagggaagcctactgattaatacttctgttttctccagaatcaccaggaaatacattaatgccttcaagaaagattaaatgggaaaaaggaatgtttggatggaaagaccgaatattataaagattttgtttcttcccaagttaaattgtagatataattcaatttcaatgaaaatcccaagagaggttataaaaaattacttataaagtatttgtaagtgaaaatagctttgaaaaatggaataattaaaatgaaaagcatgattaacaacaccaaatattttaaaatattataaagtgtgaataatt

SEQ ID NO: 247680 - DNA, 395 bp, Homo sapiens
ttggatgaagaaactatttgaagtttgaatattttctttcccctgctgtgtataatctcagtgatgttaggaatctgtctcattttgatcatgcatgtagttccatgcctacctagcacagtatacagcctcaataaatagttattcaatgactgaatgaagtgagtcatactgataaatgttcattaaggcataaagtttactataaaagaaaaaccagccaaataaatataaatattaattatccataatgtgctggactgttgtaattactacctcaatctagtttaaatttatttttataagaataaatttatattttaaaacatatagggaggctgaggcgggcagatcacgaggtcaggagatcgagaccatcctggctgacacggtga

SEQ ID NO: 247681 - DNA, 703 bp, Homo sapiens
tgagataaagggatatggaccgtctttactctgatttgggattgacgaagccaatccaggatggagggaaagaagaaaatgcccagcagcaagtattcctgaagcgtccaaactccatgcatgaaactttgcctacattattgagtaaaattagcctctgggagatgtttcatctgatggcctgcacatgatgatgtggccgacttcagggactacatgtccctgtatcagcaatttcgcctgctgttctgtgcctctctatcccacactccttattaaccactatcacctgatttgaacaatttaagttggtttcctagaactgtaatcagaagattgaaaaagactgaatccaataaaagtggaagtcaatgagagatctgagtacattctggcagggtctgcctcatggtggagtgacaaaaatgaattttttcaagtcttcgatataggtgaaaatgtgaggccttgctggaaggttttagggatagattttatgaagtgagatttcgtgggaaaactcaagtagagaaataatttgccagtatctttttcttaaaaaatcaaatgtgcacattttcacacacaactgatggaacatcaaagggaacatctcttctggagggcatttggtgatatatattagagttctttaaatacatataccctttgacatacaattttatgcttaaaaagtttccct

SEQ ID NO: 247682 - DNA, 488 bp, Homo sapiens
tctgcctgccatttctaaagcacccagtatggatgtacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccct

SEQ ID NO: 247683 - DNA, 491 bp, Homo sapiens
cataggaaagagccctgttggtttttcaccaagctttattagtattaaatatttagtaaactcttatgtctgtttcttactacgtggaaagaagtttgtgggtggaagtggggtgggagactttgagtgaatttcacagttgaaccttggcgaaattatttttataagccacaagtcattgaatatctggtttcatatgattcagcctaatatgttagcatggtttggtatcttagaaggcaaaggtgatacgcatttatggataccaattcgagctcggtaccttgttcatttaacatgtcagacatgctttagaatcatcttttgtacgtgaccatgaaatattctcagattatacattgaaatttatgttaattttggagagaaatatatgtataatactgaatattcccattcggaaacatggcatacttatgtattttcaggcccttcatctgtctttaataaaattttagtttttgtatagattt

SEQ ID NO: 247684 - DNA, 445 bp, Homo sapiens
gtatgttttgttcaacaatcgagagagtgaacttgtgaatgagtgaatgagccacctcgggacagagagagtgtccaggcaggttgtgtcatatttttttcttcacttggcttttccagtttctggatagagtgggtacttggtccctgctgtcagctggtggatggaagatcctgatgtggattgatcatgatttactttgaccttgggcttgttaacatttacttcataatggattgtaaatgtcaacaaaaaaggctttttcttctttgaaaggtggatttctttctttctttctttcttttttttagatgaagtctctcactcttgtcccccaggctgtagtgcaatggcatgatcttggctcactgcagcctccacctcctgggctcaagggattctcctgccttagcctcctgagtagctgggattacaggcgcccgcc

SEQ ID NO: 247685 - DNA, 169 bp, Homo sapiens
taaaatactacttatgtagtatcactatcactactactactactaacaataatagctaaattattttgagtaactaaaatgtattaggtcttgcattattttatcccattcagtgtctatgctggaggtcgttcataccagcttgcaaaggtcaatagttcaattttcc

SEQ ID NO: 247686 - DNA, 206 bp, Homo sapiens
gggttctacctttcatattggatcttactcaaccagcattaaacatgttcaagccactcactcaatcctcagaatacaattctgttaaattctctggtgaacccctgcactgtctcccaggatctgtcgtgtgtcattcataactaaatgtgttgtaagaaatgttgacatttgccatcttccttttctcatctttcatacacttt

SEQ ID NO: 247687 - DNA, 420 bp, Homo sapiens
tggtagaaaatattcgcaatctatctatctgacaagggattactaaccagaatatataagaaggtcaaataactcaaagagaaaaaaatgtaataatctgatttaaaaatgggcaaaaggaaatgtcaacaggcttttctcaaaagaatacaaattgcaaacagacatataaaaacatgctcaatagaaatgcaaatcaaaactacaatgagataacaccagttaagatggcttttatgcaaaagccaggcaataacaaatgctggtgagaatgcagagaaaaggtaacccttgtacactgttggtggaaatgtaaattagtacagccactatgcagaacagtatggaggttcctcagaaaactagaaataaaactaccagcaatgccactgctaggctgataggtacatagcaaaaaaa

SEQ ID NO: 247688 - DNA, 523 bp, Homo sapiens
tcttgcctccgatgtgttcttcccagcatggccagagaacaatgtctttaaaataaacatattttaatgccattgctcctgcttaaaaaccccaagtgtcttcctgtttctcttaggataaagaccaaacccagagaaccataagcctggccccgcaccactctcgcttcttattttgctctaccgcattttctcctggagagggcctcctggatgccccagggcccttgaatttgctgtttctcttttctcttctccttacctggttaattccagtggattgatccctcagatctgagagatggaggggacgtcatcccttccttgggaccttttcctgtgctcgccttcctgtgagctcacataacacacagacctctccaagccacgcatgtggtcgcaacttcgcactcgctgccctggttgtttgactttggttgtgtttgtttttagtcttggcccgctgttgtgctcattcctctcccatacttatcttaaaatactcatcttggacaagtgatta

SEQ ID NO: 247689 - DNA, 1084 bp, Homo sapiens
ctgttactgctgattaatatcttgctaatcataggttatggagactgcgtttctgttttaaggctctgttagaaattactgatgcacactattgtaaattcttatctctgtatactgtacttctgcatacagatgttatgttaaagaattacttcatccccatgtgaccatctcacctcataatcaaatgaccctaaatccctcactaacctacccccgccctcattaaacttaataataaatgctggtatatccagtgcattgttggcaccgcgggaccagaaggtggtgacccccctggacccagctttcactatcttgtgtgtgtctattatttctcaacctgccgatccgcctgggaacaaagagagagccccgttgcattgcaggctactggccagatcccgcaataaggtatgttctctaagatctgaaacaagatagaaatgctcacctttaccacaaaaaaaagggcgtccaaattgaaaaagaagtcaaattctgcagaagacatgatcttatatacttaataacctaaagactccaccaaaaaaccgttagaactgaaaaatgaattcagtaatgttgcaggatacaaaatcaacatatcaaaatcataacatttaatatacactaacagcaaataacctgaaaaaagaaatcaaggaaagcaatcacacttaagaagctacaaagaatagaaaatagctacaaagtatagaaaatacctaggaatcaagttaaccaaagaagtgaaagatgtatatgaggaaaactatgaaaaactgatgaaagaagtagaagatgacacacaaaaaaggggaagatattccatgctcatggattagaataattaaaatgacaatactactcaaagcaatttatagattcaatatgatctctatcaaaatgccaatgacattcttcatagaaataggaaaaaaatcctaaatgtatgtagaaccacaaaagaccctgagtagccaaaggaattctgagcaaaaagacaaagctggagacatatattacctgacttaaattttctacaaacctatagtaaccaaatcagcatagtactggcata

SEQ ID NO: 247690 - DNA, 1074 bp, Homo sapiens
ctgttactgctgattaatatcttgctaatcataggttatggagactgcgtttctgttttaaggctctgttagaaattactgatgcacactattgtaaattcttatctctgtatactgtacttctgcatacagatgttatgttaaagaattacttcatccccatgtgaccatctcacctcataatcaaatgaccctaaatccctcactaacctacccccgccctcattaaacttaataataaatgctggtatatccagtgcattgttggcaccgcgggaccagaaggtggtgacccccctggacccagctttcactatcttgtgtgtgtctattatttctcaacctgccgatccgcctgggaacaaagagagagccccgttgcattgcaggctactggccagatcccgcaataaggtatgttctctaagatctgaaacaagatagaaatgctcacctttaccacaaaaaaaagggcgtccaaattgaaaaagaagtcaaattctgcagaagacatgatcttatatacttaataacctaaagactccaccaaaaaaccgttagaactgaaaaatgaattcagtaatgttgcaggatacaaaatcaacatatcaaaatcataacatttaatatacactaacagcaaataacctgaaaaaagaaatcaaggaaagcaatcacacttaagaagctacaaagaatagaaaatagctacaaagtatagaaaatacctaggaatcaagttaaccaaagaagtgaaagatgtatatgaggaaaactatgaaaaactgatgaaagaagtagaagatgacacacaaaaaaggggaagatattccatgctcatggattagaataattaaaatgacaatactactcaaagcaatttatagattcaatatgatctctatcaaaatgccaatgacattcttcatagaaataggaaaaaaatcctaaatgtatgtagaaccacaaaagaccctgagtagccaaaggaattctgagcaaaaagacaaagctggagacatatattacctgactttttcttcacacctttggacccctagcttgtcctggctt

SEQ ID NO: 247691 - DNA, 1132 bp, Homo sapiens
ctgttactgctgattaatatcttgctaatcataggttatggagactgcgtttctgttttaaggctctgttagaaattactgatgcacactattgtaaattcttatctctgtatactgtacttctgcatacagatgttatgttaaagaattacttcatccccatgtgaccatctcacctcataatcaaatgaccctaaatccctcactaacctacccccgccctcattaaacttaataataaatgctggtatatccagtgcattgttggcaccgcgggaccagaaggtggtgacccccctggacccagctttcactatcttgtgtgtgtctattatttctcaacctgccgatccgcctgggaacaaagagagagccccgttgcattgcaggctactggccagatcccgcaataaggtatgttctctaagatctgaaacaagatagaaatgctcacctttaccacctttattcaacatagtgctggaaatcctggcaagagcaattaagcaagaaaaaaaagggcgtccaaattgaaaaagaagtcaaattctgcagaagacatgatcttatatacttaataacctaaagactccaccaaaaaaccgttagaactgaaaaatgaattcagtaatgttgcaggatacaaaatcaacatatcaaaatcataacatttaatatacactaacagcaaataacctgaaaaaagaaatcaaggaaagcaatcacacttaagaagctacaaagaatagaaaatagctacaaagtatagaaaatacctaggaatcaagttaaccaaagaagtgaaagatgtatatgaggaaaactatgaaaaactgatgaaagaagtagaagatgacacacaaaaaaggggaagatattccatgctcatggattagaataattaaaatgacaatactactcaaagcaatttatagattcaatatgatctctatcaaaatgccaatgacattcttcatagaaataggaaaaaaatcctaaatgtatgtagaaccacaaaagaccctgagtagccaaaggaattctgagcaaaaagacaaagctggagacatatattacctgacttaaattttctacaaacctatagtaaccaaatcagcatagtactggcata

SEQ ID NO: 247692 - DNA, 472 bp, Homo sapiens
aggctgacccagctgagaatactccctagagaagatgtggcaagcctcaggaggtctggccactcttggagtgcttaacctgaagcctgagagcagcactgagggtgggggaggctgccccctcttaaagctgccttttcagaaagcaaagtgatgcagcggtgtgagcacactctgagggcctgtcacaggagctagctggttaatggccaagtggtcagttcactggaagccttcttttcctgcctgtggctacaagattaggggcttggaagacccagaggaaggtctaatgaggagaaaaaaggaaagagatcaattcagatctccttcattcctttggaccgtatacaaaaccccagaataaaaccagaaacaaacataaaccataacctattcatttctgtatccctgaaagttttgacaaagctttgaatcatcaaatttcagaccaataaaccattgctgattt

SEQ ID NO: 247693 - DNA, 460 bp, Homo sapiens
  misc_feature (412)..(412): n is a, c, g, or t
gcctacgctgactccatgtaacctgctgaatgggaagtactatgtctctgcagtttctgatgggaacagggctggttttcaggaagagctcactgagcatatgatcctccaaggaaaccaagtaaccaagtctcctcaggcttcaccttccctgtctgtgaaccaaggatctggagggaatccttccactgcagcactccagtggcctatgaaatatctgttcccgacctcaagtatgtccttgattgccttctggttaagaaaagctgatagtgtttcaagagccaccaacatggtcagtcagctctttaaccactcaaaattcttctttcaaccacagctggattacagttactctgaacatgtttgaaatcactttttcctttttttttttttttttttaacgggcaancaagctgggggatcctcaaaagtcaaccggaaggcttgaaagttggga

SEQ ID NO: 247694 - DNA, 443 bp, Homo sapiens
tctcctcgggccgctgtgtgcctggctcacgaagtgtcagctgagcagggaaatccaggcatgacgccgctaaaatctattcctgatgcgcactgcagcgcggtgcttcagctctgagaacatcacactaagtgaaagagccaagaggccgcatacggtctggtcccattttatggaatgtccacgataacaaatccacagagacagagtggatttggggtcaccatggggagggtgtggagaagacagtgacagctcctggggccgggattcactgcgaggttgatgatgtgctctggagttaggtggaggcgctggttgcagaacgttgtcagtgtactaaataccactgaattgtgcactttaaaatggtgaaaatagtaaattttatgttctgtttatcacaaatttttaaaagatcttaacattcttaaaaaaaaaaa

SEQ ID NO: 247695 - DNA, 821 bp, Homo sapiens
taatgtgttctgctacctccatatgggggcccacctctttataacgtggtcagattctatttgtattatcactcttatcttcttgtctctcccttagggatcccaaagctagaccccgctgttcaataattgaccaaaagtttttctctacttatagtattttttctaaattagattacagtctagcacctgcagtgaaaatgggcaatcgaaggataaggaatgaaggtaaattccagtataaaggaagaactaaagaaaaaaaaacatagtaaatgtttaactttaaagtggcataacattgtgaccttgtgttccttagttcaaagaaagaagactaaaataactacagcaaatagcagtgctaattcacttggttatcctttcttcttggaagtactaccgttttggtctgtttccatagtttcaattacatagaaaactaaagggaagacctgctcaattgaaaatatccagataaaatgaaattttcttctgtctacctaagctatatagttcttactttcaaggaaatgctaaagttggatgctttttacacttcctttcatcaattcaccacgcatgcatgtcttttttgtggagactttaaaaatgtatacaaataaaattttactctgagactgatgatgtttatcaagtattagaaactgatatggaaagaacaagcaaaatacacagaattcagaggaggggagacgttcgcttaggaatgaaggcaagctgtttaactgggtgtagactcagggaggtagggacaagggcattccagacattgggagcaacaagcaagatcatgattc

SEQ ID NO: 247696 - DNA, 720 bp, Homo sapiens
agtttagttaagggatatgctttcaaatgcagtcacacgtcacttagtgacaaggatatttctgagaaatgtgtcgttaggtgatttcatggttgtgcacacattaacatgaagttggaaaaatggtgcagttagattgcttgatgcagggttgccacaaatctgttcacttcatatctctatgtcatattttggtaattctcacggtatttcatactttgcattactattatatctgttttggtgatctgtgatcagtgatctttgatgttattttgtaattgttttggagttgtatgaactacacccatttaagatggtgaacttaattggtcagtgttgtgtgtgtcctgattgctccactgaacagctgttccccatctctctccctcttctcaaatgtctcattccctgagacacaacaatattggaattaggctaattaataaccccacaatgccctctgtctaaatgaagggaagagttgcctgtctcttactttaaatagaaagctagaaatgattaagcttagtgaggaagggatgtcatgaaagctgagataggctgaaagctaggcctcttgtgccaaacagccaagttgtgaatgtaaaggaaatgttcttaaacgaagtttaaagtgctatgttagccaacacacaaatgataagaaagcaaaacagccttttgctaacagggagaaagtttgaatattctggatag

SEQ ID NO: 247697 - DNA, 486 bp, Homo sapiens
agtttagttaagggatatgctttcaaatgcagtcacacgtcacttagtgacaaggatatttctgagaaatgtgtcgttaggtgatttcatggttgtgcacacattaacatgaagttggaaaaatggtgcagttagattgcttgatgcagggttgccacaaatctgttcacttcatatctctatgtcatattttggtaattctcacggtatttcatactttgcattactattatatctgttttggtgatctgtgatcagtgatctttgatgttattttgtaattgttttggagttgtatgaactacacccatttaagatggtgaacttaattggtcagtgttgtgtgtgtcctgattgctccactgaacagctgttccccatctctctccctcttctcaaatgtctcattccctgagacacaacaatattggaaaaaggcctcagttttaattattttcttcccaaaataaatcacacatttggtta

SEQ ID NO: 247698 - DNA, 841 bp, Homo sapiens
gcaactttgatgcatgtacaaaatagagtcagccaaatttgggatttttgcaaggggttaagatggaaagacagtaggcaaggaagttgatactattggtaagaaagtggttggtgtgacaaagaatagaacctaagtttaataaggaagagagaaagagagctatagaaaaaggggactagagatccctatgaagtcaaggaactgaaatcttgagaatagttgactaagagatctgaagacataggatatttggtctgagagttgttttaaagtggggagtgattcttgtattgataagtttctgagtgtggctattggagtgctatgctgacatggaagtcaagaaagagaggctgtagcgtaggatggggcaaccacatggatgtaaagtcatcttggataatagtgaaacttgagatagaaggaaagactgtgaatcaaatgctaaaatcttggagagaggcaaacatagtaagcaacagaaaggaagagggattggaaggtattatagctagatggcatgtatatcaaaggaactgatttttaaaaaacttctcaccgggcgcggtggctcacacctgtaatcccagcaatttgggaggctgaggcgggcggatcacaaggtcaggagatcaagaccatcctgactaacacggtgaaaccccgtctctacttaaaaaaatacaaaaaattagccaggcttggtggcatgtgcctgtggtcccagctactagggaggctgaggcaggagaatcacttgaacctgcgaggcggaggttgcagtgagccgagatcgcaccactgcactccagcctgggcgacagagcgagactccatc

SEQ ID NO: 247699 - DNA, 354 bp, Homo sapiens
catgcttgagcccactagcccaatccctgagatcttatcgggaagctgctgctcctccacagctccaggagtttcctatttattgggagactgtcggtccctagtaccagctgtgaccaattataatttcagagacacagtttaacaaccacctgaccattacctgatggtcccctgaagttctctggggttgggagaggctctcctgcctggctcatgtctgcctaactacctactctaacattatgacttggagaaatacttattggggacttttaaaaaactgcagagtatcataagacttttggctatgaggatttaccagttgcagaataaagaattttaaaataattt

SEQ ID NO: 247700 - DNA, 410 bp, Homo sapiens
gacccactgtaagaaagagcgatagaggaagactgatgccagcaccagagtgagccagtgaaggacaagagaagctccgcagcagttttctataacaaatagatttgtcaggcaaggcagctggaccaagggatatggttcatctttttttcagagaaacagtggcagcaggggtccaagaagcagcaaattaacttgaggtgagtgccctcctataacggacagtctagaatgtataccgcttggtgatttagtatgacaagtaggtgtaaattacttgaggaattagtctaatactagcaggactctggccatagggatagggttaaataaataactcgagagttttatgtgctaaaaacaatagacaaacaatatccctccatcctccccgctggaaaaaaaaaaaa

SEQ ID NO: 247701 - DNA, 362 bp, Homo sapiens
tgtactctaaatgcagtctaatcaatgaatggagtagaagcaccccttactccaatttagcctaaggttattcaaaaccacaaatcttttagaactgaactattgataaataggtgagggtttctcaaatcccttccacacaaagctgactttctaagtctcaatgcagaatacatattctattaatatttatctaattatttttcaaacatatctctgccatccactatattaactatttctctcagattcgaaccatttgccaatggaatagacacaacctctattcagccatgggtgagaacattaaatgcaacaatgctgaggacaaaggagggacagtgcaattccatgagagacat

SEQ ID NO: 247702 - DNA, 413 bp, Homo sapiens
tcatgctgggcctggaacatgttcttttcctctctggaatcctcctcttttgtcttccctctccacctagatggattttccgttccctgcctcacttggaacaatgttccttcggttccatgtgtctcaaccaaaatgtcctgtcctaaggagcatgccttccaggcaccatgtccagaacccccaactgccaatgggttggctttccctaacctgttaggattcctaacacaccctatacaatactttccttccaggagctcacctcccacctgtaatgatttatgtcatgtctctttcccctccaggctataggttccaccagggcagggagagtgtttggctgggtcaattccccaacactttgtatacagcaggtgcacaataaactattagaaagtttcaggagcctt

SEQ ID NO: 247703 - DNA, 341 bp, Homo sapiens
cagcataaagaaaatgtagcttttcatgtgcttggattagctgtatacgcaaattagatgctgatgaactttctagaagtcagttttccctatggataggaacatctacctggctacatctgtgctagatatttggagagaagcattcagaatgaaagctatattttccgagctaatatttgcatgaatattgagatgtcgttccctttttgaagtaaatattgacctcagtttcacctttatttctgtgttctgatcaacacacaccaataactgctgatgactggatgttcatcctggtggaatctgctggaaccaataaaaaatgcctagctgctgtt

SEQ ID NO: 247704 - DNA, 447 bp, Homo sapiens
tcctgcagtagaatctggaatgggcttgtgacccagctcaggccagtgaaacatgaaggaaggcttggcggagaattctgaagaaggagcttctcagcttttaagagaagctcaccataggaaactccctctctccctctggacttgttggtttaaagacgcaaaacctggagctgctacagacatttttcaccactgcaagtgaagacttctgccccatagacagcgactggaagctggatcaggccaaccctgaagatcactctgtctctggatgtcggttacacaaatcaatacatttccatgtgttaaagcaattcgacttggattttacatatatttttgaaactgaaaacattgtaatctatatatctacttagaaagatgtgaaatatccacctaataataatcatttggggttactaataaaaattatttttacttttc

SEQ ID NO: 247705 - DNA, 430 bp, Homo sapiens
ctatttatagctccaacagcatcagaaagaaaaacacatgcctagtggctaaagcattcaaacacaaccccttataaaaaagttaaagtttgggttaattaaaaaaaattaatttcatattaaatatatatttttaggttccaatttacagttatgtagttatatattatcgcaataaaaagatctgcccatggactggtttttggttttgagacatgtttaaattacatcccttacagagtgctcaacttgtatgggggtaaatgactaacatgatgttatctacaaggttaaaaagcaagaataaagaactaactacattttaggtcagttcttcatcagagaaggaatgttaaaaatttatttccatccaatttattttctaaatattattaattttcttaaataaaacatttcctgaacggcaaat

SEQ ID NO: 247706 - DNA, 434 bp, Homo sapiens
acgaggaccattctgatgttggagctgcccgtggtcacacactcagcaaagtcctgaaagcctcagcgcactggggtcagctggccatgggggtgtgtgggaggtgccacagcaagcccctcctgaccctaggcgtccctccttctgacagcagaggaaaggagagccttgggctggtttcagggctgggtgcagcctgggctacacatatttttgagaggagatttgggggcacagctggggactccttaagccaccatctctctcctttgtgagcctgagtacatggaagaccctaccgactacagctcacctttcggattaggggttatttacttccaggtcattatttttaaacttttcaaattagaatataatacttggtatagatttcaaaaatcaaacttcatagaattaaaagtgaaaagtcatca

SEQ ID NO: 247707 - DNA, 546 bp, Homo sapiens
agccagtcggaaaaggctacgtagtgaatgaccccaactatgacattctgaaaaaggcaaaactatggagacaggataaagatcagtggttgccagtgaggcaggagaatagggtctgggggcagggagcctaaggctgattcatgctgacttcatgaacggaatcaaaaggaaaaccctaaatttccatgcccacgtaacaaaaggatcagaggctactccctttgcaactccccccaactttctgtgttgcagatgaaaaatggaaagtgcctcggattggtcccctcctgcaaccagtcagacatctgcatagagcgtaactttgtaacttcacttcagcctctgcttggtcaccttccacaaccaatcagactggtcatgggccactatttcatagggtgtaaaccaagtgaccaatgggaaacatctagagggtatttaaaccccagaaaattctgcgaccagtgcttttgagccttgcttgggcctgctcccactctgtgaagtgcatttttgtttcaatacagctatgcttttgttgct

SEQ ID NO: 247708 - DNA, 390 bp, Homo sapiens
tcttcttcagtttaaaagtatgaatgacatttgccagtcctccaacttttggcacatctttcattttccaagagtactcaaagatatctgacggggcggaacattagtgatctctgttgcaaggactcataatatctagagctgtgattgcgagactgtgtttaatttcaccttcagcctcttgtctgattctttccaggcatctgctgttggggccaggacttcttctttttccaagttgttacattgcatgtacaaaagaaaagttcagctgggtggggtggctcacatctgtaatgtcagcactttgggaggctgaggtgggaggatcacgaggtcaggagttcgagaccagcctggccaacatggtgaaacccatctctaccttaa

SEQ ID NO: 247709 - DNA, 566 bp, Homo sapiens
aactgccaccaactgcttctggtgtcaatactataggaggtaaacagttatgggtccccttctccagaaaggccctgtgctgtgtccataagagcaggttaagaataagaaagagattttttaccttaataaaactgggccagaagaaacagtcagggtcaacgtcatcttccctcaggacacaaatggaagaatttttctttcacgagaggtggaaaataataccaaagcaaccaaacccattagcaccattccatcctatatgagaccttgcttggctatatgatttgtggaattgcatttgtctatttgtcagtgaatctgtaatccattgttgttttctgctctgtgttttttatttcctcagaggcccctgcaaataagcagcagggccaggggctggttgggggaggaagctggggtatttacatggtaacaggaaaaagcagaaaaaaaagatccacaaagtgtgcctattcctctccccccgccaaatggaacaccagtcctcaatgttaataaagtattgcttctttaaatattttaataaatggataaacataatc

SEQ ID NO: 247710 - DNA, 709 bp, Homo sapiens
taccctgtcctcccactctgagtcagaatgatattgactgaaaccactagtatttggggctagagtcagctcatggagcacagttgatagatgacaaggcccaggagcaggtgtggcttgctcaatccctcagttacctcctaaattgctaagttaccagtagtttcccaaaaaggaagatagcttgccaagcacctgttcttgcatatgctcacttggaaacaaagcaagaagtgatgcctcaagggagttgtcttagctctgggagtgtgagctcctttaaggactttgttaaccacttgcagtaattaatacaattgcttgggtggtgggaccaaacaccaaatatccatctcaattatgttcagacatcattacaaacccattagcaccattccatcctatatgagaccttgcttggctatatgatttgtggaattgcatttgtctatttgtcagtgaatctgtaatccattgttgttttctgctctgtgttttttatttcctcagaggcccctgcaaataagcagcagggccaggggctggttgggggaggaagctggggtatttacatggtaacaggaaaaagcagaaaaaaaagatccacaaagtgtgcctattcctctccccccgccaaatggaacaccagtcctcaatgttaataaagtattgcttctttaaatattttaataaatggataaacataatc

SEQ ID NO: 247711 - DNA, 659 bp, Homo sapiens
cccggtaccgcaccagatgctgccctacatgaacgtgggcacgctgtcgcgcaccgagctgcagcttctcaaccagctgcactgtcggcggaagcggcggcaccgcaccatcttcactgacgagcagctcgaagctctcgagaacctcttccaggagaccaagtacccggacgtgggcacgcgcgagcagctggcccggaaagtgcacctccgcgaggagaaagtggaggtctggtttaagaaccgccgcgccaaatggaggcggcagaagcggtcctcatcagaggagtcggagaacgcggagaagtggaacaagacgtcgtcgtcgaaggcgtcaccggagaagagggaagaggaaggtaaaagcgatttggactcggacagctgacggccgcgggacacttgcccgtattacttacctaactcgaaggacttgcacagacagacgatgctactttcttgcacacgcgctgccttgcgggagggggtcgagaaagaggaacgaggagctgtaaatagtgtacagagccgggagggtcggcgtctggggtcagggcgcgcacagcccagcagcccgaggccgcccgcgactagcccccaccgtagtatttatagttaaattaagggtgacagtacaataaagtgatggcgatgtagac

SEQ ID NO: 247712 - DNA, 336 bp, Homo sapiens
aggcatagaaagacctttgaactagcagaacatatttctttgagggacttaggaacttcattctggttaatggctttgtttggtagaacatacccttcatcttctttctgaataagaattcatggcatgaacacgaggacaggagcaacagacactgggtctacttgagagtggggggcgcgaggagtgagaggagcagaaaaaaataactgttgggtactaggcttaatacctgggtgatgaaataatctgtacaacaaactctcatgacatgagattatgtatataacaaactctcacatgtagctcgaacctaaaataaaggtttaaaaaata

SEQ ID NO: 247713 - DNA, 318 bp, Homo sapiens
caaagacagggaccattctgaatgggagctggagccaggagtgagaaacccagcatatttggagcagaaaaggaaggctgtcttgcattggatcaaagaggctttgtgacgttggttcacatttgttactctctgggcacgtcggcatctctgggtgttctgggctggcttaaggaatctcaaatcagagtagacaaatgtagtggtttccttcattacgtctctaaaaatcatgcagcctctgctttcacacttccagtaacaaaatcacaactttttctcctttgtgaggaaggtgtttgttacattgaccccaaa

SEQ ID NO: 247714 - DNA, 482 bp, Homo sapiens
ggcacaggaaactctgggtggtttggctccagctcttgaaaacaagttccttgtttgccctcctgagttgatggtctggtggagaatttgtctgaaggaatttgttccaggaaaggtccagctgcatttgacaggaaagggagaaaagagagaacgaggcataaatctctggccttctgcctcttgcttgggaatctgtcctttccagcctgcacccacacccttggagcccaaaaccatgccatgcacatgtaaccaaccagctacatgtgaagatcacataaaggtgttcttgtcctggctctagctaaggttccagctctcagtcagcatcaattgtggaagatgggagtgcatgagcttttagatgatttcagtcccctgcctttgacaccaagtggaactgagatgatctttccaccgagccctagtcaaactgcagattcatgagcaaaataaacaccatcattactgaagcaaca

SEQ ID NO: 247715 - DNA, 421 bp, Homo sapiens
ttaactgacaagtgacttggaggtttaggttgaggagtggaagttacagagctaaacttccttacttgaacttgtactggatctagcaatggagtcagtaattatattgtaactttttgaagttttgatttagataagtctgtgcaactgtgagaatcagaattttcaatgtttgagaatttaagaggcatatttacttagtcaagtaaaggtagaaatgagccaatcatttataaatgtattctgcaaagataattaagttgggttattatggtacagttttgcttttagtttagactagctccttatttaatcaaagatactcctgttataaaagttcagtagttagaaattgcctctcagaatccattttaattcctaatctcctcttacatgttctaattgcagaccaattttaaat

SEQ ID NO: 247716 - DNA, 373 bp, Homo sapiens
gtcaaggaagaaaatttaaagagtcaaaggatcataactcttctcctctacagtaaaaatggcattgttgatgatttaagaactttggatggtgctattcagcccagataattataaagaataccccattgtggaatattattccataggtctgtaaattttctgtcacttttcctatttcagctcatcttacgcatcaaacaactcaccctgtctataaaatggaagatatgccgtataacagttatatcaaaaaagatcttttatgtgtaatcacttcataaagtgctgtttgaacataaggtattagtagttattttagcctatcacatgaatagtgcatccagactccaagatttagagatttagagtc

SEQ ID NO: 247717 - DNA, 724 bp, Homo sapiens
tccaccacctgggttcaagattctcctgcctcagcctcctgagtagctgggattacaggcgcctgccaccatgcccggctaatgtttgtattttcagtagagatggggtttcaccatgctgcccaggctggtcttgaactcctgacctcaagaggtccacccacctcggcctccctaagtgttgggattacatgcgtgagccactgcacctggcgatttctttctcatttaagagatggagtcttctgttgcccaagatggaatgcagtggtgtgattataactaggaccacaggtatgtgtcacaataccggctttttttttttttgagatggattcccactctgtcacccagactggagtgcagtggcgcaatctgggctcactgcaacctccacctcccaagttcaagcgattctcctgcctcagcctcccgagtagctgggattacaggcgctcgccaccacgcctggctaatttttgtatttttagtagagatgaggtttcaccatgttggccaggctggtctcaaactcctgacctcaggtgatccacccaccttggcctccaaagtgctgtgattacaggcatgagccaccgtgcccagccctggctaatttttttttttgtagagacagccaggctatgctgcccaggctggtctcaaactcctggtcttaacatgctccttccttagcctcctgaggtgctgagattataggcct

SEQ ID NO: 247718 - DNA, 352 bp, Homo sapiens
ttgacttgaaattgttactaaatcaagtaacttgtgaaaagagggtagaatttttagtgtcttagatttaaattaaaagtttttagaatatgaagactggccaaaccagtgattttaaagaagatagaccttcacgtttcaggtaagaatattgtaaaaccttttaaattttttaagaagaaaattgttcattttgtggcttagattttaaaaattttagaaagtataggctgggtgcagtaactcatgcttgtaatccaagcactttgggaggctgaggcaggcagattgcttgagccatgcgatcgagaccaggctgggcaatacggcgaaaccctcactctgcaaaaaa

SEQ ID NO: 247719 - DNA, 455 bp, Homo sapiens
cagcccccaggtcacatcactcatggaagggacctctcaagttcatggatttggaaagcctggcctgcaaagggctccagctgacactagcttgaggcagcatcgtgagtcagtgaggtgggcacctggacccgagtctctgtcctccaggcccaggctacaagagcgaaggctctgggctctcccagcttcatccctgggcagggggcagggctgctttggcctttgctgggctgttgagaatgagggcaactttccctgtgaggacacccggctggccaacttgcccacccactcatctcagggcctgtccccctatgattccgaaggctgggcactgagaaacaggcacacagggggctgtgctggacgtgaacgcctgacccctggactcacctgtccagacccacattgaggtaccagttctgtaagttgctcaaagcaaaatagttgct

SEQ ID NO: 247720 - DNA, 689 bp, Homo sapiens
gagcaacttgctatgttttccaggctggtctgggactcctggcctcaagccatctccctgcctccacttcccgaagttctgggatcacaagtgtgagcccctgcacctggcttaactttcaagaaagtgtttctttcctcccttccttccttcattcagatggggtctcactctgttgcccaggctagagtgcagtggcactattacagctcgctgaagcctcaactccccaggctcaagcaatcctcccacctcagcctcctgagtgagtagctgaggctgcacgtgtgtgccacaacaaccagctaataagaaagcgtttccaactgtttttttgtcttccactcatgccttgcaggagatccatagaattcctcttactaatgtcacttaagagtgagaaatataagtcccggagaggttaaacaacttgcctaagaacagggaggatgatagtagcagaaggagttgctccattctttctggaatccattaaccaaaagaaaatccatgttctttaatcatgtcacataacaaggagtttgttgcccatagataagagggagaaaggtggtaaacataacaggacaaatatttaaaatggcagaagaaaaattagggttttagaaacaagaagaaaagggctaaatcggcattttaaaaataaatggtcttagactgctgcacca

SEQ ID NO: 247721 - DNA, 602 bp, Homo sapiens
acaaattacatttttaatagtagtatcgtgagaaattgtggggttttttttgtctacttctgttattcttttgtaactcgtgtcttttgattctttgttttgtctccttatgtacttcattaatcttcttgaatttttccctaatcccaaactactagaactgtccaaggccaggaggaattggaaagaagatggtttcttgaaatctctcttccatacttctttggtcttttgcagcagacagtaacttattgggccactcttcagtattcatcagtttatttccattgaagaacttcagactccttcaagttcaaaaaagctgtgaacttgaagaaggattagtattgaagccgttgctcttataacttactagttgtgtgaccttgggcaaatttcacattcagatcctcaattttctcatccctaaatggagaatgatactgcctacctcagaggtttagttcttgtggttggtaacttacctatataaattataaggttaaatgaaatgaactctttccatacgttcgttaacattaagaattgagcactttatccaagttgtattttgtgaagaagtgagaaagaaataaaatagt

SEQ ID NO: 247722 - DNA, 407 bp, Homo sapiens
gggaaattcctccccacaagcagatgacatcctagatatggacagctctatcaagatgatagatcaagacttctctgctattaacacttctcttaatttttcattacttatgctaggcacgataatcccataattataatttcacaatcagtagctactatgattagcttaatgtagtgttccatctgtaatgccaaacctgtatctttacattttctatgggatcttttagttcacccagtggttaactttagcaatatctctaaagtaaccattgttcaaattgtatttgtggtaagatttataaacccacttgttctcactcctgtttgaatttaaccctgtaatggaacacaaaaagcagggccaaaaagaatataataaaaaaggttttcactaaaagccca

SEQ ID NO: 247723 - DNA, 444 bp, Homo sapiens
tcagagcagcatgttgaaaaagacatcacaattcaattaaaatcttcctcctttgaacactcccagaggggcaaggccacttggaatttgtgagaaatctaatttatagacacagtatcaggaaatagaattgttaacaatgaacaactgtgtgtcatagggatcaagcagcaggcatggagccaggattatctaggttctaccctcttcagcaagccatcgaacctctctgagcctcagtttcctcatctgtaaaatggagatcacagccatcagttggtgttctgggaataatagagattgtgcatgtaaaccaggtatggtggctcccacctttaatcccagcaccttgggaggctgaggcagggggatcacttgagctcaggagttcaaaaccaggctgggtaatataatgagacccctatctctattaaaaaaaaaaaa

SEQ ID NO: 247724 - DNA, 221 bp, Homo sapiens
cagcgttaagattctctgtttccctgtaacatcggagagacgagcaactctatttacatttagtgcgtgtgcatctagtgacttcggtagacatctgccaatcaaatacacgtcattctgcaaaaccacctagacgcctccatgcccttttcttactggacgatagagttgtttagataagtaaatgctttgaaataaatttggtggcttttagcaagaag

SEQ ID NO: 247725 - DNA, 694 bp, Homo sapiens
gaaactgtgcaaagttatgtgcgtgaaaaaccttcaggatggagagaatcagctgcctaccttgaactaccttgaataaggctgcctttgctctaagaaaacctgaaaagtcttcaactaaaagctgaaaagtcttcaactattacgtgaggatctgcaattggggtctatgctgtagtgactcaagatcactgatagaacttaaagtctaatttttttttcagttaggtgcatcccgatacagaaatagtgaagagtattttagctaggacccaaaattgccaaggttcttggaacttcacaaaggtcaaagcttgaactgtgtctgaagagggtatcagaatgtatctttattcagtaccatagactaagaaagaaaaacaactttatttgtacgttatatgaggaatcctcctcatgatctcacatttgttatcttagttccgtttcctcaacaatgctgtgacccagtgtggattcccatggatcttattgaaaatgcttattaaaactgctacttgacagaaactttataattttagactaatttctctccatcccctctgaataaaaattcacatggtcattgaatttttatgtgacaataatgcatatatatatatacgtataaatatatataatactcaaattctttgatgctttgtgtggcttggaataaatgttaatattacag

SEQ ID NO: 247726 - DNA, 443 bp, Homo sapiens
cccaaagaatgaggaatgttttgtgatacagagaagttttggaaattaaagaagaagctggatgcccagcttaatttatccccagaagatactgccttccgtaatgaagatacagccttccctggtgaagatacagccttctctgaggaagatacagccttccctgatgaagacatagccttccctggtaaagatacacccttctctgaggaagctacagccttctctgaggaagatacagccttccctgatgaagacacagccttccctgaggaagatacagccttccctgatgaagtgctagcctcattcaggtgactctttggtagatcggaattatattttctcacaccccatcagcatctgacaatggatgcttaacaacctggcaaatcaacaaccgattaacccatctggattaatgaggccctaaaatgctttaa

SEQ ID NO: 247727 - DNA, 544 bp, Homo sapiens
ggaagctgtatgttggtctttcccatggtggacactggaactaaagctgcaaccaaaaacatggggtgatttcagacttttcccaggaatggatattaaattttatgagatgattttagagcatctgccggatgattatgttgtttttttctttgacctattactgatggacaatattaataaatgtgctactaataagtgaatattatattccaagaataaaatctgcacaatatagtctaaacattatcttgtaatatactactgtatgattttcattggtttagtaaagacttttatatctatctctaaaatgtcattctgggaattataacttggacatcaagttccttacactctggttgccctttattggttatccttcttttttctttttaatgggccaatcaagcacactatgtaactaagatgaaagctctttaagagcacaggtctttgttttatttgctgatttatttactaagatcctagaagtatgcctgatacattattcgtattcaataaatactttttgattggttaa

SEQ ID NO: 247728 - DNA, 237 bp, Homo sapiens
aaagctgaggccaaagagagagaaaaagatttgaagacactacactgctggctttgaagatggagaaaggagccaggaaccaaggactgctgcagcctctagaagctagaacatgtaaggaggtggagtcttccccagaacctccaaatggaaagtagccctgtctactaccttgatttcaggacttctgacctccagaactgtaagataataaatgtgtgctatttcaatctacta

SEQ ID NO: 247729 - DNA, 325 bp, Homo sapiens
cattgtagggaatttgaggaatacattaaaaaaatgttgagagggctaagcgcagtggctcacgcctgatatcccagaactttgggaggccaaggtgggcggatcacctgaggtcaggagtttgagaccagcctggccaatgtggcaaaaccctgcctctactaaaaatacaaaaatgagctgggcatcatggcaggtgcttgtaatcccagttactcaggaggctgaggtgggagaatagcttgagcccaggaggtggagtttgcagtgagctgagatcacgccactgcactccagcgtgggcaacagagcaagactctgtctc

SEQ ID NO: 247730 - DNA, 464 bp, Homo sapiens
gcctcccaaagtgaaattcttaatgactggctacactaacttatgaatgccataatcaatacagattttttctccagagtcttgatagctattaatattttcctctttttttcactaaaacataaaatggaaatataattgttttgatttgaatttaatgtctatcaagattgcatcttttttattgccttcgtatgtgtctgtagatccaacatgtttatcaccacaactacctgagttctaatggtcccaagacaactctaccaccaaatttctacctttgtttctcaatgtctctgtgcattggcttcctctgtaaatgggaatacattacctgtttcaggttgttacaaggagtaaaggaaataatgtacataaagcatttggtgaggttttatatattatgatatcataatatatagaacaataaatgtctaggttttctcctatagatgagttacagt

SEQ ID NO: 247731 - DNA, 370 bp, Homo sapiens
gctctgggcagctgtctggggccgggaagcggggcagatgtcacgcagcccaggggaggaggcggctccgcggggaggacaggctgggcctcaggcctggcaagactgcctcctccccctagggcctggctctgccgcctggggctggggcacagccatgggccaggctgacctgcttccaagtctagctccagctcttcggtgtggctacccgcaagtgctagagcctctctcagcccctttctctcctgctagagaataacagcacctgctttgagtgggtgtggtcctctagtgaaagaggtgtgcaaagcccagcccagtgccgggcacactgttcctgctcaataaatatcagctgctaatatta

SEQ ID NO: 247732 - DNA, 2446 bp, Homo sapiens
  misc_feature (338)..(338): n is a, c, g, or t
tatgatcacagctatgcagtccttaccataaatgtaaacggaggctggaaaagagcatgaagaagggaaaacagctaatgtgttagggttgtggatagtagcttagtttttctttcagaaattcttttattgttgttaaagattatgccagtgtatccaaacatacacactcaaagaccttgcaagaggacgttactatcatggtatatgggacatttggaacatgggtaagctctttccgaaaatagagtaatcaaaacccagaaagcaccggaaaccttgagggtgtgatcacttacgtcgagaagaaattgaaacaagactttcattcttgaacngttcccctacaaaatactatactttgatgcttctttagatctttgctgttacctctcagcgttcttaaatcactttgtttccaggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaaatatccttttttactcttcaaagggagtgtgcattctgaaatgtttgaaaagttttcaggatttatcttccctgcaattctcctttggcctcagaatcttcatttatctgatgaaaggaggcaatacaaataaatgagttggaaactagaaacatctctgcagtcaacatttggaaacatcattgtaggtgtttatgaaagcatcaataaagttcagtttaatgaaataacaacaaaaacaacctgtaattcggtcccattgcagggtgttctgagcattttctccagaaattggccacgttagagttaaacctgactttgaatcaggttagagagccttagtctctttagcaaaaatggacatagagatatgtgatttatttgtacttcttttgatctgctgacctgcttttggaacttacagacaaaatttcatattattttctatttgtgatgtttcaaactcagtaagtgataactaaaataaacctagaatataggaaaatctcatgcagtgatgtacagtcacaccaaactctgctgttaagtagaaataaaggaaaggaaatggtgaattcacctgacagtttcatttaatcagtcctgtttacagggcggcagtggtgggtgcagctgtgtgaccagcattgtgccgaaggctttggggaacagaactgagctggattttttgggagaggacacagaagtgtgccaggagggcccgtgctctcacttcattcttctcagtactcgggcgcaggggtggaggaaggagaagaaaggcggggtgggtctcgctgcggagagctgaattcctggcagtgatggtagagttggcttcacaagcctagaaaccaggaagtgggggcagggcactcatgtttactgagcacctacccatgccaggcgctgtgctgggtaatttatgtgtcacttagtcctcaaaaactcactgagtcgttaatttttttaaccctcattttctgatgaggaaactgagtgtgtggtgaagtaacccaggattcagaccaggccccgctgatggcccagcctgtgctctcccctccctatgccacctgcgaccattcgcagtgatgaggaccttgtacaagggagccaggagttgtgggggcactctagggaaaccccaacttttcttgccttcaagcttcttgcagtttttagtctatttggaggcaaggataatgaccccagggaatgtttttctctcccctttctcccgcccccaggaacacaccacatttggtccacagaaggactgacttctgattttgtatattacgtggctgttatcaaggaaagtaaagatgataaatgatcttgagaatctattctggaatgtgtgataactttgacattgaatgaaaaaggcaaaaggaaatggaggcaattcatcagcaaatttgtacatgtcaggatggagtggtacatcaaaccgttgtccaaattgccaagaatattcaggcaaaagacttggagtgtttctttgattgatttaacaatgtattttttttggctgggcatggtggctcacgcctgtaatcccagcactttgggaggccgaggtgggcagatcacgaggtcaggagattgagaccatcctggctaacgtggtgaaaccccgtctctactaaaattacaaaaaattagccaggcttggtggtgggcacctatagtcccaggctgaggcaggagaatggtgtgaacccgggaggtggagcttgcggtgaaccgagatcgcgccactgcactccagcctgggcaacagagcgagactccgtctc

SEQ ID NO: 247733 - DNA, 718 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcaggttgagaggaacagcagtccctgtgttgatggattgaggcagtaactcgaggaggaagattttcctgcacagaactgcagaggcttggggagagagagaacacactgggatgactctgagatcctaacctgagtgtcttggtggacggtggcctcactaaatgagatggactataagaagaggaacagattaaggggacagtgattggttggatttttggtagaatttgagctgtcttgggtacttttggcagagaacttgagtaggcagttggaagtatgcacttggagttcacaaaagaactgttgggagctggaggtgtcgatttatgagttactggactgtgggtgacagtgg

SEQ ID NO: 247734 - DNA, 441 bp, Homo sapiens
  misc_feature (21)..(21): n is a, c, g, or t
  misc_feature (28)..(28): n is a, c, g, or t
gaacccttggaaaagaatttntctttangcagcttatactattcctttttcactcaaactactctcaaaagccttctcatgcaatgactgtgctgctttttttttccctttagtagcatctttccctggcccattgaaagaagagaatctgttaaatgttccgaagccactgccaaaacaactgtgggagaccaaggaggtgggtgaacagtactcagctatgtttgttgtcactgaatgtttgtacttagaggtcattgaaaaatcctgcagaggtgaaagcaagaggaactgggggaaaaggagaagatttgtctgagaacagagataagaatatacaagggaaggacgtttcaagtaaaaattatcgcgcttgtgtcaatgaattagcacattgatctcttggcttactaattttcatatgaattgacttatttaaaa

SEQ ID NO: 247735 - DNA, 5179 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatga

SEQ ID NO: 247736 - DNA, 5647 bp, Homo sapiens
  misc_feature (5647)..(5647): n is a, c, g, or t
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatgaaaaaaaaaaaaaacaaaaaaaaaaaaacacaaaacaaaagaaaattatttatacacaaacaaccaagaaaaaacaaaaaacaatctctgttgcggggcgcgcgcggccgcgccgcccccagaaaaagatttttttaaaccacccccgtggtggggggcgcgggggccccccaagtagggtagttagcacaccatcgttgcacaaataaggtgcgttccccacaaagaaacaacacccctggggcgacaaccaaacagcgggggtgggggtggttcttctcccccacaaaacaaaaaaaaccgcccgcgggggaaaacaccaccagcgctgtttttgaaaaacaccaccaccaaaaggggcgtctaaggacgggggcaccaaggagcggcgactaacaaacagagaggggcgccacagcggcagggggcgaagataaaaaatagacgcccgccgccgcgggttgtccgn

SEQ ID NO: 247737 - DNA, 4305 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtaaggcactatgtgaagagtgactatgctgagacctctgt

SEQ ID NO: 247738 - DNA, 2852 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacatctcagagactagtgctctctcctcgtccttattcacccccggcctttttctatgct

SEQ ID NO: 247739 - DNA, 1479 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcaagccaggcctggcttgctcaggtctcctggatcagacagatgggattttagctgctgctttaaatcctagtgctggaataagtcaaggtacttcagttcagctcttgcctctgtcactaatcttgctttatgaactcctttgattttctgaataagttccagaaggttctctattattctgtccttcttccaaactggaaatggctgt

SEQ ID NO: 247740 - DNA, 256 bp, Homo sapiens
gattatttgtcattattttatggttattataaagaaatagttccatatactactttatttaccttgacccaaggcccactaatgtataataagtaaaactgtaaaatcggtcctttcatctcctgttgttatcagttgttcttgagggtgagtgtcaatttcatggttggaggccaactcttcttcccttctctctgcagccgtcatttcaccaagctgataatgttcggggaacccgccatcacgggctggtgga

SEQ ID NO: 247741 - DNA, 1335 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctatctcgaaaatcaaactcaagcctccgacgtcgttccatgtgttcccgccagccaggactgtgaggtcgccacctctctccatc

SEQ ID NO: 247742 - DNA, 1071 bp, Homo sapiens
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcaatgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggaggtgggtgaacagtactcagctatgtttgttgtcactgaatgtttgtacttagaggtcattgaaaaatcctgcagaggtgaaagcaagaggaactgggggaaaaggagaagatttgtctgagaacagagataagaatatacaagggaaggacgtttcaagtaaaaattatcgcgcttgtgtcaatgaattagcacattgatctcttggcttactaattttcatatgaattgacttatttaaaa

SEQ ID NO: 247743 - DNA, 388 bp, Homo sapiens
caggaagaagaggcgcccggaaaaccttagctcttggctatctcttccctgagcacaccctggccctggggcctgagatctctccatgcaggggcagccatgagctccgggggcagcagcaaggctggccacaccacccatcagccacctccagccccgccgctcaaccagccatcagtcccttaactgccagtgttcgtggaccatgcaaaacaaccaagaggaagagaagggaccatctcaggtatgacttcaaatcaagccactgggttgtctgagaagtaccccaagcaactagtctggactgggaggttgaattgagtccttgctgttgctgaagctgtgagaataattctgtttaaaaaacttttaaataaaatatccttca

SEQ ID NO: 247744 - DNA, 780 bp, Homo sapiens
gcctactactactaaattcgcggccgcgtcgactgcatctgaatcacttgggagacttgttaaaatgcagatgtcagggccccactcaggaactaatgagctggaatctctgatggagatgctgaggaatctgcatttcaacatgcaccgctggataattttgtttctgatgcacggtaatggttgtggaccactgagctaatgcagtgcatctcagtgattactgtccatcagaagcttgttaaaaaatattcttgagcaccacccccaaaggttctggttcagtaggtcaagggtggggcccaagaatttgatttctataatgcttttaagtgaagccaatacagaccacacttagagtaacatgttctaatttttttatgaaccaggaattaataaactgggcagatagtaaagcattgcccacagaggttgaaagagactttcagattcatcgagtctaatctcatcagatggttgagcttcttccacaaaatccccaccaagtgggtctctttgaatgctctaccaacaaggatcccactacatcagagatgaaccatttacttaaatcagatcaatcacccaactatcaactaagcacttactatgtgcaagtctctatgttaagtgctaatgaagataaatgagttttctcagggagtcggggaactgtaactaaagagtacagctcttttgttttcacttaaatatgtgtcattattgtggaactattaaaccacaccattgttcattctacacacataatgaaaaaaaaaa

SEQ ID NO: 247745 - DNA, 374 bp, Homo sapiens
caaaaaaaaaaaaaaatggctgggagtggtggctcacacctgtagtcccagctactttggaggctgaaaggaggatcgcttgagcctgggaagcggaggttgcagtgagccgagattgcgccactgcactccagcctgggcgacagagggagactgtctcaaaaaaaaaaaaaagaaaaaagaatgcaatgtcagggctagaaaaaatgaagaattaaccaactcaagatgagattctaaaatattcattttattttcccccctgtgtatcagctaaatatgaggaaaaaaagaggtggaagtataaattaatttcaagaatatttttcaggttatttaggtaaactaaataaataataaagtaaataaaccag

SEQ ID NO: 247746 - DNA, 487 bp, Homo sapiens
tactctgcaggagcagtgcattttatagtgttttctttgacagttaatattaaattctgaatgccaacaacttattaatagtgagaacatctggtaattgctaaggacagaaagatgtgtcccagaaggtcacaggaaaaacctttgaatctccatcccccttgtgccatgcctaaatgattgatttccacctctagttcctttctatcaggagtggttattggtttgaagttgggggatgctgcatagtattatttagcttctttcgtgcctcctaaaagccattcatttattaaacaaacactcattgatcacccattatgttccgaaaactattctaggcacttgggatgtaaaagagaaaaaaccccaaagaacctggccttagtggagcttaacattcaagagggagaagacaaaaaacaagcaagctaaacaaacaaaaacccatgaagaagaaaatatatcatgctttataagcgctatg

SEQ ID NO: 247747 - DNA, 755 bp, Homo sapiens
ccctgtctcaaaaacaatttttttttaatcattgcagaaaattcttttggaatgtgctatatccagatcttgggtcaagttgtgcttttaaaaaatataacgatatgaggactgtgcatggtggctcatacttctaatctcagcacttctgggaggccgaggtgagagcattgcttgaggccaggagtttaagactaggctgggcaatgtagcaagatctgggtctccaaaaaattttaaaaataaaaataataactttatccaaaaagttcaactttaaccataaagttcatccttttaaagtatatagagtgttgtttttagaactgaagttacacatttaaatatgtatactctattaataaagaaaaaatagttattttttgggaaactgtacaaaggatgttatcacatacatgcagaattaataaaggttaacaatatgtcatagttactcaaaatatttggtgaccttacagtttcagaagaagggaaaatttgcagtgggtttaatgagtggatgagaggaagtttagaaagtagagacaataagtgtaggctggggtgagggttgaaaaattacatattggatacaatgttcactatttgggtgataaggcgataaggttaggtaactagaaaccctaacctcaccattatgcagtatatccatgtaacaaacttgcacatgtacccctgaatccataataaaatatatgtatgtaaataaaaattaaaaaataaaaccatgaaca

SEQ ID NO: 247748 - DNA, 420 bp, Homo sapiens
gacttgcacatttataaatagctcctatttattaatggccatcctctcttcaaccacctgctaaagttgaaccacctgcacggcaattacaaagatgactgggccagagggtatgggaagacgcctgagatgactatctttcctgcaattttgcctgggaaaagctctgcttccggaaaaaaaattactgttatcttctctatcaccaaaaattgggacaatcaaattttttctaacccttttggatataagaggcagttaaaaaaaagtgacggagatttcctagacattcttatgttttctatagacaatgtttggagtatggtgacaagccaaggaaaatgcagaaatggtcactataactatagcacctgcttctatattcccataattaataaataatgctattcctactgtcat

SEQ ID NO: 247749 - DNA, 260 bp, Homo sapiens
aattatatccaatatttattgtagactcactgtggtcaggcattaatctaagctttctaaataagtgtgatcagttagtgtgcatgtctttcaattctcacaataattaaaagagatacatgctatgattttcacagttttaaagggcaaaacaaaaaaaaaatcaaataactttaaatcgagtaagttagttgagttgaaactcagacccaatcaacacttaaattcatggttttcatcatatatcatacctcctcctc

SEQ ID NO: 247750 - DNA, 319 bp, Homo sapiens
ataaaacgctccctctccctttgggtttggagagccgggttcccccctccgggcagggcgcgggcctaaggggccccgggagttttctccggggccgggtcgggacgcggctggtgagtctcggctccggcccctgaattggggggtccgcgtctgccccaaacgccgctttcttccgttttccatgtcatttcctgtactaataagatggtggtcaaagcaggggaggagagcagcagcgagtcgccgccgccgccgcgccgaggctggcgctgaaactttgcctcgccggggaccagcgcgcccgcagcgcggccgc

SEQ ID NO: 247751 - DNA, 484 bp, Homo sapiens
ggcttggccaagagtcatctcattagaagcctcacagagaggctcctgtcactcatcactcaggaaattccaggggttttaggagctctgtgccaggaaccaggggcaaagaccaaatatcttatgatgaaactgcaatatcagattaagttttttgaatgtttgaatagatgggatttgctatgcatttttaattaactgagacttctgtcattgagactgatgaataaaatgttaaaatcttctgaaatgtggaaagtaaaagctaaacagagccaaggtgagatgaagtgatactgtaaacaaccaacagtgatggaaatgtccttctttacattctatttacaatttttattactgaaactgcatataatactttcctgagaacaaacctttcccctctccatttttaggaagatatttaaaattatgattatcatttctacagttttgggaaatagtcattaaatcttttgaccccctc

SEQ ID NO: 247752 - DNA, 484 bp, Homo sapiens
agttatagatgtcgccacgtctggtgttttctcagtttttttcctagagagatatggggagatgtggccgtgcctggtcagccttcctgaaccacacattggctggattgctgtgggtggggcagactttgttgctacagaaccccagaccccgctgttacccactggagttatttacaaggcctgccggatgcctgtacgtcagtggcttcaatccggccactctcattggcttgctgctcctggagttgcccatgctgagaaccgttctgttccacccagccagcagccagtggaaatttcctgacccctcctgggcctgaagccccagagccaggaccggacctttgtggatactgatggctggagaaaatgtctgtaagactctcagtagagaaatgctaggtgcaaaactgcacagggcctatcatcctagggtaatttagaaatacgtgcatataaaattatccctatcttgatgttt

SEQ ID NO: 247753 - DNA, 883 bp, Homo sapiens
tattttaacaaagataatttaatataagtaattgttaactgggtattggaaaagcatggtcaccagatcagcatcataagcatcacctagaaacttcctagaaatgcaaattctcagactccaacttcacccctgacttactgaatcagaaactctagtagtaggcccagcaagctgtgctttaacaagccctccagcggattctaacgcatgctaaagtttaaaaaccactgcactaaaatatcaccaagacaaccactcataggactgggcagaaagaaaaagagatggatggacttactgaaactgagaagcttcaaaaaggcccccatggaactgaaattcagacttttgagaacaggtcactgcttgcctggtactgatttctctgagttcagaggagggagcctatagacctgggaaccaggtatctgaggaagaagcacccagtaattggagctggcatctcaagaaggcacattgagattggttctataagtgttgggaaacccccaaattgcaatcagctgctactactagcaggcactattgctttcggagtgaagaattgttgctagagtgagacttaacaggattaagaaacccatccgaaggaaacagcaaattccttcttccttctctacctgtgaagtgtcacgctggtccctctattggcagagcctaacagggagacagaaatgcttgcagaattccaaagagtgggtttgaagccaagagacagtagcttactgtcatggccttaattataatacaagtggaagataatagaaataatactttaggtatgtataattgggtgcatgtagacattttctgggatactaactactgggtagacatttggccttattgtaaaaaaaaa

SEQ ID NO: 247754 - DNA, 486 bp, Homo sapiens
cagtgtcaggatgtcatagaagtctttagggacaccggacctccagccatgtggatccaggttgcagggcagcacagacagcagccggcagcaaaggcacccgtgccagcagcctcatggtgtgaagaaggtgggcaggtggtgacgggcactccgctgtatcctgggaggacactctccatgccacccaggccgttccctctgtgcccggggagtgccgccagcccctgctcctgagttcccactgtgctcggggagtgctgccagcccctgctcccacgtctccatccatctgcctcgtgcactccagagacacaggccctaggaaggaggcttctcacacccggctctcctgtccttcccgaaagctcatcacatattgaacacggagccctccccagagctgctggggactctgtgcaagctgcacacgggtacagtcaacatggtgcatgcacaggacccccagatgtcgctgaggacttc

SEQ ID NO: 247755 - DNA, 435 bp, Homo sapiens
aagattgagaccatcctggctaacatggtgaaaccctgtctctactaaaaatacaaaaaactacccgggcgcagtggtgggtgcctgtagtcccagctactcaggaggctgaggcaggagaatcgcctgaatccaggaggtggaggttgcacagtgagccaagattatgccattgcactccagcctgggtgacaagagcaagactccatctcaaaaaaaaaaaaaaaacaaaaaaacaggaaagatcacagcaagttaagacatctgtgagaaggcagtgaatattccaaaggcaggaacaagatgaacaaaaagatgtggagatcaaaattaacaaagtttagaagacttttaaaagtttgaattaggccaggcgtggtggctcatgcctgtaatcccagcactttgggcggtcaaggcaggtggatcacaagg

SEQ ID NO: 247756 - DNA, 170 bp, Homo sapiens
aggtatatggtatctcaccaggagagggtaggctactagcatatcacatttcccctggtcccagttgtatagcctaaaaaaagtaaatgtgtaacccactccatatcgtcgcttccacacctatgatgcatgggatccctgtgaaaaaaacaacacccactaaagatgaa

SEQ ID NO: 247757 - DNA, 700 bp, Homo sapiens
gggctaattttgtatttttagtagagatggggtttcgccatgttggtcaggctggttttgaactcctaacgtcaggtgatccacctgcctcagcctcccaaagtgctgggattgattacaggcatgagccaccgtgcccagcctctgtcagcagtttttgatgatgcaggcttccccctcactatccttcaactatactgtgtagtttcatatttttatcttcatcagcctactaagtgaaaatgtctatcttgttttcatttgtattttttaaattataagttaagcatcttttactgtaagtaattttatttctttttctatgggctgattttttttcttcttctttttttttttaaagagatggtctcattttgtcaccaagactgcagtacagccgtaggatcttagcttgctgcagcctcaaatttctcggctcatacaatcctcccacctcagcctcctagataggtgggattacaggtgcatgccactgtgcccaactgatttttctagttctagtggaggtgggcgtttaacatggtggtcagcctggccttaaactctctgccttacgctatctgcccaccttggccttccggcccgggattaacggcgctaagcctatgcacctggtcttaatgcggcctttttcttttagggtcccagcgcttcatgccccactcctggccctttggcc

SEQ ID NO: 247758 - DNA, 590 bp, Homo sapiens
gggctaattttgtatttttagtagagatggggtttcgccatgttggtcaggctggttttgaactcctaacgtcaggtgatccacctgcctcagcctcccaaagtgctgggattgattacaggcatgagccaccgtgcccagcctctgtcagcagtttttgatgatgcaggcttccccctcactatccttcaactatactgtgtagtttcatatttttatcttcatcagcctactaagtgaaaatgtctatcttgttttcatttgtattttttaaattataagttaagcatcttttactgtaagtaattttatttctttttctatgggctgattttttttcttcttctttttttttttaaagagatggtctcattttgtcaccaagactgcagtacagccgtaggatcttagcttgctgcagcctcaaatttctcggctcatacaatcctcccacctcagcctcctagataggtgggataatatgcatgagccactgcaccggcctctgagggactaatttttactatcctatgcctattttatttttctccaattattggtcttttacttggcttacttgatatattaag

SEQ ID NO: 247759 - DNA, 434 bp, Homo sapiens
ctatctaaagctctcattaataaaattggagaaataaagtactgcttaataaattcagtctaataatgggggaaaaagccttttaaaacatggtctcaagagtgggaggaataacagtaaaaggttgggaattagatttagtccagtctcttccacaatgactttccacacaacatctctaataattatgtacatagcttctgctcaaatacttcctgtaagagaaaaatactgtgtagagaaaaacaaagcagtgtgcttaattcaggtcaactaactacaagtcagtggtttctttaacctattttgagtcacagaattttttttttttttttttctgagacagggactcactctgttacccaggctgaagtgtagaagtgcaaatacaactcactctagccttgacctcaacctccaaggctcaggtgatc

SEQ ID NO: 247760 - DNA, 308 bp, Homo sapiens
ctatctaaagctctcattaataaaattggagaaataaagtactgcttaataaattcagtctaataatgggggaaaaagccttttaaaacatggtctcaagagtgggaggaataacagtaaaaggttgggaattagatttagtccagtctcttccacaatgactttccacacaacatctctaataattatgtacatagcttctgctcaaatacttcctgtaagagaaaaatactgtgtagagaaaaacaaagcagtgtgcttaattcaggaagtatttgagcagcaccacgaatgtcgcgggggatcct

SEQ ID NO: 247761 - DNA, 404 bp, Homo sapiens
agaatatatagactgtatatctatcagttataaagtataataaaattaatacatggaaacttacccagcttaagaatcagactcagggcccgggcatggtggctcatgcctgcaatcccagcactttgggaggctgaggcgggtcagtagtttgagaccagcctggccaacatggtgaaaccccgtctctactaaaaatacaaaaattagccaggcgtggtggcgggaacctgtaatcccagctactcaggaggctgaggcaggagaactgcttgaacccaggaggcggaggttgcagtgagccgagattgaaccactgcactccagcctgggcaacagaacaagactctgtctcaaaaaacaaacagacaaacaaaaagaaaaaagaaaaagaaagaaagaag

SEQ ID NO: 247762 - DNA, 370 bp, Homo sapiens
cgcgcgggctgctccaggggtggggactcctctatcccttggccccggacaagtcccagggcacggacgtgacccattacgaacaggcagtgaagctgtggcagggctggagctgccccaggctctggcatcatccccgagggctggagctcactccccgctagaggcttttccggaccccacgtccacaggcaggtgcatctggtgaagctttcggccacagtgagtcatggcatagccaacgggtgacacagcacgaggcaccccccccgcccccctccactgtctcttgtgagcagagttaatccccaagctggtgtttcttggcgccttcgaggtgtattttaaattctgcaaagtgactaaaaat

SEQ ID NO: 247763 - DNA, 187 bp, Homo sapiens
aagataatgacagatagattttggctcctgaggcttttcaaaatgataaagtattcttggaaatggtatgaagaacaaatgttgaatgtaagctatgattagtctcatacaagatggtcatacaattaaactcctgattgagttattcagaagcaacagaatggttcattaaaagtaatcctgacct

SEQ ID NO: 247764 - DNA, 399 bp, Homo sapiens
tcttccaatcttctcattgtatctccctgcttatctcataaatatcaaagttttaaagtaacatagctatttggttaattttagtgtggttgtttaaaacagcttaaattggaacctacttaatcagtaatctaagctactggtgaaatgaattctttttttagtattggcaggcatttgcaacaaatgaagatgccttagctcagtgccagctgtgagcaaatagtttcggttctcaatttgtgctaatctagaaattcataggaaatagccaggataaggcttgggaatgtcttgtccttgttaaactctgtccagctgtactgctcagcactctcaactgaaaattttacttgctggagaggagcggcacagattctaaggactcttctggagtct

SEQ ID NO: 247765 - DNA, 460 bp, Homo sapiens
agctaagcaatgaggatgcaaaggcataagaatgatacaatagactttggggactcatgggaaagggtaggaggggctgaaggatacaagactacacattgggtacaatgtacactgctcgggtgatgggtgcaccaaaatctcagaaatcacactaaagaacttattcatgtaaccaaccacctgttccccaaaaacctattgaaataaacaagcaaacaaaaaattctcctaaacagccaacatacagccatcaaaattgggacactaacattgatatgtgactatcctccaaccctcagactccatttaagtttcatcagttactccagtagcatcatttatagcaaaataatccagttcatcattctgtgtggtatttaatgatcatgtctctttaaactcttctgtctggaacagctccttggtctttccttggcatgaccttgacacttttgaa

SEQ ID NO: 247766 - DNA, 482 bp, Homo sapiens
gtggcagcagctttctaacttgtctccttgcctctatctgtccctgttgtttcattctccatgcagggcagtccttctgtaacctgaaccagaccttgctgctcctctgtgccactccctccggtggcttctcatcaccatggcctgcaaggctctgtgtgacctgtcttctggcactccctgacctccctcttagctcagtctgctccagcctcaaaggccttctggctgttactggaacattcaagcacattcttgctttgggtcttttataaatatatacatctgtctgtgtgtatatatatatatacacacacacacacacacaaacacacacatacacacacatatatacacacacacatacacacacacacatatatagttctctcttcctccagatatctgtaggcttcatcctctcacttccttaggcctctgcccacatggcaccatatcagaaaggccttccctgatgactt

SEQ ID NO: 247767 - DNA, 461 bp, Homo sapiens
aaaatatgcatctactccaaaataaaatttataattattctaatcagtttactgcttatttcataattttctcaaactatgtgactagaaaattttgacactcaagcttagtgaaattataaaaactaggtgttgttaattctctaaggatgatgtaccaaagggagagttagaaataagcatttacagcaattaccaaactaaaaggccaaataaaaaatagatagcttttagttattcaaataacaataattattataataatccacgttactttgctccttgaaaatacaaactctacctattgtaacaattttgatcccttgagcatattgcttggcttttaatacattttattcaaatataacaaaaagtcctccgtaattaaactgcaatatttttgttgaagtcaaattactatcattgtgaacatatgctatatgtatttagtaaaacaaacc

SEQ ID NO: 247768 - DNA, 423 bp, Homo sapiens
ccacccagattaagggtgggtctgccttcccccgcccactgactgatatgttaatctcttttggcaacaccttcacagatacacccaggatcaatactttgcatccttcaatccaatcaagttgatactcagtattaaccatcacaagattcttacattactactaataaacaagaactgaaaacaaaaacaaaaacaaaaacaaaccgagacagatcccccatttgtctctcttcactccctcttctcttcttccacatgtctctgcagtcttttctgcagcagccatttgttcaaagagcccacttccttgaacagctgcttgccaggctgcatggtcatataatgttaggtgaagagtgaagagctctgcatgaggccccactgtctatctaagagcaagggttcttgcctcaaaaaaaa

SEQ ID NO: 247769 - DNA, 458 bp, Homo sapiens
gtgactgcacccagctgactagcttctttggagtttcatccatattgtaacgtgtatcagtacttttttatagtagaagaatattgcattctatggatatactatgccacatttgtttactcattcatcgattgataagcatttgagttgttttattatgatgatgattctttttaatgctcacatgggctttcgtgtacaagtttttgcatggacttatttttcatttctcctgtgtatgtacctatcagtgaaattgccaggtcatagaataacttgatgtcaaaattatggaaaattgttttctaaagtgattgcaccattttacatttccacaagcagtatatgagagtgttctccacagcctcatctagacttggtactgtctgacttattaatattagcctttctactggggatgaagtgacatctcattttggtttagatttacatttcct

SEQ ID NO: 247770 - DNA, 474 bp, Homo sapiens
caccgccccatccctggagctagaaaccttggattcaagctggacttctgtcttcgcttgggctgccgtaacacaataccgtagactggggggctccaacaacagaaatctcttttctcatagttctggaagctagaaggcccatatcaaagtctgttgctggttcctgtcttgcagacagctgccttcttgctgtgtcctcagatggtagagagagacctctaagccactagacagtgggccccatctgctgccctggttcctggtcctttcttcctctccttttaatcctatcaggccatttaaccttaatgacctcatttaactttaattacctcctaaagaaccagtcacattgtggattagggcttcaatatgtgtatttttcttactttgagaggctgaggcgggagcattgcttgcacccaggagttcaagaccagccagggcaacatagtgagacaccatctctgt

SEQ ID NO: 247771 - DNA, 575 bp, Homo sapiens
gaggtggagtcttgctctgttgccaagctggagtgcggtggcatgcactcagctcactgcaatctccacctcccgggttcaagccattctcctgcctcaacctccaaagaagagagcttcacataactcaggcccgaggtttccttccacattctcattcttcactggacttcctgccttacaagtagcttttcagtgtgccttgtactcactgtcaggagttttactgtctgcaacaggctctgccttagaggacttagagagtgagctctgaataagtaatgatgtgtcataactttgaatatttaaatgctgagcgcctagagccagcccttgattctctgccagcttccaatctagtgtctcggtcagtggaagggccttggaagaatgaaagtggggacacaccctatctgtctggagacagggcccaattaggacagaggtgaaaagaagcaaataaaatcactatttcagatgaattgaaaaaaggcttaaggcttgcagttaagatgctgttgctcctggtaagcagcaaaatttcaacaaaaacatttgacacccagacttagctg

SEQ ID NO: 247772 - DNA, 453 bp, Homo sapiens
gttcacaggtgaagaaactaagaatcagaggagttctaactgagccatgaggactcgattcctgaaaaccttatttataaaaaacaggaatgggaactaaaacaaggcaacctgtgcaagcccttacaagtttttcatgtattacagtaaaaggtaaagcaacttaaaaaccacttgacattttttaacatttgtaaaattttgtaatgcacagttgtctctcatttaccatcccttgctagaaacttcttaggctcacccttcactgcatttccaacattattttgctgataatgtatacgcccaagtgacatgttttcatttggcttaactttcaatgcctttttgattttatgatctagtcctttattgctggacccttgaattgtatctagtcttctgctattacaaaaaatgctgaatcaaataaacctgaacatgtaacatcataaa

SEQ ID NO: 247773 - DNA, 339 bp, Homo sapiens
tatttagcgactccattgaaaagaaacataatatatggaaaaattactagaaaatctaggaaaactgactgaatgctttggaaagacacagtcaagattaaaaaaaatgtgtcacaagaaagtttacagaacctactcaaactcaaagagaaatcagagactaaattctcaaaactggaagctccctacagcatccacactcttcagccttgtactatgtgatgtgtattacgaatggagccaccggcagtatttgtatgaacatgagacaatgtgtggcagatgcttggtgctttgtaatatttagtaaaataaaacaataataatgtaactataaaa

SEQ ID NO: 247774 - DNA, 390 bp, Homo sapiens
tatttagcgactccattgaaaagaaacataatatatggaaaaattactagaaaatctaggaaaactgactgaatgctttggaaagacacagtcaagattaacatgctgagactcgggaggtggtgatttgcctagggacacagaaaaattaaaaaaaatgtgtcacaagaaagtttacagaacctactcaaactcaaagagaaatcagagactaaattctcaaaactggaagctccctacagcatccacactcttcagccttgtactatgtgatgtgtattacgaatggagccaccggcagtatttgtatgaacatgagacaatgtgtggcagatgcttggtgctttgtaatatttagtaaaataaaacaataataatgtaactataaaa

SEQ ID NO: 247775 - DNA, 762 bp, Homo sapiens
tatttagcgactccattgaaaagaaacataatatatggaaaaattactagaaaatctaggaaaactgactgaatgctttggaaagacacagtcaagtttcacctccttatgctggatatgcgacgactccaggaattttctaatctaagaacgagcgtgttcagtgaaatatcatcggtgttgcaatccgggggagcacgtgaatgtgcctgccaggggagtcaaaagcccttcttgtagaaccgtgaaaggaaataggaagtgaaagctttgccatgtagaacattcctccacactgagagcacagaggatacagacttagttcatatcccagcttcaatcttagagtgccgtgtagatattcctctgtgagtaatgacatttcctcaacatttatataaccctgaaatatcttctgatttctgcctttggtgtataggaagcaacagcacttcttttaaaaggggaaggagggtcagcgcggtggcttatgcctgtaatcccggcactttgggaggccgaggcgggcagatcatgaggtcaagagatggagaccaccctggccaacatggtgaaaccccgtctctactaaaaatacaaaaatcagctgggtgaggtggctcacacctgtagtcccagctactcgggaggctgaggcaggagaatcgtttggacccgggaggcggaggttgcagtgagccgagatagtgccactgaactccagcgacagagcaagactctgtctcaaaaaaacaaacaaac

SEQ ID NO: 247776 - DNA, 640 bp, Homo sapiens
tagggttaacataaggaattctataaaaaggactcacttggtactagaagcactcatgtattagggttctctagagtgacagaaaaataggatatatatatatgtatatcctatattacgtatatatatatatatatatcctatattacatatgtgtgtgtatatatatatatggagtttattaggtgttattaactcatgtgatcacaaggtcctacaataggctgtctacaagctgaggagccagaaagccagtctgagtcccaaagctgaacaacctggagtcctgtgttggagggcaggaagcatccagtgctggagaaagatgtaggctaggaggctaggccagtctcaccttttcatgtttttctgcctgttttatatactggccatgctggcaactgattagatggtgcccacccagattaagggtgagtctgcctttcccagcccactgactcaaatgttaatctcctttggaaacaccctcacagatatacccaggatcaatactttgcatccttcaatccaatcaagttgacagtattaaccatcacaacccacatttgaaaagaaataaatcaatattttgaaaggcaaaaaagagtgggcagatacgtaagaaaaaagtaggggtttt

SEQ ID NO: 247777 - DNA, 1052 bp, Homo sapiens
aggactaagactgaatgagggttataagagagactgtagtatgtgtgactaaatgttctaacaaggtacagtgtatctaggaaataacagggagatgtggtgagaacatattaaaggaatattatgcttgctgattatagttattaactgggagtaaaggacagtatttcaaattagatatagagggagagagagggcagggagaagataggtcctagttaatttctagttttatcctttgaaccacattaagtattttacatactcaacaaaattgcatcggcaaggatggaggaaccctaaaactgaatacaaacagacaaatgaacctgtttataaaattgataaccacacagaaaaaaaaattcaagtaacttctgaacattaaacagtgcatatattctaagaacaaaaagaactacaaatgaatgtggaactttatcaaatagattaacaaatactgtttgtcattcacagtagaaagggcatagcaaatctgaggttaatttctctgtattgtaagatttagtaaatgaggacatgcaatactgttgtgaccagagttctcctggtaggaaaagggagaacacgtaggtctctgtggtgacactgtggtgacaggccgagttacagaggtcagcatggatttattgaggctgggatgtgccactgtgccaaaaaagagagcagtgctaccctgagtgggagcgccaggacacaggggctggtatgaaggggttccagctaaatgtacaacagttttagcaccaatagtaacatgttgaataaaagaatctctgaaaatgtactggtgccaaaaaaaatacccatatttgttttctgaataaaatatgtattaataaaagattattttaaaggaagggcaaagggcaaaattagtatatggtaccatctttaaaagaaaaatcaggtcgggcacagtggctcacacctgtaatcccaaccaacactttgggaggccgaggtgcgaggattacttgaggccaggagttcctaccagcctgatcaatagagagagaccctgtctctgg

SEQ ID NO: 247778 - DNA, 684 bp, Homo sapiens
cttgctttgttgcccaggctggtctcaaactcttgagctcaagcaatcctcccaccttggcctcccaaagttctgcgattacagacatgagccaccacacctggctgacagtatttttataatggttgttgttacaccagtccagggtttcccccttggtactgggtgatcaatcagctggccacaagcactatgcacagagcttatgatctactctaactcagaactttctcggactaaaagatgagctggtttatgctgaggatttctaacagtgctcttcccagatagcagactttagtttataaaatattcatcagttcttttgctcaaaagaactcaactaaagaattcaaacgctgtatggaattaaatattaaagactatgtgttatagaaacactgtaactattttagaactcaagacctcaattcctttttctatgtgcgttcctgccaaaatcattccagctagaagggcactggcctgaggaacctgtgtccagtctccggcaccaacatgctagccctaccatcaccttgttctctgtgaggtctggcaggtggaggaacctgctgaatgacaagtaacttgtggacacaaatggcactttaaagatgcatagcttatcttatccaacgacagttaaagcacataataaatgtaaaaaatttggccaaatta

SEQ ID NO: 247779 - DNA, 2055 bp, Homo sapiens
tgcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagaaacacaagacctgtaaacatcagttgctttgggaacacaggaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccccaccattttgagggcatatttttaaagcaaaaaagtatgcttatttgtttttaattaaaatgattagcctagactgcacatatattatttacactaatacatacccctaaaagtcctatattgctactttctggatctcagtgaaatttatttccatactgactttctccagtccacagtgtatatgaatatgtacacatacagtgtttattagttgtcagtaaaaattctcatgaaactaaattccccatttatttaaaaggttagaaatgtttagtttgatgctggaaataaaatcattgaagtctatgtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggccgaggcgggtagatcgcctgaggtcaggagttcaagaccagcctgaccaatatagtgataccccgtctctactaaaaatacaaaaattagtcgagcgtggtggtgcatgcctgtaatcccagctacttgggaggctgaggcaggagttaatgctgaatttgtggtcaaggaatccaaagtctagcatctggtcccatctgactccatggtcccttggggaatcaactcctcagggctaactagattatttccactgagcttttaccactgaagattcatcttttatcttttgtaacagctaacctgtatgtatcaagatcttcttacaaccagtgtcaaaataggatgcaggaactggaaaaagaaacacacactcacgtgcacacatgcatacacatatacacacacacccctgagcataagctcagactgtacatgaatagtatcactgcacatactcatcataatggaaaaactacagtgtgtacaccaaggcctgggattaggggctgggaagagtagaggctgggagtggttaagaagataaaaacagctctttccttccctggaagtataataaaattttcaacagactctttcaaccaaaacttg

SEQ ID NO: 247780 - DNA, 1441 bp, Homo sapiens
tgcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagaaacacaagacctgtaaacatcagttgctttgggaacacaggaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccccaccattttgagggcatatttttaaagcaaaaaagtatgcttatttgtttttaattaaaatgattagcctagactgcacatatattatttacactaatacatacccctaaaagtcctatattgctactttctggatctcagtgaaatttatttccatactgactttctccagtccacagtgtatatgaatatgtacacatacagtgtttattagttgtcagtaaaaattctcatgaaactaaattccccatttatttaaaaggttagaaatgtttagtttgatgctggaaataaaatcattgaagtctatgtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtggaattacaggcgtgagccaccctgcccc

SEQ ID NO: 247781 - DNA, 669 bp, Homo sapiens
gtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggttgaggcaggagaatggcgtgaactcagaaggtggagcttgcagtgagctgagatcgtgccactgcactccagcctgggc

SEQ ID NO: 247782 - DNA, 309 bp, Homo sapiens
cagttacactgaaggaggacatttcttttaaatggaaaagagtattttttaagttatattttgtgttttgttataaatctaaggttggttagttttattggttaaaaaagtttgctaagtgatgagggtcatggattcttattcactgcacacatttattgagatgtccctgccaccttctagcaccttcccctgcttcctttgcagtctccaaccacactggctgtcagccctggtccaccacagggcctttgcacaggctgtccccaggacctggagcacttttgccacttccccttctcaccactt

SEQ ID NO: 247783 - DNA, 400 bp, Homo sapiens
taactcatccccacagggtcatttaagaaaatgtatgcatgtttctgattcataactatattatgatgattattcttataaacccttttgacgtctaaaagccttagagccactcaacagtcctgtttgggccagtctcctggaatatgagaaaagatgaagaatgggagtgttatggagggcatacgcccctctgatcatcaccacaaagagtggagcccttcatggtcccagctgaaagcctggagaggctgcgcgcggtggctcacgcctgtaatcccaacgctttgagaggccaaggcaggtggatcacttgagcgcaggaattcaagaccagcctgggcaacatggcaaaaccccatctctacaaaaagtacaaaaattaaccgggcgtggtggt

SEQ ID NO: 247784 - DNA, 447 bp, Homo sapiens
agtcaaagctgggctttaatccttgtgagagctgatctctttccaatttgcccttatccctagagtggagcccttcatggtcccagctgaaagcgcgtgagccaccgcgcccagcccgctgaaagctcttttcagcctctcagcgctgcttttgcttttggaatcagcaattgtcttcagagtaaagtgtctccaaataccagtctcaccttacttggcttctctttttctccagatcttggactagcaaattctcactgcttttgtagctcttccatagctccaaattgctgtttttaaaaagtgctaatttgttcagcatttgtaattgttctcagcaagatgtttgaaaaagaccaactagtcagcctttgccagaaatggaactctatgacacacatttttagaaatataagttcattaagattaactttgttttggaagata

SEQ ID NO: 247785 - DNA, 372 bp, Homo sapiens
aggctctctagtctcgctggaggactcgaacatcggtacttccgagaccagctgctggaagtccaggtcctgggtctggctagctcccaggccttgaagccccaggtcctgcagacacacacgacgacgtgttcgagaagggccttggtactgggagaagggggcggggagctgagggagtgtttttttccttctgggcaagagaattaattgctcacagttgaaaggcaggaagtacccgcacagcctcccctccccagatctgcaggtcaaggtcatgtgtgcccgcatttgcacagagcctgactctgacatccgtgcacacacacgcctagtacccctgcactagtgcccccacgcccgccttcggaa

SEQ ID NO: 247786 - DNA, 1444 bp, Homo sapiens
gaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcactgcattaccgtggcttcaggatgtgggggctgctacagtgttctagtagcctgacatcgactctctcaacccaagtccagcccatttccctgttcttgcttctgacaaagtgaggcccaatagggctcagactggttgctcagttctggaaagatcagggatgctgccagcatggctgtctcaacccactgagttctgtctaaacttcatttttaaaaaataaaaaaaattaagtatcagagggaaagaaattgacctgaaattatacagcaagtggaggcacagcagattcctgcatgattcctgcccctggatcaggagtctgctctacttgacctgtccctgttttcaggagttcttgaagaggatggagaaaaaatgagaatttaaccaggtttttcaagaatcatgtaaaatcaccttagtcggggtgtgttatcattaccagcatgtcctgcaggccaggggcgctgggactactctctctcccaaagacttgagacaggcagccccttctaaagcctctgcttccccgtttgtttaatacagagaacaaatcctgagatgtgacttcttaggctctgtgagatgaagcttcatggatgggggttattaatatctatcactccattccaggctcat

SEQ ID NO: 247787 - DNA, 489 bp, Homo sapiens
gtttgagtcttgtctcttttatttcttagtctagctagaggactattgattctgtttatttttttcaaggagccaattctttgttttatgaattttatctatggtttttctgttttttatttatttctgttctgatctttactcgtgccgaattcggcaccaggcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattac

SEQ ID NO: 247788 - DNA, 519 bp, Homo sapiens
tagtctatgatcctgtaacaggataaaagtgaaaaataaagaagggtatccccatcatctcctccaaatgtgtatcaccgactcttaggatgctttatgacataagactttctcatttatgaattattgtgtgtaccacatattatatattagtgaggcttaacatctttcacagatgaaaaatagaatttctaatatgttcttcctacaacccaatgcatcatcttgcctgcttgctgaaaccacgtttgagactatcagcatatgagataaaacatgctcttgagtgtgcagtgggttccttacctcccctgctaaacaagtgagaaaaagagagccagcatggtgatgcccatcttgagttcccaagaggctgcagctggaggatggcttgagcccacaagttctgggccttagtgtgctatggcaatggggagccagggaccaccagattgctcaagaagggtgaatcagcccaggtcagaaaggaagcaggtcaacaaaaacaacaacaacaaa

SEQ ID NO: 247789 - DNA, 423 bp, Homo sapiens
ggaatcattatcaatcctttcatttcgaatccattatagacagcatccctcatacactttaagctctgtgcaggcagatcacatgtctgttttgtttagttttatcccaagcctcaggcacaatgcatagaatttagaaaaagctgaattgtatttttggatgaaagagtgaatgaaatgattgcatgttgtatatgccatgtaatggagaaacagcctctctgacattaactgaaatgagtttcaagcatctactacatttatacaatggactgcctgttataaaaggtcttattttgcaaagcattaaatctcttctggaaatcaatgtaaatatccagaaataaattcttttttatcttaatctctgcatttggatccacatccagccctattctagaacaggatttttattcattaaaa

SEQ ID NO: 247790 - DNA, 386 bp, Homo sapiens
cctaatattctggtcacacaaacgtaaactctaaatgggatttgatcaagagaaaaagccctttgttcttagtaaggcaagtacttgcgtatttcaggtatggttaggcaaatcctaccagtcattcaggactcaaaatcaaattcctctcctactctcccctctgaactttttttccctccttctcttatggaacatatcactgtactccttgtactttagctgtggtttttggcatattattataccagactggagaatccttaagggcaagaccctgtgggatgtgtcttttatctgcccagcacaacacccaaaaggctgcattgcataacatgtatttgttgaatgaaaaagtgactaatggaaataaagatgcccacata

SEQ ID NO: 247791 - DNA, 525 bp, Homo sapiens
gatggaccgtagacagagtaagtgctgtaatgaaagtgctgtaagtatgaatcccagctaagctagccacataattttaccactccgaatttgtcttaattgacaaaatggggataatatgaccaatctcataggactccccccataggatttttaaaggtttaaattaggtatgattggtaaagcacctgtcacataataggaattcaacaaatgctagttccctttccactgccctgaataacgtattagtttatctagataacagatgtttttgcatagtgaagtgcagctatgttaaattcctagtattgaatgtgtgagaaatgtaagtcactcctcctgaaaaaaaagttccttgttccttgttagtaacttacttgctttttcttactgcgcaccataataagtgtttctcaaggttaaaatcttacatcacttggattttgtcatataatattatctttgattatcttttactaaaatatacataaaaattcttatgataattaaaagtacatttta

SEQ ID NO: 247792 - DNA, 415 bp, Homo sapiens
caatgcgggcactcccctgtggcagggagggggagtcaaggaaaggaactcagcattttcagggctgcattttcacacagcaagccctaaagctgcgtttgtttcctgaaacaatcttgatttcattcagaggaggaaaacgacattttggagagtctgcggtctggggtgctttgatcctcgttcacagtccagggaggtgtagccacatccccctcctctgccctgcttggcaactcacttttttgtggaatggtggccgctggccactgctgttttgaccaaatagctgggtggaccctgaaggggccattctggccatttctggcctcaggctgggtgacggtagaggatgtagtgtcaaggttatgcgtgactgatcctttctgtaaaacagcccatcccatccctcaca

SEQ ID NO: 247793 - DNA, 347 bp, Homo sapiens
ccttgggccttgtctgggcctcagatggtgagtcccatgccttgtatcaatttagtcctgttggccaggctcggtggctcacgcttgtaatcccagaactttgggaggccgaggtgggaggatcacttgagcccaggagttggagaccagcctgggcaacatagtgagaacacctgtctctacaaaaacttaaaaaaattagccaggtgtggtggcacgtggctgtagtcccagctacttgggagatgggagatgggaggattgcttgagcctgggagttggaagttgcagtgagcctaggttgcacctgcgctccagcctgggcgacagagtgagaccccgcctca

SEQ ID NO: 247794 - DNA, 320 bp, Homo sapiens
ctggggctttgagccatgtggtatcaactcaacctctgggaagaggaagagaacaagagattaagaaccatgggcaatcattcaattgatcacgagagcaaagcatcctgactccaggaagagagggcgaaagaagcgtcaccttcagcatccttctagatctcgccctgtaagtttctccttttggctgattctgatttacatcctttggctataataacactgtcatcgtaagtacagctgctccctgaataactcaggggttggggcaccaatcccccacactgtcaaaaatctgcatataacgtttgattcccaaa

SEQ ID NO: 247795 - DNA, 318 bp, Homo sapiens
tgggatggctacactggagagtgatcaagagtgagtgtagggcaggggttggccgactttttccataaagtgctctgaaagttgcagattccaggagaagtaactattgtcagacccagacaaattggagcctagagaccagaaaggaaggaaactcatgcttgtatgtctgagataagaactgtctcaaggccagacgcggtggctcacacctgtaatcctagtactttgggaggccgaggcgggcggatcacgaggtcaggagtttgagaccagcctggccaacgtggtgaaattcccgtctctactaaaaataca

SEQ ID NO: 247796 - DNA, 490 bp, Homo sapiens
ccaaagcagcagaaaccggtggtgtgccttaagatgcatgctccaaagctgtccacaaggcctctggtacaggcttccaggtctacgtctcggcttccccgacagtgtccatgcgacactgtcaccagtttctcctctcacaagcagaaaatcaaattcggattgggcaaatgattccctgcccgggtgtggaataagggtcaagtcctaagtatggagagagagcgccggctcccgccaggatatgcgaagctctggaggggaggccaagccaccaggcacccggcgggagaagaggaggctggagagcgccgcccagtgcctgcaggccgggcgctccacgcctcccctccctcctgcacaccccattcccctccggttgccccgcctgggaagccccctccccacacctcccggcccagcatctgcacgagagccgcgagccctggcccagagctctgggtgggcctctcaccccagacggcggccg

SEQ ID NO: 247797 - DNA, 347 bp, Homo sapiens
gagaaaaactggtccaagtactgaggaagaaagcctcagaaacaccaaggttgccagggcagtgggctcttgttatcagatgaacagagtccctgaccgacacctgatctgctgcttaactggtatgtgggagccttctttctcttctggtggcatttttgttgacatttcttcctactgtcttctggcatttttattttgtaccctttttgacatattaatttggtctagataagctgtagtttgcctttaaggataatacgtaaatcacacaggttcttaacaccatgtgtttgtatgtgtgtgtatgtctagggagtaggtgcttagaactgtgtgcatctctg

SEQ ID NO: 247798 - DNA, 447 bp, Homo sapiens
aaatatgctcaatgagctaatgagaaataatgaaatcagggaagtgatacatgagcaaaatttctcagctatcttaaatatgctcaatgagttaatgagaaataatgaaatcagggaaatgatacatgaacaaaatttctgtcaacaaagaaacaaattatttaaaagaaccaaattctggaactggaaaatacagtagctgaattgaaaaatttactagaagagttcaacagcagacttgaacaggcaaaagaaagaatcagtgaacttgaaggcaagttatttgaaatgatcaagtccgaggaacaaaatcaaagaaaaaagaaaagtgaacagagtctgaaggacttacgcagtaccatcaggcagaccagttgatgcattactggagtccagaaggagaaaaaagagaaagggtggaaagataatttagagaaataatagctg

SEQ ID NO: 247799 - DNA, 332 bp, Homo sapiens
gtataaaatcatgcattgataaaatagccaatcaaagtgcaagatatgggctggacgccatggctcatgcctgtaatcccagaactttgggaagccaaagcgggtagattgaggtcaggagttcaagagcagcctggccaacatggtgaaaccgtttctactaaaaatacaaaaattcaccaggtgtggtggtgggtgcctgtaatcccagctactcaggaggctgaggctggagaattgcttgaacccaggaggcggaggctgcagtgagtggagatcgcaccattgcaccccagcctgggcaacaagagcaaaattccatctcaaaaaaa

SEQ ID NO: 247800 - DNA, 226 bp, Homo sapiens
aggaacgaagatggccgggcgcgccgcgggaacggaggggcggccggcagcggcggcggcggcggcggcggctcccgggctgtgacttcgcgcgcggcggccacccgggctacctgaacggagtgggcggcgcgggcagcggcttgctagggcgggcgggcggacgccggtgcacgggcgccgggcggaggatgcgccaggagcggcgggcggctccccgcggccg

SEQ ID NO: 247801 - DNA, 433 bp, Homo sapiens
aggcaaacggtttggccaatctctcaccagtatattaaccacatgggcaaagaaaatattttttcaaaatggatgtttttgctttagggtggagggatatgatatttttctttctatcttaatttccttccatgtttatgtttaaaattacttagtaagtaaaagtaatggttatgttagataaaattcattcaccacccttaatatgactcagtgactcaaagacaaagttccagagcaaagggtcaatcttgtgagagaggtcatgcagaatttacaaaacaaaatttatacagaacactcagaagtataaaaaagatgaagttcattattgtttataattactcacttactctgaagctacctttcctcctgctggcagagaaaaattcaaattaattaaattaattttaattaagggaaaaaaaaaaaa

SEQ ID NO: 247802 - DNA, 288 bp, Homo sapiens
tatctgccacctgagagagtattgccagcctgattcgtttagtgtgaacaagcagccatgatcagaagaagctgacacctgctgagctgagctccaacagcctaagaccctagcttttgtgggggggtggtttagactctgaagtcatggggctgataaggtaatgactgctggttttcaaaatgctttctccttcattgtttgattggatccctccttctgtctcatgagattgtcagagcaaggattgtttgaaatgtaggttaatcctttccttgaactaagtga

SEQ ID NO: 247803 - DNA, 667 bp, Homo sapiens
gagacggtgtatcaccctgttgggccaggtttgtcttgaactccagacctcactgcctgccttggcctcccaaattactgggattacaggcataagtcactgcgtctggcttgggggagttactgttgaagtattgtctttgtatcccaaagcaggcccttctgaaactgatgatgttgatgaaaaactccttctactgaagtctttgcaatgtataatcttttcacttccattttcctacatactgtttctattggttccttgtattccacagactgtgttttagtatttataagtatagtgttccttttctatgtggaaaagggaaaatgtattggcctttttttaacatataaatgaacttcacaagcaacaatttttcaaatcagttttccctgttgtgaatctcgaagtgggtacatgatgcactttcccatttaaggtaaagtacacatttatcccttatctcagaacagtcagaagtcaggttcttattgtatggttagtaatgcaaatattgataaggtcatgtcaatacttagtatttagaagaattctgaaatagcacttgttactctgtaagttttatgcatttattactttttttgaattttttataatgttcccaaacttgactgccttacttctatctcttctggcctcaagt

SEQ ID NO: 247804 - DNA, 845 bp, Homo sapiens
aaaggtatctaaaatcagagatgatattttaacattgtggctggatataagataaatctgtgaacattagtagtaaaaccatatactagttataaccagctccaaaatacaatgaaaatgatttatatagatccatttacacactacttaccaaactaaacaactctcagaatcatattagtccggataagctatgttttgctgcagtaacaaccctaaatttcagtggcttagctgagtgtggttgtgtgcacctgtactaccaactactcaggaggctgagacaggaggattgcttgagcccaggagttccaggctgtagtggtgatgatcacgtctgtgcatagccactgtactctagcctgggcaacatagtgagaccctgtcccttaaaaaaatgttagtagttatgctacacatacattgtgggtgggatagtaggttttctatccagtgattatctctactctctagaagattgccagtctccttggcagatggaaagagagactggggaattgcatgttggctcttaaacttgttctctgaaagcaacagatcctttttattcatattccattggttaagatcacatggtcaatcacttggacacacttatctttcaaagggccaagggtgtacagttcaactttgtacctgagaagagaactgaaaatatttcatgaatagcactaataattgtagcagtattgaaatataaaaatgaaaaccaaaaaagcacaaggaaaagattaatacatgtgactataaagggtataatctctgaattatattgaaagcataaatgaacagttctaaacatggaagtctttagatcagtatga

SEQ ID NO: 247805 - DNA, 742 bp, Homo sapiens
tttttttccagaaattgttgtttatttgtgccttttaacatatttctcactggatactgaaggcaggaggtccattcttctcagtttgtctacctttaatgttaatgattataactcttgagttattttggattgtatacagacagagtggacacgaggctatttgtagataagtgaacattgaaagtggtcacatgtaattattaaatgtttttctttaccttcaggtctttccagctaaagtaattcattgatgttttcaatctttcatccccaaaccctgtgttgagtgcctgtcataagcagagttgggagtatgtcactcatcaaatccattgccactgccctcaattagaagcagtgcttggttcagatttccagtatattctgtgtgcggctgccatgggaatcctcgttcaagctttcatcatatcagcctcctagtagaagatttcaaacacttttccttgcttatgagataatattccaagctgcttgtttggaattcaaggatctcatgtcaccctgatttacttcagcctaagatgactgaattgacactttgcattattgcactccaataatgtttaagtcctaacgtctaatactaagaaaaactggctaattaaatgctgctgatagtgtttctatttctacatttttgttttggtaaaaatattttagtgagacttatggttacataaagcttctgcttttcaaataaagaagtttgaaaaactga

SEQ ID NO: 247806 - DNA, 559 bp, Homo sapiens
atcctatagttcatactccatgattcttgcgggaggtctttgtagacagaagctttactaaaagataaaagcagtaggagatcgttaaaactcagcagttgatcaaactctttctgaaacctaggcttagaagccaagcagagatatgaacatgggaaagtaattaatctattacagtctttcatgataattttcactttctcaaactgttgaagtaaataattgttgggtacctatttactctaaccaaatattaacctttttattcttttcagcttttaagtactgcccattccacttctatattttgatccctcaatcagatagctaatttaattccagcattagttatgcagattttattccactggaccaaagcaatatactgtgttcctcttcccatttaattttattttaaaactttgcttgcagagctgaaagatttcttagagttttcatggggctggggttctggctgcttgcttctagattgtatcaaagcagctctgccttttttctgatttatttgttggactactccatgagattttgtctgaaa

SEQ ID NO: 247807 - DNA, 176 bp, Homo sapiens
ctagtttcttctcctagtttcaacagtaagataaatcattcccacctaggggagagaatgaagtctggaatcactaatagtgttataccctgggaatgtaagttccctcatgcaacatgagggggaggaataagatttccaccagataaataaataaatagtctgtggtgcaccca

SEQ ID NO: 247808 - DNA, 484 bp, Homo sapiens
atcatattcaactattcaccaaaccagtatcaactctattaataatcctaataataaggcccctcaaatatcagtacttggccctcatgtttcaggatactcctcaatagctatcactggagtataaccaaaaataaccattataccacccaagtaaataaaaaagactattaaccccatgaaagccccaccaaaattcaacacaataccacaacccacagcaccactaataattacccctaagcctcaataaataggagacagttttgaagaaaaacctacaatccctataaataagacaacacttaatagaaataaagcatatgccattttcccacgtggactataaccatgactataagacctaaaaaaaaaaagttaaatgtaagacttaaaagacttaaatgttcactgttactgtaaatatagaaatggcaaactattaaataacaacaataaagtttgaagtctgtgctctaaaatt

SEQ ID NO: 247809 - DNA, 321 bp, Homo sapiens
gcaatcataggcatgagagtaagtgtgcaaccagcctccagatagggagtcgctgcaaacatttatagacatttttggattggggaaaagtgtgtagaaatgtatgcataaagtacttatgtaatagggtatacacaatcagtttaaaaacactaaacacttgtcaaaatggcagttaaatttttttcagaattaaatgaaaatgatggaacaagaatcaggaaagtaattacccagaaaaaaaaaatgtttcttggatttgtaattacagttaattgctatgaaacaccatgttgatttgaaaagctgttaactaaattg

SEQ ID NO: 247810 - DNA, 476 bp, Homo sapiens
ccatctgaagatttgcctgagactgaaggatccacttctgcgacgactccctcaggacttataatgcagatggaaccagattgagaaaaaccagccaaccaaccaaccaacatgatggctgaaccagacaagagaagtcccgaagtaaaatacccaccaattaccagaatctgtgcctgccatacatcgaagtctctgacttctttattccacatgactctgcaaatctacgtctgaacttatattctcctgaaaccagaacggatgaaactcattagatgctccagcctgggggattaatgtttaccttgatttaatgtctcatcagaagcatgacatccacagcactctggctgcagcaggattaaatgaagcatggccgtttcttcaagagagacttaaacttcaagcctttagccctagagggaatgggcaggagatgaagagagagtaaaaatctattgaactaccaatga

SEQ ID NO: 247811 - DNA, 426 bp, Homo sapiens
ttacataaaagtttacccagatttacctagattctagcttgtgctttttcctccaacagttgctgatggggagaggaaaaaatagccactattcaggttccctgtgagttaactgctgctgtacaaaggcaggtgtaatattttctctgtattaaaggtgaggagaaatggcccagtgccctaaacatttatctatggccccgataagctaaaaactcctaaatcttcccatgcaattgttgtaatctcttgctttccacagttccactggttcttccttgggattttcccaaccacaaccctccttaagaccttaaagatactttaacctagcttaggcctgacatggacagatttccttttctgctagcacagtccagataagattagtttaaaaaaaaacaaactatattatgaatccgtggt

SEQ ID NO: 247812 - DNA, 609 bp, Homo sapiens
tcgaccatgccccttcgttccagctgcttgctgataggctggcccaggcgggatccatccttctgatcgccaggtcctgatgaggctggtgccaccactacatccattccagggagactcccagtctctgtcagtttcttctgcttttctgaattctaaactcactctgatctgatttcattatttgtctgttgtggtagctttggtgaagttggaccacaaataatgatatagaagaaaaaatgaaccttttttcttctttcctgtgtccttttatcaggtatcatttcctctataaaactaattttaagttgatagagtcttaggtctatagccactgttgaatgcacctaatcaggccatctccttgaactagagaatgtttgcatcataggatagataccaggttccctgagaggtgggtaccaggtgcctgggaagtgaagtaacttgccaagaacagagagccagggagtgacattgcaggcatttaagcctaggcagtctgagtcccgaaaacaagtcaagacatttattgtctttccatttcttacccatgttcttactgttttgcctggactcctcttttaatctcagtgaaaaaaaaaa

SEQ ID NO: 247813 - DNA, 2085 bp, Homo sapiens
tcgacaccacgtccacgccagtcctcagctccaggagctgggcgggatccctcatcccgctcagctgggagatgccccgggagggcgtcccccggctccgggcggcgagggtagtagccgaccccaatccactccgggggccgccgggggccgcgtgaaggcaggtgttccggggagaaacgtggaagggaggcgcggcctggggccggtggcgctcggctgggggccgcagttggctcccctgggggctctgggcggcggcagctcccgcctgtggggaggagaaggagccggatgggcgggttcaggcgcgcgcggcggcggtcccggggccgccggctcctccccgcgagggtgcctgtccgccgctcgccgcgctgaggcagtgcggggcgggcgcgcctaggctgccgcccagcgccctcgccgcggccatgcccgggccctagagcgcctgccgcagcttgcgccccgcagccccgcagccccgcgcccgccgccgcctcttcaatgggcaacctgctcggcggggtcagcttccgcgagcccaccaccgtggaggactgcgactccacctggcagaccgactcggagcccgagcccgaagaaccagggccgggcggcggcagcgagggcccggggcaggagtccgagcagcccgcgcagcccccggagcaagccggcgggcggcccggcgccagccccgcgccggacgaggacgccgaggcggcgggcgccgagcagggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgt

SEQ ID NO: 247814 - DNA, 1224 bp, Homo sapiens
cggcacgaggagaagtttttcataatctcctttccatttacttagaacttcttcaatgtaaacaccatctggcctaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgt

SEQ ID NO: 247815 - DNA, 1173 bp, Homo sapiens
tgtttatcgatgccaccactccaccaactggccattccatctctctccctctccttgggcctccctattccctcggataccaccatattaaaattaggcccactgaataacccttccctgacctataagtgttcaagtgaaaggaagagtcacacgtttctcactttaaacgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgtaatgcttttaggatgtgaattttcaaattttgtatataataattactttgagaatattttcagagtatctagaaattaccatgtagtatttggtatacaaaatacattcttttgagacattatagtctacatgaaggaaatcaagaggataatttcattggattgctacacttttacctgatttatggctttattttactttattttattttattattattttttgagacggagtctctgttgcccaggctggagtgcagtggcatgatctcggctcactgcaacctctgcctcctggactcaaacgattctcctgcctcagcctcctgagtagctgggattacaggcgtgtgccaccacgcctggctaattt

SEQ ID NO: 247816 - DNA, 1122 bp, Homo sapiens
tcgacaccacgtccacgccagtcctcagctccaggagctgggcgggatccctcatcccgctcagctgggagatgccccgggagggcgtcccccggctccgggcggcgagggtagtagccgaccccaatccactccgggggccgccgggggccgcgtgaaggcaggtgttccggggagaaacgtggaagggaggcgcggcctggggccggtggcgctcggctgggggccgcagttggctcccctgggggctctgggcggcggcagctcccgcctgtggggaggagaaggagccggatgggcgggttcaggcgcgcgcggcggcggtcccggggccgccggctcctccccgcgagggtgcctgtccgccgctcgccgcgctgaggcagtgcggggcgggcgcgcctaggctgccgcccagcgccctcgccgcggccatgcccgggccctagagcgcctgccgcagcttgcgccccgcagccccgcagccccgcgcccgccgccgcctcttcaatgggcaacctgctcggcggggtcagcttccgcgagcccaccaccgtggaggactgcgactccacctggcagaccgactcggagcccgagcccgaagaaccagggccgggcggcggcagcgagggcccggggcaggagtccgagcagcccgcgcagcccccggagcaagccggcgggcggcccggcgccagccccgcgccggacgaggacgccgaggcggcgggcgccgagcaggtacgcggcccagcggtggcctcgggtcgggctggggcgccccgacaccccagaggggcaagtgccaagccgccctcgcgctcggaggccaggggcgccaggtggctgctcgccgctgcgacccgacccctccgcgccgcggctgacctgtctcccggtggagcccgggggcctgcaggagcccaaagcgccggaccctcccactgccggcctggggcctggccgagggcacggcgaggaagtccctcaaggcagaacccaacttgaatgggtgttttctttgcctctgcagagcagctggattatgcgaaggtggggtgggaggaacctgtctaaaaatagaggattttgacaacccctctagtgtgtgttattggt

SEQ ID NO: 247817 - DNA, 2000 bp, Homo sapiens
agaaaagaaggaaacaaagtatgggcaattctttggtggtgatttgctataaaaaaggagtagatatatggatctgtaattgatggtaggcctgggtcaaggaatgttttgtatgtttattttaagattaaagatactacagcatgtttgtttgagatcgagaagagagggaaattttgatgatccaggaaagaggaacaatattgaacaacagaatccttgtctgagcaggtgaaaggggtctgggtagagagtccaaagggaataggggttggaagagcaggagcagatgctggcaggacacagacattcttatgataatcctgagaaataggtagggcttgagtcattatctttatttcagagatgataaaactaagattcagctaaatgatttgcttaaggcctcacaaatacaagtaagcagcgttcagattgctagtcttctgactccaagtcttgggctactgatactacaccaaggtttccatatatccttcattttttagtgtgactgagattgattcagacctggacttgggacccagagcctgggattcttgttcttgcactgtcactggactctgggtggtgtgcaacttctctaagcccctgatatcttgtttctaagatggaaacacttattaactgtcaatcagggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgt

SEQ ID NO: 247818 - DNA, 2458 bp, Homo sapiens
tcgacaccacgtccacgccagtcctcagctccaggagctgggcgggatccctcatcccgctcagctgggagatgccccgggagggcgtcccccggctccgggcggcgagggtagtagccgaccccaatccactccgggggccgccgggggccgcgtgaaggcaggtgttccggggagaaacgtggaagggaggcgcggcctggggccggtggcgctcggctgggggccgcagttggctcccctgggggctctgggcggcggcagctcccgcctgtggggaggagaaggagccggatgggcgggttcaggcgcgcgcggcggcggtcccggggccgccggctcctccccgcgagggtgcctgtccgccgctcgccgcgctgaggcagtgcggggcgggcgcgcctaggctgccgcccagcgccctcgccgcggccatgcccgggccctagagcgcctgccgcagcttgcgccccgcagccccgcagccccgcgcccgccgccgcctcttcaatgggcaacctgctcggcggggtcagcttccgcgagcccaccaccgtggaggactgcgactccacctggcagaccgactcggagcccgagcccgaagaaccagggccgggcggcggcagcgagggcccggggcaggagtccgagcagcccgcgcagcccccggagcaagccggcgggcggcccggcgccagccccgcgccggacgaggacgccgaggcggcgggcgccgagcagggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgtaatgcttttaggatgtgaattttcaaattttgtatataataattactttgagaatattttcagagtatctagaaattaccatgtagtatttggtatacaaaatacattcttttgagacattatagtctacatgaaggaaatcaagaggataatttcattggattgctacacttttacctgatttatggctttattttactttattttattttattattattttttgagacggagtctctgttgcccaggctggagtgcagtggcatgatctcggctcactgcaacctctgcctcctggactcaaacgattctcctgcctcagcctcctgagtagctgggattacaggcgtgtgccaccacgcctggctaattt

SEQ ID NO: 247819 - DNA, 298 bp, Homo sapiens
tgcagaacttattgtgtcaatctcctggttacggcccctccatggctccccacctgacataggagacccttcacaatctggcttctgtcactcataacttgtctccagccttcattcttcagtctgattttatggttttctagttccccaatacaccacaccagtgtttatgaaaccctagtcattggcctacgaactttatgattattgacatattcatgtaccacctgtattattttttgcatagtgtttatttttaattgactacatttttaactacaataaagtaatttcaact

SEQ ID NO: 247820 - DNA, 777 bp, Homo sapiens
aaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacatccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactcccc

SEQ ID NO: 247821 - DNA, 481 bp, Homo sapiens
gagggggaggttgcagtgagctgagatccctccactgcactccagcttgggcttcagagtgagactccatctcaaaaaaaaaaaaaaagaaaagaaaagagtcttagctggatgaccttctgtttcctcattataaaatgggcagaaaaccctctttggaggctgctgtatcagacatcatatgttcaagtggctggcatagagcctggtccatgatgggcactcaacttttaattatcataattattatataatgcatcccaaagccagtgcagtggtgtgtatctgtagtctcaggtacttaggaggctgaggtgggaggatcactggagtcctggagttcttcctaagttctcaaataggggaataacaccaagcctgaaaggaagaaattgatggacagagaagcagctcatggatcctgagcatgtgggtgctggtgaggatgtagggtgtggcatcgaaaaggctggcactaatt

SEQ ID NO: 247822 - DNA, 358 bp, Homo sapiens
ctgctctatagtgctgttgcttaaaaagtcatctgtgaagaaaaccagagggagaaatttcacctgccaaagtggataaagaggactgtgcttgcagcaagaaatattgagggatgaggtactaccttcactcagataaagaacttgcttgcttcagcttgttgtaaaatggcaagttccccaagctgtgggttctataagtgttcctctgttgtgaagcaacccatggcctatgcaagtatccacctgagtcctctgcattggacttgggaggaggcaaggagaactaatataaacatgatgctcatgctacttgctgtgctatgaataataaattcctttgtctctaaatctcaaa

SEQ ID NO: 247823 - DNA, 519 bp, Homo sapiens
aaacgttggagaaaatctttgtgaccttggattatgcaatgatttcttagagatgacaccagcaaaatttcataacagtaaaatttgatcaattggactttagaaaatttaagaatttctgctcttcagaagatactattaagagaataaaaatacaaaccactgggagaaaatattttgcaaattatacaacaaaagatttgtatctagactttacacagaactcttaaaactctgtactaaaaaagcaaggagccaagataaaaaagatgggcaaaagatttgaacagacccaagaagatatacagatgacaagtaagcacacgataagatgttcgatgtcattgaaatgcaaatcaaaccagagtgaattacatctctattagaatggctagaattaaaaagtctgaccaggtgttggctaggatattaagtaactacaattcttatacactgctggtggaaatgtaaaatggtacagctactttggcaaacaatttttgccctttcaaaaagtta

SEQ ID NO: 247824 - DNA, 389 bp, Homo sapiens
tagcaggaaaaaaagatgaatgaaccaggagagagagaacatgtttttaaaatggcgcaaatgcaccccatctcccccgattcctgctggctgggcaagatggggaaatggcgcaaatgcaccccatctcccccatctccccatcttgcccaggaactccaagacatcaagatttcacgatttttaagacgtcaagatgctagcatgctaacaccatcacggttctagaactttaaaggtgtcaagattctaaagccttctggattctagaatcctgtagatgtcagcattctaaagtaccatcaggttctttatttactggattcattagttccaggattctatgagcctggtgtttagcctaaaaaataaagataaattaaaattga

SEQ ID NO: 247825 - DNA, 708 bp, Homo sapiens
gaaggagatcacgttctttgcagggacatggatgaagctgaaagccatcatcttcagcaaactaaagcaggaacagaaaaccaaacccctcatattctcacttataagtaggagctgaacaatgagaacacatggacacagggagggaacaacagtcactgggccttttttggggaggatggtgtggggagaacattagagaaaagagataatggatgctaggcttaatacttaggtgatgggttgataggtgcagcaaaccaccatgacacacgtttacctacgtaacaaatttgcacatcctgcacatgtatcgcagaacatcataaaataaagtaaatctacattgaacttaaaaacaaactctccaacctcattgtcccaccatccccctcccccagtctcctgctagagcttctcgtcctcttcgtggctgaatgaggaagacagaaaggagggaagtcctttgatttagttcacattggtcggcctcccagggcacagaggcagggagaagtagggcagagggtggatctgaggggcaacacagacatgtatccggtccagtgaatgatactgcgtctgaataacaaatggccatgtatggacaggtcactcctgaatggacaaatggccagccaggacagtttaattttactctgtggctaatagagagtcagataaaatgttggcacaggaactgacatg

SEQ ID NO: 247826 - DNA, 486 bp, Homo sapiens
  misc_feature (137)..(137): n is a, c, g, or t
cagtacagtctggtgagacatcaccactattcgcatttacagggcaaacctggctttattgtcggtcattaagaacccataagttgtcgtgaacttcacctcgtgtggatatacctaataagcactctaaatacatngaaactctccaacctcattgtcccaccatccccctcccccagtctcctgctagagcttctcgtcctcttcgtggctgaatgaggaagacagaaaggagggaagtcctttgatttagttcacattggtcggcctcccagggcacagaggcagggagaagtagggcagagggtggatctgaggggcaacacagacatgtatccggtccagtgaatgatactgcgtctgaataacaaatggccatgtatggacaggtcactcctgaatggacaaatggccagccaggacagtttaattttactctgtggctaatagagagtcagataaaatgttggcacaggaactgacatg

SEQ ID NO: 247827 - DNA, 398 bp, Homo sapiens
gtatgtctgtatcattgtgcaattgcctgtgtcatcatttatttatccaacctgggttaatgtctttgctattatgaatagtgctggactgagaattttctaaacacagctgtgtgcattttcctcttcttgcgatttagaagtttaactgctgtattcaaggtactgtaatgtattcgttctgtgcttgcttggagacttgccgactctgtgtgtctcagctcataccctcttccttccccagtagaagtaaccacaactgtgtttatgtgatcatcgttttcttaattttccttgtagtttttccaggggaaagtttatcccttaagaagacagttcattttgcctggtgtaaattttatttagaagaaatcacattaaaagtattttttgggctt

SEQ ID NO: 247828 - DNA, 429 bp, Homo sapiens
ccccctaaatgcttttctcacttggagcagcccaaaatgtagctatagagaggatgtcagtttccaaaaggaaaaaaacaaaacaaggattgggaggctctatgcttagtcattttcgtttctgaggctatcgctatcggccagccgggctcggcgccagggccgccgtaatcatgattttattctacactcccaacaactggccagaaacgttgattgctccgacttcaggtgacacctgtgaggtcccgtgagtccaaattgcctgtggtcacgcggctaaagagacgtcagtgcagtcagagagggactccagcttgggcccaagggactgcacagccctccgcctccctctccacttgccaagagggccctgtgcctgcggccctgagggccagtgtccgtccccaaggagcgaggatggagccc

SEQ ID NO: 247829 - DNA, 354 bp, Homo sapiens
ttctctctcacttatacgatatacttcaaggacgtgaacagttacaatacccagtctttcttacctgttgtcttgcctgtggggtcactcactcaattttattttaaaattactgaataactacttcatgccaggccctgcaccaggctctgtgagaggacaagaaggattattgcctcttgtaggagaaaacagatgtgcatatcattaattatgatggggtatgataagtattacaatgacaaaagctatgaataaagtgctacaaggaacagaagcagggataattaaatccatttcagtggaatctatttcaatgtacaatagtctcccctaatctgcagatatgggaag

SEQ ID NO: 247830 - DNA, 487 bp, Homo sapiens
ttatttaacaaatattgctgcgtgcctggtagagaccaggtgtatgcttggctctagggatacagcagaaagcagagcagacagaactctctgtcttcatggtgctcatgtccttgttggggatggtagagacacatcataaacaaataaagcgtatagtgtatcagatggtgatgaacagtatggaggaatgagctagagaagggtgtaggggacagtaggcaacgattacacattgaagtcagttgatcttggaagtcttctctgaggtgaccttgggccaagatcaggctgaggaagagaagacttggagcagcagaggtgaggtcctgcagttttgaggaactcactgaggttagggactcttctcatgccattcagctagggaatggctgataataaatgtatgctttatagtctttactcactctccatgttcttggtttaaaagatgcctgaatcccccctcccccccaccaaaaaaaag

SEQ ID NO: 247831 - DNA, 234 bp, Homo sapiens
gagaatctagattttgattgtttgtatttgatgggattttcaaattacttttaaaagtaagtcataagtgccagcctgaattagagggggaggactctctagggactcaggctgtgttttgagaaatgtgcttgggagcacagtgcaccttatccccagaaaggaaaagtgcccttgaagattacaagcaacaatttctatcttgcctccaacatgaccagaatagggtggagc

SEQ ID NO: 247832 - DNA, 478 bp, Homo sapiens
tcagattcttgataacctgttttaccaccctgggcggttgtcagctaaatagcctaaatttgcatattaaaggaagctgttcatgtgaaagtcaaatagcaaaatttacatggtaagatgcagagagaaaaagtttggattatataatttataaaggccttttaaatatatacatacacacgtacacacacacacacgaagttcctacagcttttacttcagaacttttagccatgagataaatacaaatttaccagcttgcaaaaagaacttcttgggtctaaacagtggtttttatcttaatggaaatataacagcagatttagagcaggcagaaaagaaaaaacagagaaaaataggacttaggaactccatagtttgcaggtcgaccttagggctcttttttcttaatgtaaatgtgcacaaagaccatattatttccattttacataaactttggctagtagaggtgccataa

SEQ ID NO: 247833 - DNA, 424 bp, Homo sapiens
gctttccacatgatttttcccccctctggacttaagaaaacaatgggcaagtcagctcatgaagaacttttcagatattcagactattattctgagagagaaaatattggcagagaacagatgggatttttctcaaggaaaagaaatggaaatcctacatcttgcaagaaatagaaaaaaataaataaactgtttgaagaagaatcacatcaggctggcaggagagagcctgcggctcggtgtctgacccagaatgttaaagccagcctggcttggctccaggataaaggacactctgtcagcctctccacattgattcatctccccagccccaagatcaggagagcattctgttccttgaagcattttatgactgtaagtcagaagtgctgcagttttaataaaaagctgtattgtcctgatc

SEQ ID NO: 247834 - DNA, 248 bp, Homo sapiens
tatatcaccccaaattttcaggtctagttggaagcaaccattaggcaaggcgaaaaacagtagaacatcaatatagcgtgcctcagttaaatattttttgaactgtttttgcactgcagaagtgtttgttgaatagctaacagaatctaagttgagaagtaaactttaagaaattggactaatattgtgatttttgatattattggtcagaatcatttcccatttctcattataatagttaaagcaag

SEQ ID NO: 247835 - DNA, 422 bp, Homo sapiens
gaggcagctatacttcccaaaagatctggggtctttctcacgagctcataccctctgctggcctagaccctttatattcccccctcggtgctgaggcaaacgatctttgccagcagggaggtctgaaaggcttaactttgtacactctgaggcaaattctccagaagtaatgttgcattttctccctgccaccaggcacattcccttcccaaggtctagatcagcaggtggccctcccagcgaaagctctgtgtcctatgatccgaaacaataaagctgtgcttgggtacgtgagattatgtttacgatgatggtcatcactccagccctaggaagtttgagaaactgaaaaataagcttagcaggctgcctaggttctgcggaatcagcaggcccccgctgtgaccaatcaagagcggccg

SEQ ID NO: 247836 - DNA, 573 bp, Homo sapiens
ataaaaatagtttgaagactttaactacataactaaaaaaagtataaaggaatttgatgtgtgctgggcagaaggtggggggcacaaaaagtaatatgtggacacatttagtcacaaacaaatccaaaatataggcatgaaaactgtttattaattcctcgctgcatgacagaagtggcttaatatactctttccagaccaaagcatctttatctgcaaaatgagaggattaaattaggttatctctaagttcatttaaaattgttttaaaacaatctatgtagataaacagagtagcagtctgcaatgtatttaaaaggaaatggactagtcaagttggcaagatctatgtgaaagaattattgttgtgctatataaaaaaagaatctgcctttttaaataagacgagtaatgacaaattaattttcatgcaggttgaaaatgtggcagatgtgtatggagaatgagaaaattcctgttataatagagatgacttaaattatgaggatggtaaagaagagggaatgttttctgtcctttcaagatgtcaaagcttaattgaacatgttttta

SEQ ID NO: 247837 - DNA, 350 bp, Homo sapiens
gcagcagctgaccctgtcctggacattttctcctgactttatgagactctagtgcagaggttgcaaactcagatgctcacagccaccaggcagggaacaagaggggcacagttggcctaatgggggccgtgtctgtcttgaaagcagctgcccctcctgaaggcggcggctcacagtggcggaactccctccgactcctccccaccccctccccacaggtcaggaacacggggagactacagctagctcttcatatttttttttgtttgtcttttgaggagaatccagagatctcgatttcagtgtgaaatatcttgattccggcacattagcaattgagaacatgtttt

SEQ ID NO: 247838 - DNA, 457 bp, Homo sapiens
taattatgtgattcctctccatagcctcaataataaagagatctcaagttggaatgtatagttctatttttcataagtatcatttaaaaaccgatttataaaccctatgacttatgaaatatttgtgaacaaaacacccaatgccactggaataattcaaatgaaagagggtcttacattgagcaatttgtcagtttaatacctgccctttacaattgctctgcggttgaccctttagtcgtattttgagttagcagatgaaaataaggtttcccttgaagtagtggttgctaagggcaactggtactgacgccgaagacgaatactctatctccttagtataatgcctactttgtgagctaaataaagagctaaattgtagagaagaaagttgtacaaatgtgaaatatcaagaaaggaatagaaacaggaatattagagatgggaaaataagaaa

SEQ ID NO: 247839 - DNA, 549 bp, Homo sapiens
acactcaactgtttttttaaagttccctctggggtttgtgactgctggcagtggctgcctagctttctggtaaaggagtgtagttagtggcaggtggctgtaccaatccagatggaggtgaaagaagctgagctgcagccacggtcagtacagtggtggcagctggactggccatttctgctgcaggttttgcaagtcaggaagcacatatagcctgaagtaaaacaggattttcaaagtctaccaaaatctgccttcagcggtggctattagagaggtgggcttgaactaaaaaggacaaaatgggaagcagcaatactacctctaagccttactgccattaaaggaaaaataagagatgctcagtaacaaatatgatcttaaatcgcccaaagaaggatctccttatatagcaacccaaatcaatgaagctaaggatttactacgtcaagctcaaaaatgaaatcaatgtatgatgaattttaggttcctactactttttatgtgtatgagtatcaactttctataaaatgcctcagagctacaact

SEQ ID NO: 247840 - DNA, 491 bp, Homo sapiens
tgcccagttccctcccctggctctggcctcggccctgaactctgccaggaaggcactcagatctcaggtggagactgccgagctctgaggccacaacaaagagctctctgcagaatgtgggccacagaatgaaaggcaggcaggcatcttaaccattcggcagggcctggcaggaagatgccggtgacaccgtagcctgtgagccgcactcagggacagtgggaagtggccagagcagatagagtggagctttggcaccagccgaagcccttgatgtggtccgtgccccaccagcgtgaattacccttgagtgcccctgcccctgggctcagcttcccagctcccaggactggcctcatcttccctgggtccctgagcacctaggtcatagtagaacattcaatttgtagttcaagctaaataataccaattattattatcgttactgtaactagcaatcttcatgggtcaagccttacttggcggccagg

SEQ ID NO: 247841 - DNA, 363 bp, Homo sapiens
cttcaaggtgtagtatttttatttggtaagtaaaaacctttattctacatgcaaatattttacttaaatattatctttaaatgtatgatatttttagttgttaattgttttcaaactaaacaatgaatcagaaaaaatgatcattcctggtaactaaaggattattactgaaaataatgttgcagcatgtcctcctctgtaccaccagtgctcactttattcacaaccctcctaccaccaagagccaaatcttgttcaatgtggaggcaatttcacatctcagtgttccaaacagacagtcacggtgttcataaatccagcgagcaccatcgctatggcatgctggaagataaaaggcaagaa

SEQ ID NO: 247842 - DNA, 168 bp, Homo sapiens
ccagaattgttccagaagagaatagagctattgattaaatttagtatttaagtcaattacttatgttacacatttaaagaatagaaatagtatgtataatttccagaactatagagagataaataagcaaataagaaaacttaatccatttagagggtagaaatgaaa

SEQ ID NO: 247843 - DNA, 285 bp, Homo sapiens
cttttctaactgtgggccagacatttctgggcagatgtttgttcctcactgactcacattccacacctagttcagctcgcccacctccaagctgtccgggtgggacgcgggaaaccctctgctcctgcgcttagcgttcgcaaaggtaaacacatcgcagaaacctgcctcccaccctggagtggcccgtggtcctcgcagacacgcgacaggcaggccagtgagaagcgccaacagccctggttcccaaactccttagctcctcagcgaaggagcacccacggc

SEQ ID NO: 247844 - DNA, 836 bp, Homo sapiens
ctatgaggtaggaactgtgatgatttccagtttacaggtgaagcagttacagcaccaataggttagataagttgcccaaggccatggccctgtcagcagcagggcagagtttggagccgaggaagtccagccctagatctagggaagatgccgaccctctatcccacctgagaacagcagaagcttgggactctctcctggctgtcggtcatctccattaaaaccaacaaatccaacgtttcctccaccattctcagcatggagaggtttggggttctctttggaaatcagcaggcaatgtttgttctggatcagtcaggccagcccagatttctttcagttgaatacatatcttcaaccccctttggggaaaaaaaagcagtggagaaaatctggtttctgagtcagtgtttgtgaaatctgcatgttcccttggtataaattgggctttggactgactttttggtttaatcaaatgtctacttcctgggctgagtgtgtgtgcgtgcgcttgcgcgcgtgtgcatgcgtgtgtgtgtgtgtgtgtgtgtgtgtgtgtgttgcataaaaagaccttccttcagattttcctgaatccagcaaataatatgatggtggaaatgagaaagttttgtatttcacgtcctcacattctgggccaccagctgccttagaaccacactggtgacactggtgatgtactattttccttagagatttttagcatcagaagagtgcctcaagttcacattttccaaaagcttccatcctcctcataaccattatttggcttcaaattacctcagtcaataaaattactatcgttggttcgcaaa

SEQ ID NO: 247845 - DNA, 593 bp, Homo sapiens
accgaggcgaaggcacctgaaattttcccagtgcccgggaaattttaacagaagcctgttaaccccagctgagcttcgtggagtaggcgctagctctgggccacagcagaggacgcctccgggctctcttgtttgaattcctccaccaatgtccggttcttctactctttacaagctgggctccgaaggaaaaaagaagaaacaaagaacgcacgctccttggcaccaacttcactttctcaggcttctgcaggtcccaggcctcccgatgtctccccctccgccctgagcatttccagaccttggagagcctgacttgggaaggggaaactggaatcaatcggttgaccgacccccttttcccaaccgccgcctccccaccaatcactccatgtccggaagggggctgggggctcccgactataggagactctgggagtcctatgaggcctttgagacaggggcgcgagcgaggctggaaggaaaggctgggcagagagcggaggggctcgcgcgcatctctcccggcgcggcagaaggttggcactgctgcccccctgcgggtcccagagccgctgggcgcccgcggccgc

SEQ ID NO: 247846 - DNA, 962 bp, Homo sapiens
ttgtgatatgatgtaaaatatctttggtcttttttcctggttcctatcatagcttctaaaacccctagaatttcctgggtgataggaacatctttgttattcataatgagctcctttaataactccagcatttatactaataaggtgacttagtgtgggggccctagttagtctcaggataggaccagtcaccagaaagaccaagtgattagaggattggaactttcaaccctaccctccaacctccaaggaggggagggagggtgttgctgaacatcaagctctataaacactcaaacaagagttgatgagctttgggactgctaaacactaggagacgccaggagggtggctcacctagacacggcgtggaagctctgcaaccgctctgccataccttgccctgtgcatctcttcgtctggctgtttatctgtatcctttgtaatatcgtttgtactaaactggtaaaacagttaataagctggtaaatgtttccctgaattccatgagccatcccagcaaattaatcaaatcccagcagaaagttgagggaatctcagtttatagccggttggtgaaaaataaaggtggcccagacttgcaattggcctctgaagtgagagcagttttgtgggactgagcccacaaccactgggatctgatgctatatccaggtagatagaatcagaattggattctaggatacccagagagggtctgctggagaattgcttggtgtgtggggaaaaacacacatctggtctaagaagtgttctgtattgagtaaatagggagcagagagagtaggaaaaaacctttttttttccttttacactctgttattctctctggaaaactcactccagtacattatgagttgggtattagtagtgagttcatatgtaattttttttgtggttttttttccccattgaaaataaactatttttgcaactagaaa

SEQ ID NO: 247847 - DNA, 584 bp, Homo sapiens
gatactgtcagttgaggattcatttgcaaattaaatgagacattgcatacacagcacagcacagtgcttgttttattgtaactactaaaaaaggttgggtattacagattcagcccatatttcagagaaaaaagaaatctatattttttcaagagattttttaaggatattcttgaatctcatttatgattttattgatcacttattggttcacccatttactcaaaaaatatttgacacctactatgtgtcaggtcgtagtcggtactatttgttggagggaagaggaaatacaccaaaatgaataacacagtttctgtccttaaaggagctcgctgctcagtggaagagaaaagaactaaagaggcagatcagtgagaaaaatgtgcaatataacacattattaaaatgagaagagagagttaaacaatcaacatcattaactctgtggcatttccttaagatatcatgaattatgagacatccttttcttaacatcaggtaaaggaaaatctttcattaaatgtgtataatgattctgagtcccacgttagtttcagaaacatgaataaacaaagaaaaac

SEQ ID NO: 247848 - DNA, 357 bp, Homo sapiens
tcagaaaagaggaaaaagtgttgtaagcaggagctcagaagcactcaagaagccggatacagtggctcaagcctgtaatcccatcaactttgggaggccaaggtaggtggatcacttgaggtcaggagttcgagaccagcctagccaacgtagtgaaaccccgtgtctaataaaaacacaaaaattagctggacacatctataatcccagctactctggagtctgaggcaggagaatcgcttgaatccaggaggcgaaggttgcagtgagccgagattgagccactgcactccagcccctgggcaacagagtgagtgagactctgtctaaaagtaaaaaaaaaaaaaaaagagttga

SEQ ID NO: 247849 - DNA, 495 bp, Homo sapiens
aaaaaaacaacaaaaaaaacacctgatttacattgtttgtaatgctgattgcaacccattaagttgacttcatgacccactaatggattgtgactctaagtttgaaaatccctgatatacacagttatgcttaatccttacggcgggagttctcaccccgttagtcaggctcatagaggtagacaaacctggctaaagttgcagaggtgaaattctattttggaatttctgattgtggagccattgctttgtttggccatctcaaccagctgagtatctgcttttgctttatattatggctggtgacttggtgagtttgcccatttccaactaagcttcagaaacagagaaagggaaccagtttgggaaaagggtccagctacaatgaacactaccatttgtctcccacaaggtcagaatagccagaggactcttcccatatgaaataccccatattcttccttaatggcttatgtttatagcagatttcctgag

SEQ ID NO: 247850 - DNA, 327 bp, Homo sapiens
tattgagatggagtcttgctttgtcgccaggctagagtgcagtggtgcaatcttggctcactacaacctccgcctcctaggttcaagcaattctgcctcagcctcccgagtagctgggactataggcgtgtgccaccacagccagctaatttttgtatttttagtagagacggggtttcaccttgccaggatggcctatctcttgacctcgtgatctactcacctcggcgtcccaaagcgctgggattacaggcatgagccaccgcacccagccctacatttctttttctgtgaatgaactcttcatgtcctttgcccagtttttgt

SEQ ID NO: 247851 - DNA, 630 bp, Homo sapiens
agttggctttgggaaagggttccttgcctgcttcagggatccagacacctcctgcccaaccatcctccaaaacaatggaacaaaataataaaataaatgcagcttggtaaaagatacacagtaggctaactgcctgagatttttctaggcaataagtttaaagatccataaacagcatgattgatgggtacagaaccatgcatcatgagctccttatgatgaaagaaaccgttattgccaaaggaaaacttgacttagcacatgacaaagaattcaaatctactttcttgtctcttacaaaaataataggattataacatcaagaacacttcagttggccaggcgtgatggctcatgcccgtaatcccagcactgtgggaggtcaaggtgggcagatcacctgagttcaggagttcaagaccagcctgtccaacatggtgaaactctatctctactaagaatacaaaaaaaaaaaaaatgagctgggtgtggtggcacacacctgtaatcccagctacttgggaggctgaggcaggagaatcacttgaacctgggaggaggaggttgcagtgaatcaagatcacaccactgcactccagcctggacaacaagaatgaaactccatctcaa

SEQ ID NO: 247852 - DNA, 100 bp, Homo sapiens
tttccggaggatggtgagtatttctggtgggtggaggtttcctccacatggcaatgtggccggggcatggtctgcatcaagctggcttagtgtggagggt

SEQ ID NO: 247853 - DNA, 299 bp, Homo sapiens
ttaaaaattagctgggcataatggtaagtgtctgtgattgggaggctgaggcaggaggattgcctgagcccaggaggttgaagctgcagtgagctatgattacacctgcactccaacctgggcaacagaaccagactctgtctcaaacaaacgcactctcaataaatgtgttaacagcagagaagacattgaggaagaaagacgggtaaaggtggaagagatttttttaaaaagtattgcacagagagatgaagaaaagagataaatatggaagagcaacagagatgaaggacagaatg

SEQ ID NO: 247854 - DNA, 505 bp, Homo sapiens
tggggccatataaatgaaagaagaaaacaaaagctaacaacaaaaacagataacttagacagatgtagcacagatgtaccatatataaccctaaaggtgaaaaactcttaaaaagtagaaaggttacagagttttaaaaaaactgtatcttacccagtagttttaatttcagaagtttatttcctaaagaaattactcaaaaggaaacaaaagtaatttttttaactttttacaaaaacaacagtttttagctgtagtatttataataatgagaattttaggaactacttaagtgccagacaataagggaggtgctaaactgacatagcagcgcaacataggcctctgtaacagggtttcccctgtaacaaggttttcttaagtgtggttcctccctgtctggtgggtcactgaggtgattaagtggttcagagaggagcgtttgttttaatatgtattactaaagagaaagctctttttttttttaagtgagttagtttaaaga

SEQ ID NO: 247855 - DNA, 527 bp, Homo sapiens
gctcgacctcctgcctcgacctcccaaagtgctactattacaggtgggagtcactgcacctagcccagtccgtcaactttgaataatgtcagagtcactggtcttggggacctagaattgccctaaatctctccattttgacagtaaaatttcacatgaatactttaacaaggcttatcaatgcaaccacaggctgtctacgtgcattcaccaacaatcctctttccaccagtccttctgtttcagccttagtacacacacacaaaaaatttaatgttgccaaaggacttgagaaaatccagaatgttttcatacacacatgtcttgggatgtgctgcctatggaagaccttcctttgcctgtcccttctccttcatccttgactttgctgtccagctctttaagggacttgagcctgagagcacatggccagagagaggacagcccagggaggtggtgttatctcttgataacaccagaagagcagagagcaaaagtagaaccggaagtgtggtctggtttgtcga

SEQ ID NO: 247856 - DNA, 634 bp, Homo sapiens
gggaggctgaggcaaaaggattgagcccaggagttggaggctgcactgagctttgatggcaccactctactccagccttcgtaacaaagaccttgtctcctaaaaaaaagattgattctaggactgtagaatagatagttaaacagcatgggatatgagggaaatcctcagcagtattaattttgcattccaatttcatgttgatgagacatacgatggctttttgttttaaaagcttttatcttgagaacatgatgtctggagttaaaggtattggcatattccacacatctgtactattcttgagtgagatggcttaaggtgtcaaattgataacctggcagatccccacgaccgacagtataaaggaccctaaagtaaattggttgaagaaattagatcccaaagattcttggtgaattttgaagtcttcatcagtatatccacattaaaaggagacgacaggaagccaaagtaattatgggctgacaggacaactggatcagtttcattaaaaaggctaacttgaagataaatcttttgactccagctctttagaggatctaaagtgaccttgatggacagtggaagaaatcacaacatggaattccttgaataaaaatttattgacttt

SEQ ID NO: 247857 - DNA, 427 bp, Homo sapiens
gggaggctgaggcaaaaggattgagcccaggagttggaggctgcactgagctttgatggcaccactctactccagccttcgtaacaaagaccttgtctcctaaaaaaaagattgattctaggactgtagaatagatagttaaacagcatgggatatgagggaaatcctcagcagtattaattttgcattccaatttcatgttgatgagacatacgatggctttttgttttaaaagcttttatcttgagaacatgatgtctggagttaaaggtattggcatattccacacatctgtactattcttgagtgagatggcttaaggtgtcaaattgataacctggcagatccccacgaccgacagtataaaggaccctagcaatatcaacctaaccttccctctacacttaccatctgaagacagcatggg

SEQ ID NO: 247858 - DNA, 241 bp, Homo sapiens
cagatcaatggagacagggccctggtttttggaagtgacttgtaatgctgctggggcagatggagataacctcatctttaaattccatggaaaataaaatggcagatgctcctgagctgcagcccctcacagggcgaaagacgcacgtggcacctgcagccagtgtgatcccggcctcactggccgacgggcagctgctcacgtgagcgcgtatgagcctcactctgcagaagacgccaga

SEQ ID NO: 247859 - DNA, 686 bp, Homo sapiens
gtcccactctgttgcccaggctggagtgcagtggtgcaatcttggctcactgcaacctctgcctccaagttcaagcgattctcatgcttccgcctcccaagtagctgtgactacaggcatgcaccaccatgccgggctaactttttgtatttttagtagagatggggtttcgctatgtttgccaggctggtcttgaactcctgacctcaagtgatccaccgcgcctggcctaaaataacttagtcttgaaactcattgacagacttcttgtttgacctgtctcctttcttccctccactttctttctctctctccctccctcctttccatctatccatccctctatctgccactcatccaagcatctgtcattccctctgcctaaatatttaccaagtgtcttgtaagtgctaagcacagtgctgggccctagaatacagaagtggccagggcagtcatggtttctgctctcacagatcttacagtcaaatagtgaacaggcaactaagcaagaaatgcagcaccatatgacatgctaagtgccgtgatggcaaggtggactgtggccggagctcaaaagagaggggaccaggcgaatttgggggaggggaggagaggagcagcttcctaggaagtgacacctaagggcggagtagggcttgccaggtgagcatggattccagaga

SEQ ID NO: 247860 - DNA, 590 bp, Homo sapiens
gtaaatctgtttaataagtttcaattaatagagccagtatcatacagattttatctcactatctctagaaataaaatgaagttggtctccatataaaacaacataatttgggcttaattgtattcttttaaataaagtttatgtacataagtattaaataccaccctttattaaagtacaatttatataagataaactcttatttagcattatcaagtatttctgagacatttgttttaataacacatttgattaatagcattagcatacataggatgcatggattatgagtttgctaatttaaatacagtaattaaatgttatggtccaaccaagacattgtttcttctgtgtacggacccttattactatgatggagattttgaaatgctaggattaagacaaggcaactcttaagttgtgcaaaatgctaggattaagacaaggcaactctaagttgtgcaaaatgctaggattaagacaaggcaactctaaattgccttaatcctagcattttgtaaatttccactgctgcacactgaaggagaaagaaggtattgtagtaatacaaaatgttaaccctgaaaggg

SEQ ID NO: 247861 - DNA, 374 bp, Homo sapiens
tagtttctaccttgcctggctgatatatctacttatctctcagttcttagtttgaaaggtcacttctgaatgaggtgtaatggtcataggttctcaattagtggttgttattgggtctgttacagctgtgcagttggccaactttgactttgggtaacttaatttctttattggtaaaaaatactttttattttattaaagtcataaagaaaaatgagatattgggtaggcttaatgtcacaggaaaatattttgataaaagtcttcatagttacacgataggttcatgatcattgtggcaaacatgagcttatagcttccacttttttgttgttgtttgttgttgttgttgtttttcagacagggtgtctctc

SEQ ID NO: 247862 - DNA, 334 bp, Homo sapiens
tatgaatggaggagtagccttaattcccttgggggcttccacttctaagagaactgttttccgtccaggtaggcagacctgtcatggctgaagcttcatcacctggcctggtcatagcccccaggccctgtaggcaggacaggggcttggcagattggcatccttcccacaaaagcatgaaagtaggatgtctgtatgtagcgacaacaaatacaagaataaggagagtttaacaacattctcaaagttggtggaaaagaaaaagaatcaatgaaaacatcaccctaaaccagctagtgctttctgtttacagggatcagaccccttcccactt

SEQ ID NO: 247863 - DNA, 799 bp, Homo sapiens
ttatagaaaccacaattccttttccccaaagccagccataaaatctgaaaatattactctaatttttcttctgcttttctgtgtaaaaactggccataaagaaattatcttacctaccttgtttaactgaaggtcataagatcctcattccagagagggccctgccacatagccaaaaggaagaagtgcatgctcagacaggtcaagaagaatctagacagacaggcctttctgggtttccctactcaatctattagtattaggtcatatcccttttgtccagtcatatttcttcatgactgttcataccttgttgaacctaaggattaaaatggtcaattttccctgtgtctttggtcttcattctgaaggcttatgttggaaatgtggtgttcaaatttcatgtaaagctatgatcaaataaatttgtatgccttttctcctcttcatctgcctcttgtcagtaattttcacctaaccttcagagggctaagcggaagtgttctcttggctccaacagtactcagaacgtggttgagttgagagctatccaatcttccctgaagttttttgttggatgtctaaagtaccaaagagttgagacccgtccgtcagagatggccgcaaggccctgaagcacagaccatgagtttctctagctaccaacttcaagtgaaagaccagaagcaactagacatatgaggaatgtcacctcagagaccagaggaggcagaagaacctgttcaaacctgaccctttgtcccaatgcctcaggttggtatctagggatatctgatat

SEQ ID NO: 247864 - DNA, 551 bp, Homo sapiens
caaccgccattcataatgcctcctcgtttatctagaagttacccccctacccctgcactcttctgtcatactttgtttggttcatatgtttgattcaaatccaaatggcctgtatggattttatattttcttatattgtagatgtttatgtatacatctatatctaccatatactatagtaactactagaggacaacaaccgtatcataggcaactcttttatgtgcataatctctgcaggatacctttaccattactaatacttagcaaatgttcgtggaaggaaagcgttgcaagaggtagggaggcaggcatgctggctttttaaaatctaattttcatcaacctctaggtcagtggttcccaatactggttgtttatttgaatcactagggaattatttttaaagagcagtgccacacctaacacctatttgattcaaatctctgggaggtaggatcacagcatctatatgtatgttttaccatcatcaggattgctgagaatttggaagaaatggaaatttctgaaaccccttccctgaatttact

SEQ ID NO: 247865 - DNA, 464 bp, Homo sapiens
tttttttgatacagggtctcactctgtcacccaggctggagtgcagtggcgtgatcttggctcactgcaacctctgcctcccgggctcaagtgatcctcccaccccagcctcccaagtagctgggactacaagcatgtgtcgccacacccagttaatttttgtattttttgtagagacagggtttcaccatgtggcccaggctggtctcgaactcctaggctcaagcaatcagcccacctcagcctcccaaactgctgggattataggtgtgagccaccgcacccagccaattcttagttcattttaataaagactttccagtacctacatattcaaggcatttacattacaacacaatgagtactctttattctccttgcctgcctcattgttgtggttagtaaatttttagtaactatacattttctgatgagatctttgtaaattttgtatttatatcagt

SEQ ID NO: 247866 - DNA, 382 bp, Homo sapiens
aatctgtggattttgatatctgtggggatcctggaaccaatcccccttggtgtctgatatcacagatatcaaaacccacatatataacaagtgtgttatatatgcataataagtttggaaggatacacaccaaactgttaatagtgactacttccaaggagacaagtgaaattagaagttaggaataaaaacaggcttttacttttttaggctatgcttctgcattatttaaatattttcaatgagcattatttggtatcattaaaatatttttaaaagatattttaaataatatttttattttaatatctttcatgttttatgtaatatttttattttaaaatatttttaaaataatatattaaagattttttattagcta

SEQ ID NO: 247867 - DNA, 504 bp, Homo sapiens
gaagaggcgcagagccataaagtggtctgcagggaagttatttttcaatcaagttgggctttgcctcgctaatccttctcctccatgggggctgagtgcagaaaactcatctctgcataaagagaccccaggcctggctcgggtccttggacccaagtttagaacctgtgcctggagctatgagaataagtaaaaggaagggaatgtgtctcagaaaaccactaggctctgaggagctccagcactccaacaaaagagacagttgaacaatgggaagaggtgctgttcaccagcaaaggccccacaattctccctgtgacactgcatgttcccagaattacagccaatctttctaagacattgagaatatcatttttatgtgtgtgaccctgagcataaaattcctttacctttctgagcctcagtttcctcctctaataaatacaggttcctagttttcacactcaagggtatacaatgacctttttgattcagatgctaggt

SEQ ID NO: 247868 - DNA, 506 bp, Homo sapiens
ggaccccagggcatattgataaaaatgttttatgtcattttcatctgaccagtaatgtagttcaaattctcattataatctttttagggtatattttgttggtcccaattttctgaaagataagaaatctgaggattgaagagattcaataaactggcccagagtcagtggtaaatatcagtttcctaattccatgatccctgctttctccaggacactctcccctttcactatgtcaggttgtttgctaaaactcagaatcaaatgtctttattaataataggaaaactataccaacagaaacgaggttttcagagaataatagaaatttagaaagtttgtcttagaaaaagtgactgcagttcatacctcaattataattactggtacatttaggaactgaagtttaaaagtgatgcatttgtttcaacgttgtttcctttttctgtgtacttcctataggtgatactaaagagcaatgaaataagcaaaagctatgttgtacc

SEQ ID NO: 247869 - DNA, 455 bp, Homo sapiens
gagaacagtccctgtccctccaaggaacccctcatgcatcttgccaagaagcccagagcactttggtcctctgcctgctccttacccctcatttccacagactaggagactgggccctgggttggggctagccccctatgttgtggaccaggaaccccagtccagagatgaaggtgatggggcagcaaagagggtcccacccctgggtttctaaccatttctgaggccttatgaatggagaacaagaaagctgtgctctcccctcctcccacccccagggcagtggacaaatactacgattttgggtacactttcagggagtccctgcatctcttgaaaaccttctacgaaccccagtttaagagcctgtccaagaccacgaaccatcccacttttccaaagagactttcaggctaacagaatatgaggctgcagctcgtcttactagttagttc

SEQ ID NO: 247870 - DNA, 525 bp, Homo sapiens
tgctgcctttttacttagatttagtcctaacacctacttctgttccctaagttttatttgcttttgactagaattcatataatcagaaaactttaccacaaacataatcaaagcaaagatgatagaaaaagtgtgggcttattgaatctagcatccttaattcataaaactaatcatctccctgccttacactagtcacatataccaaaggtgctggaaatacaaaaatagatgaaaggccaggcgcagcagctcacacctgtaatcccaacaatttgggaggccgaggtgggcaggtcactggagtccaggagtgcaaaatcagcctggacaacatggcaaaaccctgtctcaacaacaacaaaaaaaatacaaaaattagctgggcatggtggtgcatgcctatggtcccaggtactcaggaggctgaggtgggaggatcacttcttgagcctgcaaggcagaggctgcagcaagccgagattgcaccactgtactccagcctggatgacagagtgagaccct

SEQ ID NO: 247871 - DNA, 354 bp, Homo sapiens
aaagaaaataacaagtatgtttgagaatgtggaaacaatcccacataaatcgctggtgggaacgcaaaacgatgcagccatggtaggaacaattttgcagttgcactttgggaggccaaggcgggaggatcacctgaggtcaggagtttgagtccagcctggccaacacagtgaaaacccatctctactaaaaatacaaaaattacccgggcgtggtggcaggcacctgtaattccagctacttatgaggctgaggcaggagaattgctcgaacctaggaggcggaggttgcagtgagctgagaccacgccactgcactccagcctgggcgacagagtgagactctgtctcaga

SEQ ID NO: 247872 - DNA, 427 bp, Homo sapiens
tgctgatttctcattggaaatagtctgtatttagagtttgtaaaatttccagctgaaaaactagatttgtgagccgcagttgctccagtcgtacttgaaaatcttccaacaaccaaatagagtgtgttttaaaatttacattaatttcaattaactaatattaaaagttttacagaagccacatttcaagtgttgaacagccacacgtactagtggcaagtgtgttaaacagcacatatgtaaatctcgtcaccagtccacaggaacgcacatggtaccaagaagggaaagaagataccacgtatgtgcagtcactcaattcagagtgtggaaaatgctacagggtaaggaatctggttaattgcaattaaaaaaagagagagagataacctgtatataaaataaatttaagagacttgtccaagta

SEQ ID NO: 247873 - DNA, 572 bp, Homo sapiens
catataattttgtacttgggttgggggcccaaggccaaaaatttctccttgaaggtcaacaagtcatgtgtgcatttgtaaattaaaaaaataaccacctgccattttaacaggatgattatatactctcaaaaagttttggagatcatttctacaacagtggccagaaaagcagaaatatattcagtaacttcaccgttactgaagtttgggttttctctattatacttgttatatataaatgattgtgggaaatacctatgaaaatgatcatatcagaataattctcatgggagcatagtttcttaatagaataaaatatatatcattaataataaagtatgattttgtatgttgctccttttactaaccaatctttacaccaattttattcctaaaattttttccctttgatatgtctgcaaaaatttagcagtggagtgcctggtcattgcttagttatatctgaaatcattgacaatatattattttttataaactaaccttcattatggaaattagaaacatttccataagtgaaattgggttgaacttaatgaatttatgtgtca

SEQ ID NO: 247874 - DNA, 368 bp, Homo sapiens
tcaatgaaccagcagcttaaacaaatggcaagcagcttgcagaagtaagcagggctttggtgacttctacgctaaccacctcccatcttaactggtttacttacagagctggaaattaatcattctcctcccactcctctctctcagatttctgctcaggaaagtaggagaaagaagaaagaatacatggacagcctggagaaaaagtaagcctgctggcaaactgttgcgttcatcgggcagtatgcacagggaaatatgggtgtgcggagaatcggggagaagcagttcaattcctctttctggccaccttggaaacccggtggtttatcagctgtggtttgcctgccacctagtggttatttgga

SEQ ID NO: 247875 - DNA, 536 bp, Homo sapiens
tgtgccgtgtgatgatcctcccactctatgtttcagatacactgaacttcttttcatttctaaacaataccttagtgctcttgaacttggtgtttcctttcctgacacactctttccccagatggctatatgactgactcctcttgcttcagatgtgactcccttgagcacccttcctacagtagcccttaacttgtctgccttcctcactgctgaaatcctggtatgtaggatagctgtatctagggaaggtgctcaataaatatctacacatgcgtgaatcatcgaaaccaattttaaagcccacctcctctactctggtaaaaactgcataaattaaaagaaacatatagtccattccacttactgctctcccttaaaccttagtcatccataagtatctagtgacctgctttctgttccctcatctccatcctggcccccttaagcgtctaaaatcaaacatttctcccaattagaagtcacccctagctcagaatgcacatcttttcaaaaataacctttactcctattca

SEQ ID NO: 247876 - DNA, 512 bp, Homo sapiens
ttaacttttgtttttattcctatagtgcttaccccagaatttaaatttgaatggaaccacacatattatttaacccaacctctacatagataaattaaaaaaaaaaaaaccctgaagttcacaggcttaaagtcagaaaactaattctaaaaatagtatttcctgatttttaaggctcttcacccaatatattatcattttttcttgctgtgtatatgtccatgtggttagtatgttagcagctcctatcagaaaccaatcaacgttctcaaacaaaatggaattaagagagagcttttgttgagtaaactagggaagaggaaaaagggaaggaggcattgggctaaaagaactcatgtttgcagatttgagtatctgtgttccattcattcaaatttgccatctggatcattagaatataagatgcctaagctttggtaggctgaagcagaagtatcacttgaggccaggagtttgagaccagcctgggcaacctacctaccatctctacc

SEQ ID NO: 247877 - DNA, 549 bp, Homo sapiens
gagacggagtctcgctttgttgcccaggctagagtgcagtggcgcgatctcggctcactgcaagctcgaaatgcagagctcttaagcagcctagtcagtctgtaggttaatgatgatcagaaaacctgcactgagcactgtccatgctcttgttagggtctgtgatatcctctcactgagattcagccaagcagaggccctacattttgacaggtgactacacgaagctacggttcttgtccaactacctttgcccttcttgctaaaattaattcacgttaagttgaaaatattttgtgtcaacatatttgtcaaaaattattttttcctccagtatgaatagtatacagtgagaagtgaagctcctgcctcctatggtttcatccacatctagagactcactctccaggggtaaccatggtcaacagggtagagtatatatcattccagcctttcatctatgtccatataaatacatattttttaacagaaatgagataattctatagttagagttctggaactctcttttctactgctcaattggaa

SEQ ID NO: 247878 - DNA, 609 bp, Homo sapiens
tctcaatagctcagaaacttccgttttgtaaattgtgtgctgtcagtaagccttcactaattgaacaatgccctttttgagactttactaatttctcaaactgcttttttcgtgcttgtgacttttgtcacacatttactaaacattttgtgattcaacactttcgccagtttccaattatctcctagttagagtgtttcagaatttgtttcaaattgtttttaataagattgagccaggctgtggtattttatctgcaacttactacaattttacgtgtaattcaattttatccttaacttcttctctccagattggagttcttattctttgaagtcaaaagccactttatttctgtgaatacttccttttcactgttttgtaccttccctggctttctattacgtctttgaagtggctactggaaggtaatgaagtatgctggatgcatatgtattaaccatggttttgtgtcgtgttaatcatccttaaaaaaaaaaatccttccaaattatccccagttgttatctttctgtttgtgtgtgtgtgtgttttagaagtgaggcattaggctgggtgcggtggctcatgcctataatcccagcattt

SEQ ID NO: 247879 - DNA, 850 bp, Homo sapiens
tagtgtatttccttccaggacttcttattattttgtatttttagaaaaggaatggggatcacaccaaggcagaagtgcttgctgggggacagacactggcttggctgggatcaagtagcctctttctgctctccagcccagcggactggaagcagcagatcagcactcttcttcctggacaggggtaatgagaatgagtattttcctttaaagctcacttgtttccgtattctaagcggacgcgaacattgttcttttctcgtgctttcccactttcaagacccaccaacacctgcctgcccacatttcgagttatcttcgtcggctcctgcaagcccgcactcttctccgcggtggctactctccgctcatccagactcccgccctcactgcgccttcttcctgcgatgaccgaggaggtggtgggagaccaccacttgcgagcttccaaaggactttcaaacctgaaccgcagagtcagagccctcgcgccgtagaaaagtcaggagcgccccggggcccccatcggaagcttcgtgccttcccgtggaaaggtcgcgagcagggaaggccttcgtggccactgagtcccctactccaggggcggcggccgctctccgaaagagcggcccttctcgtccctcccgaggttatcgtcagagtgcacttccttggggaaacagaggtcattctgtcgagtcccccctttctgctgttctcgggagggagaaggctgctggacccaggctcgctccccgcctctcgggagatccgggaaggcctctattgctgaacgccgagacagcggccagcggcccgatcgtctccctaccgctttgcaagccgggag

SEQ ID NO: 247880 - DNA, 719 bp, Homo sapiens
tctgtcctattcccaattgcatgcttttcctcttgcataggcactgatcttccaaatcaaagtgggatggtctgctggacagctcaataccactgagtaagctattagtgccctcctggggtaaggggaccaggggatctagaatccaaggtatggaggtttttcctgcccacatttcgagttatcttcgtcggctcctgcaagcccgcactcttctccgcggtggctactctccgctcatccagactcccgccctcactgcgccttcttcctgcgatgaccgaggaggtggtgggagaccaccacttgcgagcttccaaaggactttcaaacctgaaccgcagagtcagagccctcgcgccgtagaaaagtcaggagcgccccggggcccccatcggaagcttcgtgccttcccgtggaaaggtcgcgagcagggaaggccttcgtggccactgagtcccctactccaggggcggcggccgctctccgaaagagcggcccttctcgtccctcccgaggttatcgtcagagtgcacttccttggggaaacagaggtcattctgtcgagtcccccctttctgctgttctcgggagggagaaggctgctggacccaggctcgctccccgcctctcgggagatccgggaaggcctctattgctgaacgccgagacagcggccagcggcccgatcgtctccctaccgctttgcaagccgggag

SEQ ID NO: 247881 - DNA, 454 bp, Homo sapiens
atgtttacattgaaagacattttcaagggacattaaagaatatgagaaaatttaaccatggagcagggtctttatttcatttgcagctgtatctactgcaccccatgcctggcaaatagtaagaattcagaagtaatgtgggaaggaaggaagctagccaaaatgatagagtacaccatggaaaataggatgaaataggtgacagtaaacaaggaatatttgagaacaatttgatacaacatctgggagcaattttgtggggtttgatggtgggatgtataagtgaaaatcaaataggatgtagttgtggatgaccttaacaagttcatatgttttaaaatcagggctgctgccgacaacagacattttagattacctgccagttatcagattccaaattttgatgtccagtagttctaatctagttgggctattcatttagtcagctaatatt

SEQ ID NO: 247882 - DNA, 341 bp, Homo sapiens
tgctggactttgtcaaatgctttttccacatctattgagatgatcatgtgatttttgtttttaattctgtttatgtggtgtatcacttttattgacttggatatgttaaaccatccctgcatccctggtataaaacccatttgattatggtgaattatctttttgatccgttgttggattcagttacttagtattttgttaagggtttcagcgtctgtgtttatctgggatatggttttctagtttatgtgtgtaaagttgttcacagtacccttgaatgatcttttgtatttctgtgatgtcagctgtaatatctcccgtttcatttcttattgagctta

SEQ ID NO: 247883 - DNA, 423 bp, Homo sapiens
agagaatgaggcattctcatgttacctggtcctactactggatggagccccaggtgtggtccctgaactcaggtagatttcaacatctccttcttggctgggtgtcaatgcagttgggcttgatcctactaaaacagaaaatctctactccaacaggaatttctaagaaatttctgtaaattagtgttttgcttcccccagcctcttccctaagtcaatcatgttgagcatccatgttggcttctgtgttagaaaatccaaatgcttttgaaatctccccattcatttcaattctaacttaatcctaacagtttttttaaaaaaaattacttcttgccttagttgaactaagaaagttcagcatactggcgttgtttttgtagatactgtttaatggctacttattaaatattacaatacaaa

SEQ ID NO: 247884 - DNA, 400 bp, Homo sapiens
acccattctgttagacctcctgtcccccaagtaaggtcctgaaatgggtactgttaaagtatatataattttaacagagttaaaagtatgatttctacacaaatataaagggaatatgtgtaaaagattttattcaactttagtaattaaagaaccagtaagacgttaggagtagttcaaaaggaatttcaaagaagggagatttatggttgatcagtcaaaggaatgctgaaatgaattagtgaatagattgaaaattggttaatattctgcaaggcaatgaaccttaacctgtgggggataaccttttctaccagacagaaatcattggtattgttgttggataagaataatatacattgttctcttatctaaataatttaccttgcacaccacaata

SEQ ID NO: 247885 - DNA, 388 bp, Homo sapiens
tcatgtattaataatcatataatacatgatattatatgtagaatctagaatagttgaacccatggaagcagagagtagaatggtggttaccagggactgggaggtggaaggttgaggagatgttagtcaaatgatgcaaaacttcacttagattggaggaataagttcaagatatctattgtacaacacggtgactctagttagtagcaacgtattatattttgaaaattgctgagtgcatattttaagtgttatcaccacataaaaacaattatgtgaggtaatacatacattaattaacttgatttaggcattccacaatgtatacgtgtttccacccatcatgttgtacatgagaaatatatacaatttttatcacttaaataaa

SEQ ID NO: 247886 - DNA, 418 bp, Homo sapiens
aagaacacttggagtgatctgaactcatatagatctgatatgacagaaatctgatagaggttcccaaatctgagagcaatatcaaaaatttgcatgatattgtaataatgaattgtgaaatcaaagaaacttttataaactaccaatttaaaaaaaacttaaccaggctagaggaaaacctggtttattttactgttctttctacagaaaataatacaaaattgcatttattggcaaccagaatatgcattaaaaaagtaggaaaaaagtattacaaaggagtgttaggcagttaattaacaaaaaatgttattttcccagactttgagatttttgctgtatttatcagcttttaaaatgtataatttattgtaatttcttacatcattctaaataaaaatttacttttgtgtctaat

SEQ ID NO: 247887 - DNA, 747 bp, Homo sapiens
aatgaacttgtcatataagttaaatcttaacattatattaaatcaaataatagatattagatgtctggatcattatcaatttttaaactatattattggaaacattttcaaaataattataagatagtcctcatctataaaatgctgatgtgacaataaagatttcttacttcttaggttttcacaaaaaatttattaccaaaaatcaaaattttagttaatatgtgattttacatataaagtgtgccaaaataagttttattctgatgaaaaaagaaaaattgtgagaaataaaaatgaaataaagaaatgataagaaacagaatgaaaataattgttgtccaattcaaagattattgaaggattccttatgaaacaatgtaaagggaaccagtaagtgacagagagatttaaagaaagttataaagagattataaagagatacattcagtaagaaataccacaaagatgctgggcacggtggcttatgcctgttatcacagcactttgggaggccaaggtgggcagacaagatcaggagtttgagaccagtctgtccaacatagtgaaatctcgtctctactaaaaatacaaaaattagctgggtgtggtggtgtgcacctgtaatcccagcaacatgggaggctgaggcaggagaatcacatgaacccagaaggtggaggtttcagtgagccgagattgcaccattgcactccagctcaggtgacagtgtaagactctatctga

SEQ ID NO: 247888 - DNA, 253 bp, Homo sapiens
caaacataatgtttagcaaaaaatatgcaaggtacttcatttgcataaatacaaaactagataaagcaaatctatacaagatggcaggataatggttacccttggggcaagggtggtgactagatgaagacaggaggagggcttctggaatgtggcaatgtcctgttcttacgaggatgctagttggttgggtgtgttcagtttgcattcttctatatgtatatcatacttcaataaaagttcaaggagaatc

SEQ ID NO: 247889 - DNA, 534 bp, Homo sapiens
ctcctcctatgtacttttgaaagggactcctagacctctgccatgctatgtcttttatatcaggtgcttagaacaatgtctggcatgtagtaggtgcacaataaatatttgaacaaattagactccacttcaggtttagtgcaaagcaacatcaattccatatttgagtaagaatgcaatccagtaaagtcagggtaatttttttcccttgtgtgactcttattttcccctcttctcaggagtgcaacacgtgatggcatctgcttctctgactgcgctgctgcctgtgtaacatgaccaaacattttagcatttaatctgtccctttccagaactcaacagtacttaaaaccagacttcctcagatgtgtcagagcctcttaggttgacacctcacaatatctaacagattaaaaagaaaaaaattccttatgtttaaactagccaatcataagtaaaacttacgagaatattcataaaatgtgatctcagactgggacacaatttgtttcaaaaagaagtaattgaagtttg

SEQ ID NO: 247890 - DNA, 533 bp, Homo sapiens
ttcttgctggtggtcagaataatgccatggaactcagaaaaggacattttaccaaattgtctactacgtaaggatagcacttctctgcaaatgcttttgaagttctggaataaaaagtgaaaaacaataactctaagcacactaggtcagaccttttctaagatgagaaggctctcattatgaggcttcaaaaggtagcaacagccatactgctaagatgagaaagtttaattctgtgaaacaactgcaaaggactttttcccccaatgcagcaggatatcatctggcgtaaactgaatgttttctgtgtaatatgaacagactagtggtgattcaaaatgttctgtaattcctccttctgccctggccatcaccctcacttatcaccttctctctctgtagtatcataaacttgcttcctgctcatgggtctcctttttgtgtgggggaatgagaactagtgttaccaacttccataccacttcttctcatcaatgaccgcatccttataggcccttggcactaactgtttc

SEQ ID NO: 247891 - DNA, 508 bp, Homo sapiens
cctttcccttccttccttcctttctttcttctgtctgtccatctatgtcctttctttctttctttttctttctctctctctcttttctttcttctttctctttcatctattattctatcatctttctttcatccatttatctttctgtccatctttctatcttcctttctttcttcctgttcatctgtctttctgtctgttcatccatctcgctatccatctagctatcgttgtgtttattcatccattcattcatctatctttcacctgtctatcatctgcaatgttgctaacatcaaaacatttatggttgtggacaggatatcttccatgccaggtacctttggccctcctgttgaaaagagtcaactcctatttatctatggctgtaaaagtaatgtttcaatttaaggtaactgagagttgtctgtaaacataaaggggaagttatggattctgtgtgccttaggccagtgctgttttgggatggaaaggcggtaattataga

SEQ ID NO: 247892 - DNA, 410 bp, Homo sapiens
attctatcaagcatttatattaccttttccttcctagccattttaatggaaatgggtggagaataaacagtaactcaataagaagtcataattgctcattgtagtacatcattgattgtgtgattttgtaatataattgttattgggctcttattgactggattctgggtttctcctgtccttgttaggttttgtgttgactattttctctttctatttttttcctaagacttttaaagtgtttctcaaattatggtctttgttaaactttctgcatcccgtaatgtggatgttcaaaagattcctggtccccactccctacccactgccaacagaatcagattctctggaagtgcgagctagaaaaatacattttgaataagtactcctcccctccttaggtgcttctt

SEQ ID NO: 247893 - DNA, 384 bp, Homo sapiens
gctctgtcacccaggctggagtacagtggtacaattatagctccctgcaacctcgaactcccgggctcaaactatcctcttgcctcagcctcccaagtagcagagactacaggcatgtgccatcatggccagattattattattattaagttttgtagaatcaagatttcactaagttgcccaggttggtctcaaactcctagcctcaagtgatccttctgcctcagcctcccaaactgctgggaatataattgtgagccaacacgcccagctctatggtagacactttggaaatataaaagatagaaggcaaagatgaccattgttaaaattttggcatatttcttctggtctttttttctaagcacatggttttatttcgtc

SEQ ID NO: 247894 - DNA, 831 bp, Homo sapiens
acagttacggcttattccagggcatggcttcagattaaaatcaatgcaagcaagagatgcgtagggcaagactggaagggttcccgatgcaaagctccccatgtgtcctccccatgggggcaggatgctttaccctcccggcatcacacgtgacagcactcactgaatattgccaactggggagactcacttgggtttccactggggcttcattacagaggcatggctgatgattgattgattgcttgggtggttgaactcagtctccaggactcctgagactgtgtgaccttaaaacctccactctaaatcacagggcaggtctttctggattggcggccagtccccaccctaagcctgttgggtgtagccattcccacactaaggtccttcgtagtcagaactcttctcaaatgtgacataaattacccaccagaagccaagggcgcagaccagatgtctctcagctactcgtaagcaatgagtcttgcttggactgatgggtgaacattcaaggtgctcattcagatgcagggctggcactgtccaatctttgttcactgccacgtgtcagattccaagcactttgtaaataccagctctcattttatcttcaaggcaaccctgcaatgctgtgggctctcattatccccactttccgtatggggacagtgagggggagcagctttcccaccctctcagagctggtaaatggtcgaggccaggcagcctggttctgagggcctgcacttgacccctggttgctttggtttttaaatttttaaaacattaattagttgctgcccgacttcagctggcacactcagcacc

SEQ ID NO: 247895 - DNA, 606 bp, Homo sapiens
cattaaaggggttcaagcaggggagaagggaattccgttttttagagcagagggagaaaaataaagcaattacttgatgtaaaggccagaaacaggactcctgctgtcagggagaaatcaaatctgtcagcaattagtgggatcttaggaggtaaagaactctccagcgttgagcagtgaataaggggttagcaattatatgaactgataaaagtgttctggtttccaaacagcaggttaacaagccttacttttttcataacttgatgcagatgtgatggtcacacttgaggatatttttcagtggttcgccaggaaagttccttaataagtacattgggcagcctgtttccatctcaaactgtgttcgtgctacctaacgcaaaaggatgtgtgggagagcattttgatagcaaggctcttctttaattaaaaaatggaataataaattctctgaacatgcaattaaaaaaaatcaaatgagaaattcacgtccccatgtccattcttcccatgggattggcagttcctggtattttcagcatggaaggaacgtcacctggtataaaagaggcaaactttgtatcaaataaatacattaacttt

SEQ ID NO: 247896 - DNA, 136 bp, Homo sapiens
agaattttgcaaaatagccaaaggtttgcagcaccttagacaggatttatggaagaaaaatatcccagttttggtaagaacagcaagctttgtgctgttttaacttctcctagtccccttaccccttctacctcag

SEQ ID NO: 247897 - DNA, 580 bp, Homo sapiens
tatatgtacacatctccaaaaaatatgtacttttttccccgtaactaccatgccattttcgtattttataaatgttataatatgtggcctctactaccggatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcatcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaa

SEQ ID NO: 247898 - DNA, 734 bp, Homo sapiens
ggtagtactggagggaaagtatagttcacagtaatttactgtgtatttaaaagtagccagaagagaaaatttgtaatgttttcaacaccaagataatcgttcgagatgatggatagcccagttaccctgatatgatcatcacacatgtacaggtatcaaaatagcacatgtagccccaaatatgtacaactattatatatctattaaagatttaaaataaaagtgatcactatgtctacgaacattttttggtgctcacaatcggggagagggtgtgattctggcatctagtggtagagcccctgggtgctgctaaacagatcctcataataaagaattatttgacctaaacctgttacaggaaaaaccttagacaaactaaatttaacagagtttaaccaagcaaagaactattcatgagtcaggcagcctgcgaactagaatagattcagagaggcttccggtgcaaccaagtggtagcagaagattcatgaacagaaaaagccaagtgacatacagaaaatggaagtgaggtacagaaacaaccagattggttacagcttattgccttatttaaagctgatttcaacagttggctgcctgtgattggctgaaactcaatgattggcacaaatgtaggttacagtctgtttacatatccagttaggttacagttcactatgtacagaaaaacctttaggccacacttaaaatatgtaaggagacagctttag

SEQ ID NO: 247899 - DNA, 502 bp, Homo sapiens
cagaaaacgagaccactcatccatgaggtcattttagtaagttgtagatgaagcgtttgtgggacacaatgcttgagtcagtattgagatggctggagcctgaccctgtatcataagccagagcagcaggagcttggatttctgctcttccggttttctgttatggtaattgccagtccttagtgtacaggaaaaggatgggcagaggctggggcctccactgacctctgtttgtcctcagaggagccatagagctcaccagttcccccagccgtttcccaggacagaggtctttctcacagcctttctcagagggcttgaaatgttaagaactgcattttgctgcccagccggattggtgtccagcgcctcctgcccgtaggtcctagctcggctcatttcctcacagagtggagtcagaaagcattaatcagaacagggaagataatacaaaaattaaccgggtgtggtggcgcacacctgtaatcccagctactcggga

SEQ ID NO: 247900 - DNA, 480 bp, Homo sapiens
ataatactatatccagtaggattgtaggggccctaaaccagaaagatcccaagtgcttaatagtacctggcacttagtaggtactcctaaatggagtctcactttttactaccaagttattaaaaatcatagaatatccacatttccactttttactatttaaacatttctaaatgcttaaaagtaggatccttgattaattgcttctgctttgccacatacatttatccactttagtttgctgtattttgtaagtctgcttttctagtgcgtggaagtctagaaataatttcttttgcataaaaatttctgcaaatcttagcagaaaggactctgaagtctttagtggactgatttacatattaagagtgttttcacctaagaagggaaatgaaaccagcagaaagggaagtgagcaacgaatcgctgcctgccttgttaggttaattttgttttactttctcatttcttaaaaaaaat

SEQ ID NO: 247901 - DNA, 353 bp, Homo sapiens
taagggacacacgtgagcataagattttggttacttagtagaatcagttggtctcttctcaactgcacagggttgagaaaagaccagaggctgtgtgccatcatcaaccagctcaactgtttttactgccaacccaaaatgaaagaaaaaggtaccagcacagtgttaaactgtgttgcctgactgtgggctgttggaaacagtagcagcttccacaggtggaatgcatatttttgagcaagaaagtttatgtcctttgtgttagagccctctcagaaggaagaaaacacttcttaggcactgtacatcctttaattcaaaatataccaatgtcttatccccattttcagatt

SEQ ID NO: 247902 - DNA, 816 bp, Homo sapiens
agatactaaaatagatacagaatcaagcagttacaggctacatttaaaataacattatggagtgatcagtccttaggctaatatgttagtttttttttcagcgcatttacttagccgcatgcttgttcactcccgctagtttttggccgttgtcctccaatactttatgcctttcctaatatactgcaagtggatcacctattatttctcttttaaacatttaataatgtcctatatcttaaattggtttctctttggacgagctatccattatcaaccttcctgaaagtgcaattaaaatacaaactaggcatttacgatgatgtatgatattcttcatttaaaacccccaaataaacctctttctgttcaatgcctctaccccataattatacatatgaactacactggatcatctcctttgagaatattgatgatcttatgttcatctatggaactcccactatgttcaaagcagtgatatccaaagggtgaaattcctagtaagtatgaataaataatatatttcataagggaagccaaaagccaaggattcttctctcattttgattttcctttttcaattcatgtggcaactgacattatttttattatgggctatagtttcctccgtaacaaatagttgtattgtcagtttggttctagagattttgggagtaactctcttctctggaaaggttacaaatacccggattgaggactggaagcttgagccataactccattagctttcagagtatttcagggtgatttcagagtatttctgaggaaccagtccaaatggaataatatttt

SEQ ID NO: 247903 - DNA, 878 bp, Homo sapiens
ctgagccatttctacacagtgtctgtttcctcagaacaccggtcttcaccaaaggcgtgggaaagggcagagagcacaggacatattctggaattcaggtcaccttttacatctgcctggagttgggtgagcgcctcacgaatgactcggcaggactgactgccactgctaaccaggcggatgcaagcaatgaggaggacctgcccaggccgggtgggtgtctgctccctccctctggtccctggcacatctctggaccccctgccctgctgtcggagagagatgacgggcaacggcgtattctcagagacagggcctgcctgcaaatcctttaaagtcaatgggatgaaatgtatacccattgttagaaaaaaataggacttagcaagttgagtgcaaataactgattgcaagactgggatggagattggaaggggttttggggcaaaagcagaagtcttttctgggtccgcaccagctgtgaaatacctggcttgttgttctgtgcctgtctccagcacccaggcagggctacctgaccactctgctctctcagccccgccctggctctggagcgagcctgtggaaagggggacacttagccaaggccccagccacatagcagcagcagctgcgccctctgtcagctccttgcacctcctcactgggcctcctgcaaggcacctgctccactccaccactatcacctgggtcctcctggccttggcctggcttgcttaccttgttatcaagtcctgaatgggggaagcaatattccttctccactacaaatcaccacagtattcacaaagaattccagagaaataagaacagagacatcagaccacactgagcactcaataaagagaaaattcttc

SEQ ID NO: 247904 - DNA, 488 bp, Homo sapiens
taataacattcagaacaataacttttgggattttatgtctacccaaaaaacaataatttcgatgcattggttctgaacaagttaacatataactttacagagtttagacccttaatcaatagaaagtcatacaaattcccccagagtagtggttggcaaattgtggcccacagatcaaattctgcccatttttgtaaataaagttttatgggaacatagtcacatacattcatttatgtgttatcttattatcacttatgagctttttgcatgacaccagtagagttgagtagtggtaacagagaccacatggcttcaaagccttaaatatttatctgaccctttatagaaaaaaatttgcctccccattcctagaatatcagatgctacttaagtggtcttgttagacagtgcccttagagccctaatgtccaataaggtagccaccagtcacttagctatttaaatttaattcagatgaaataaaa

SEQ ID NO: 247905 - DNA, 505 bp, Homo sapiens
taataacattcagaacaataacttttgggattttatgtctacccaaaaaacaataatttcgatgcattggttctgaacaagttaacatataactttacagagtttagacccttaatcaatagaaagtcatacaaattcccccagagtagtggttggcaaattgtggcccacagatcaaattctgcccatttttgtaaataaagttttatgggaacatagtcacatacattcatttatgtgttatcttattatcacttatgagctttttgcatgacaccagtagagttgagtagtggtaacagagaccacatggcttcaaagccttaaatatttatctgaccctttatagaaaaaaatttgcctccccattcctagaatatcagatgctacttaagtggtcttgttagacagtgcccttagagccctaatgtccaataaggtagccaccagtcattgggaagttgagattgaccgcatttttcaccttcttgcccccggcggccgc

SEQ ID NO: 247906 - DNA, 460 bp, Homo sapiens
gctttcttaacttgttttctctttcccaatctcttttctgtaaaaggaggctacagcttcaggcagtaaaaccaagaggaagaggagggaaatgatgggggcaaggatggtggagtagaggaaactgggctctaccagttcctgggttggcttcatggcaaggtatttgcatggcaaggtatttatataatggttataaaagtgctgaatatggtcttcttcattttagtcagagaaatagagaatttctccctcttaaaaaattctctcttcctgaagctaaattcatgcagaacaaggatgcatcaggggtttggggacaattggaatgtacctcaaaggattctgggaagttcttctagtccctaagcagtaggtagatcatgaaaacagaggaattttgagcattttgactttattcaaagctttccccacctcatgtccccaagaaaaaaagaaa

SEQ ID NO: 247907 - DNA, 459 bp, Homo sapiens
tttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaa

SEQ ID NO: 247908 - DNA, 551 bp, Homo sapiens
cccatacagagtagctgcctgactcatacaatggataaagtcacatagactcaaagagtggagatggaggtcggatgtggtggctcgtgcctgtagtcccaacactttgagaggctgaggtgggaggatcgcttggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaa

SEQ ID NO: 247909 - DNA, 740 bp, Homo sapiens
atggcaaactaacaaaaagaaaaatggtgactgatacccagtgctggcagtctcgtttaaactatgtgcaggaacagcaaaggaaatccagcaaatctggcacagtcattatcaaccctggccatgcagcaaaatcaccagcgaaaattttcaaaaatacacatggccaggccccagcccaaactactgaataagaatctccaggctttcacctgttagactggcaaaaatccaaaagtaaccactctggagaaacaggcattcctagacagtactggtgggatacagaatggtacaattctcatgaaatttcacagtagttaacaaattaaacatatttatactttttaacccaggaatcccatatttaggagtccagtgagaagatacagcccacaaataccaaacagcatgtgcccccggacctttccctgtaatcatgcgcctgcctatccagagggtactggttggataagctccctacatctgtccaacagagaaccacgcagcccactagaggagcgatggtcagacaactgactaagatgccttctgtgtaaataaaacaggaaagggaaaaatgaagacacgtttttgcttatttaggggaaaaagaaagactgaaaggataagctagtaaaacggattccctatgggggtggggaatgggctggaaagggatgagagtgaggctttcctgaatagatctttttatattgctttgacttttgagccataca

SEQ ID NO: 247910 - DNA, 501 bp, Homo sapiens
ggaggagaagcctgggccagcagagggctgctgtctctgctgcgctttcagcaagctcatctcaggcatgacattcaggatgcagagttgctctttatttttttatgtagtttgctaagagaaaatagccccgctacttatgtatcagtgtaatccaggggaaattacttaatttccgtcagcctcaatttgctcatctgtaaaatgaaggcaactaattacacctgccttagcatatgaggcgtgaatacgagaatgcttgacaatacttggcatagagttagccctcgataaatttcagctgttaatgttattatagcaccttcacatgttgttgtgtttatattgtaaatcgttggttaaagatatttttattgtcatgatagctccatactttcaagatgcgtctttgtagtatttcgtatccatttagtcattcattcactgagtttgtatttatcagacacctacttatggacaaggaactgttgattattatct

SEQ ID NO: 247911 - DNA, 687 bp, Homo sapiens
atatatgctcccttttaagggggagctgcaccccagctttaggatattgttgctctatgggatgtgatcccagtgttaccagatctttcaactttgcaggaggcatcagaatttggatttcctgataagcactgtgtgacccaaatgaaatacgtttgtaggtagaataggacctctagcttttcatttgagacctttccttaggctcttggaagtccttctgtggtcctgtttacctagttctcttataatctccttctggatatatattctgtcctctagtccccccagaagcactctttcttttttcaaaatctctcagaggcacagaattcttcttcctctaattcttgaaggaccacacaggtagataatggttctatcaggaattgtctttgactacttcatatgccaaaatacagtccattagtgatgggtttgttttccacggtgaatgggggtggcccagtatcatacagcctcgtaaggggagctgacttaaggagaagacacttaggttctatctgccctagccaacttacttctcacacccccacttcatctcaggcccctggaacgactttcaaaaaaatgcacctgggctctaagaaaaaagaatacccaattgttcagagcatgaagactgccaatccccattcgggctttgaaaaaaactgaactaaggaa

SEQ ID NO: 247912 - DNA, 648 bp, Homo sapiens
ggggtgcgtgggatctgtttatttggtagcaacatctgaacatggaagctaaactgacttaaatttcaggaacaaagctggtgttagcctcctatatgttcttgaattctgattaataatttgtatgccaatgcctttgaggaaagagtgctacatctgcagttaactctgaagtctattttttaaaagttggattgatggatggatagaggaatgaaaaaatatatatgctgtaaagcaagaatagtaaaaatgctgtagaacctagatgatgtgtatatgggtgtttactgtaaaagtctttcaacttttctgtatgtatgaaaattttcattataaaacgtcaagaagaaaaaatgaagactgtgtgagaagagtggcaggatgtgctctggcccatggaacaaagacattctcttgggtgcacagccctgacaggtgggaggatgacttggcatgagagctgtcgaaaacactataagccatgctcaagaatttttaatgtggaatagagaacttttctgaaaaagcatagttgaaagcaaggacaagcattaataaggcacttctactcttttatttattaccatgttgggaattattttgggaggagtgcttgcttcagaaatgctaaagtaggtaatttgt

SEQ ID NO: 247913 - DNA, 594 bp, Homo sapiens
ttggtttgttttcaattttttgagtatttactatttaaataaaaagcaatggcagcaaaggtttctatttccatgtccctttgagctttttccttgacatccacttctctcacaaggatctggccttcatgccaagtctctgctgatcttcactgcggagggcagctcctcccaggagagggtccagcccctccattggctggtgccggcctcacatttgtcctgaccctgtgtctggcttgtgctgcccgtgattatggctcctgccggccgctcagtggcccatgggattgtggagcagaaagcagaaaaggaattttggattacgggggggaaatgatgctttaaaaaggcaacagttttctgatgtctatttttttttcattctaagatagtttcataaatttcctcttcatttcaaccaagtacgcttggttacacttcctaaggaattttgttcaactagatggtatgttttggtgaattaatccaagaggacgctactgaaaaaatattatatatatgcagctttcttcacagaacatataacaggatatatatttgggatgttaatttaaaaaacaattttaaggt

SEQ ID NO: 247914 - DNA, 240 bp, Homo sapiens
ttacagacagccaaagggaacttggggctgacaaccagaaatggtggggttttttttttccaactgtgtacaaatcatatcattaagttttatgattgaatcaccagttattgaatacacatggtaatgtttacctctgactttgcagataaataagtgatttctttctagtttttcctgctccttagtgacagctgaggtagaattcttctcagataggctttcgtttttcttactttt

SEQ ID NO: 247915 - DNA, 467 bp, Homo sapiens
tatttttcatgtcttagagcttttttttgtttcttagtcgtttttgtagaccttgtttatagatgcagccactcactaaatcctagcacactggtgcaatcaacagaatttttgaaattctcatttctggccagacacagtcgtcacgcctgtaatcccagcactttggggggccatgcggggcctcacttgaggtctgtggtttgagaccagcctggccaacatagtgaaaccccgtctctactaaaaatacaaaaattagctgtgtgtggtggtgcatgcgcctgtaatcccagctgctcaggaggctgaggtgggagaatcacttgaacctgggaggcagagattgcagtaagccgagatggcgcccctgcactccagcctgggcgacagagtcagattccatctcgaaaaaaacagaaacaagaatgtttgaaatcctgatttcctgaggactggtgctcccc

SEQ ID NO: 247916 - DNA, 503 bp, Homo sapiens
ttttatgattataagcaacgcaattaaacataaaatcagaataagagaaacagttcctttaaaggagtaagcaaaatcaccatcatgtgaatttaatacgacttcattcttagaaaacttaggtgaatcaaatgagaaattaacaaaaataaaagcaaagtgtccaaatacaaaataaatgttaaaatattaatagtttacctgttcactgaaaataggcattttgaaaatacagtgggagaaaatctatccccaaaacaaagatcaactagaaataacaattatttaaaaatctaagacccttgtaaacaaaaaaactataaaattttgctgatggacaagaaaaaaagtatacataagtcttttttacatatactaaaataagcatattttagtatatgtaaaaaaatacaaaaataaaagaataccacagcctagttgcagaaattgaataaggtaaaaggtgtaaattcttaggaaattaattaatagtctaatacaac

SEQ ID NO: 247917 - DNA, 595 bp, Homo sapiens
ttcactctgttgcctgggctggagtgcagtggcacaatctcggctcgctgcaagctctgcctccgaggttcaagcaaatctcctgcctcagcctcccgagtaattgggactatgggcgcctgccaccacgcccagctaatttttgtatttttggtagagacggggtttcaccatgttggttttggccaggatggtctcgaactcctgacctcaagtgatctgcccgcctcggcctcccaaagtgctgagatgacaggcgtgagccactgcgcctggctggacattatacattttttccccttaagctgattcttcatcattggccatacaggcagtgtatggttcactaagtttcctaaaaagaattcagtaacaaaagttctttaatgaataaatataaacacttttggaaacaagagtagcagacatactctttcttaaagacgtctggttcacttcttatacccgtattttgctaggaaagaaatcgaaaccaggaagaggcactggtagatcatttacactggtcacatagtggttccttattagcaaatgctaccaacctttgtagcatgccagacaatgtaaataaaca

SEQ ID NO: 247918 - DNA, 513 bp, Homo sapiens
acagaccacgctatgcacgtatcatcaggtctgcaagctgaacagatgctctcacgtgtcatctcttagaggtaggatcagtcctggctgctatactcaagcaggaaaggtaagagggggcagctttttttccctctctttgtgtagtgtgagcaacctaaatatttccatctaagcaggttatggttccttcccacaattgaagggaaatattgatgtgcctgtttattggggggtcagcttcctggcctgatttgcttatctttaaaacagtcacaagaactttgcatattcttaggaaagaaaagggtaagaaaagaatcattgtgtcttgacagctggttgtaaagtgaaggagtcagtaaacaggttggtggttttatatacatgagattgaaaaaagttgccttgattgtttttccctgaatcggctggtcattttaatatcgatgtgggcatgttctaatcccctggttagtcagcgagatttctttctaagtagaattaagcaag

SEQ ID NO: 247919 - DNA, 208 bp, Homo sapiens
ctcctgctggtagatgaaatcatctggtctgttttggactttctcccctatagttcctttaatgggggcagaggcatctgtgttctgactgttgctgacattttcttcctcagtcgctgggcatccagtggtacttccagcctcttgagttctctttgctgctccaaggagccatctgggaaaggagctaggctcagtccacatcagc

SEQ ID NO: 247920 - DNA, 727 bp, Homo sapiens
aatagttctgtgacagctatctccactagaaggatcctggagcaggcattgaccacatacaaggaccacaattgccaccaaatactgtggctcagggttctccttttggcagcccttatctggtaagaccctggcaaagttgacacttcaagccctcccttcttccttccttttcaaggatctggacgcataagagttacaggctctatacacagggactttccttcctggaaacccggtaggaaatcccattatggctgcctgtttgccaaactattcccttgactgacaggatgcagcctattcaaacttctctgtgtctgttgaaaaaatgcatgtataaaaaaggcatggcctcacgtaattaattaggcatctgtaagggagagaagatgatctttcccttacgcatcgcaggattcacggctgagagcccataagaaagaacagataggccaggcacggtggctcacgcctgtaatcccagcactttgggaggccaagacgggtggatcatgaggtcaagagttcaagatcagcctggccaagatggtgaaaccccgtctctactgaaaatacaaaaattagccgggtgcggtggaaggcacctgtaatcccagctactcaggaagctgagacaggagaatcgcttgaacctgggcggcagaggttgcagtgagccaagattgcatcactgtagtcaggcctgggcgacagagtaagactc

SEQ ID NO: 247921 - DNA, 165 bp, Homo sapiens
gtagatgagattagttttgtagaccattagttcacattttgctcctacccttgtgcataaaatcactgcatcatttccgtggggatgagactactgcaagctacttccttggagattctgtggaagatggacatcttaaaagtaaactacttttggtatgactgc

SEQ ID NO: 247922 - DNA, 337 bp, Homo sapiens
atgcagtaaagtggggaaagtgatacaaatacaccaagctaaaatccaccgcctccttcatgtccagggaagaccaatagattagaggagtgtcctcatgttgacattattaatactttaatgattttctaaatttaatgtctcctgtgtctaccagaaatatattcctgagaagttcaatagacttggaagcagaccacctgggttcaaggcccgactgcctttctctgtaaccttgggctggtttctcaaagccttagtttccttatctgcagagtggagaggatagtaacacacttcacagggtgccctgaggattaaatgagataacgcatag

SEQ ID NO: 247923 - DNA, 398 bp, Homo sapiens
caatactgatggttgggtagttttcacacagccatgaactacaatgcaactactgaaaattatattgctgataactgtttattaatatggggatattacataacaaaactactttgttgaagaaaacagagtgaaaaagtatgtaaattatggtgtcattttaatgcacaagatgaaatatgtatggatacatatatacacaaagaaaggttctaaaatagtcactaatgtgttaactgtggtacctggagtaggagtactgataagattggtttggttttgtcttttgcctgttgttttttaacaataagtatgaagtctttttatagctagaaacaacaaagtttctttctgtattaagaaaaaatttctgcattaaaaatatatgttatggggca

SEQ ID NO: 247924 - DNA, 409 bp, Homo sapiens
gtgcaatgaacagaatcacttaatgcacactattatagaaaagttagttcctcagagagttcatgctatgatgcttttcttggtttgcatttgaagcaaagagggatagaattaacatgaatgccttatgatatatttagttagtggatccattattgtaatttaagttgtatttatactgaataatccttattttatattttacctggattgaattttgaaacaaaactggatataagatggtaaaaacctagaaatttcattttcatcagtctttctaatatacactcatgcaccgcataacggtgtttcagtcaatgatggactgcatatgtgacagaccccagattataatggatctgaaaacttcctattgcctaatgacatcataatcaatgcattactcatg

SEQ ID NO: 247925 - DNA, 333 bp, Homo sapiens
cagttgtattagagaaaagcttaaagacaaggaaaaattaaggaaatgaggcacaaaacgtagagtagatacaaccaacaaaaccaaattggattctttgagaagattagtacacttgagaaagccctggtacactagtcagagaaaagagagcagggacaaattacaatgtcagaatctacgaacccttcagacataaaaacttgaggctgtctcaaaagtcagtgggaaacgttaaatgcaattgacaaattactaggaaaaaactgctatcagaagaaatagaacatgttactagctcctgtctttcagaaatcttacctatatcttgtc

SEQ ID NO: 247926 - DNA, 414 bp, Homo sapiens
tagctgggattacaggcatgtgtcactatgctcggccaaggggcatgacattcctcacacgacttgggtcaaggtgctcgtcaccttgctgcagtaccttgcatctctaccaacgttttctatgccttgtttctgaagtgtttgtcatagtgaattccaggacttcaaattggattctttgagaagattagtacacttgagaaagccctggtacactagtcagagaaaagagagcagggacaaattacaatgtcagaatctacgaacccttcagacataaaaacttgaggctgtctcaaaagtcagtgggaaacgttaaatgcaattgacaaattactaggaaaaaactgctatcagaagaaatagaacatgttactagctcctgtctttcagaaatcttacctatatcttgtc

SEQ ID NO: 247927 - DNA, 650 bp, Homo sapiens
ctgtactccataaatatatacaattatgtgtcaactaaaaataaaagaaaaaagtgaaaaaacattcaccttttatattgccttaattgagtatgctaatataatccatattgttttaaaaatgcatataaagcttgtcctgttttttggtctgaaatgtcccagtttcaatctcaagagccccaatataattttcaggtcacccagaatgtctgattcaggaaggtttaaacactaactctgagtacatagtaaaagtaatatttaaagttgtgttttaaatgtctgtgagaccattctggacaggcttttcatatgctttcaacacttaccatatgaacgatagaatacgtaccttgcctactccagcataatttatatccccattttacatctttacgtgtatttactacttgaacttgaatatgtgaatagagatgatacattcctgggtaatcaaaattaatttctgtattacatttgaacatgaatgtttcaacatatcttgcagaaaatgaagcacagtaataaatttgcattaaaatctaaagaacattctgaattatactaaaatccttttttttttttttaaatcacattttagaaatgagatctttttcatgccactcaatactcgtgcagagcattct

SEQ ID NO: 247928 - DNA, 590 bp, Homo sapiens
ctgtactccataaatatatacaattatgtgtcaactaaatataatccatattgttttaaaaatgcatataaagcttgtcctgttttttggtctgaaatgtcccagtttcaatctcaagagccccaatataattttcaggtcacccagaatgtctgattcaggaaggtttaaacactaactctgagtacatagtaaaagtaatatttaaagttgtgttttaaatgtctgtgagaccattctggacaggcttttcatatgctttcaacacttaccatatgaacgatagaatacgtaccttgcctactccagcataatttatatccccattttacatctttacgtgtatttactacttgaacttgaatatgtgaatagagatgatacattcctgggtaatcaaaattaatttctgtattacatttgaacatgaatgtttcaacatatcttgcagaaaatgaagcacagtaataaatttgcattaaaatctaaagaacattctgaattatactaaaatccttttttttttttttaaatcacattttagaaatgagatctttttcatgccactcaatactcgtgcagagcattct

SEQ ID NO: 247929 - DNA, 376 bp, Homo sapiens
ctgttacataggtggcaggaaagtcatcgtggcaagtgatagttctatgaaggccctggggtagtcagtgatggaaaaaggcaaagataggccgggcacagtggctcacgcctgtaatcccagcattttgagaggctgaggcaagtgatcacttgagcccaggagctggagaccagcctgggcaatgcagtgaaaccccatctctacagaaaatacaaaaattagccaggcttggtggcgtacgcctgtggtcccagatactcgagaggctgaggcaggaggatcaattgagcctgggaaccggaggttgcagggagtcaagatcacaccactgcactccagcctgggaggctgagatggagtgagactccatctt

SEQ ID NO: 247930 - DNA, 484 bp, Homo sapiens
gatataggttaatgaaattttaaaaagacgtaggttaattgtaagttattgcaatataaacataagcctaactttatatgttattgcataggataaaagtttgaataaaataagctggacagatgagattcatatatgtgcttgtaaatgcactaaaaaaagaaaaaaaactgctgatgtaaaaatattgagttttagtttactcaatattttttaagtgtgatacaatagtattctactgtattattataatcatgtaaaaacaatatgttaatgctgggattatacaatcacagatgaccttttttgtaatgttttatcttactttttttcttcaaatgattcactaaaatacgaaagattttgttgcctgttgaactctccaggaattatcccttgcctcctattacaaaacagacaacactaaacacacaagtacccagtatttctccctaattcaacagctaaatttctgaattacttt

SEQ ID NO: 247931 - DNA, 480 bp, Homo sapiens
gagctgcagaaagccagaaccagctcagaaactgagaaatggacatgaagatgcccaggaaacatctctacagcatccctaactgggggttgatccattcatttccagacacagagaacagagtcacattctgctgtttccatatgtaccattttagtaagacttcttggggcacaaggcaggaagttggggacaatatatttgtctgcaccaaggcagcctgagaagagagaagtgaatactcctggggttattctatattattcacttaatattctaagtgagtcctctaggggtacctgagacatggagtatgaaagtacacattcacaaaagtaccagctttaaaactagattatctctactattcaaaaacaccaaggaaaggccacacaatggagacaaagtgcatctgagatctagcaaatttccctgttggccacatactgataatgatgtattaaaatcaattctatactg

SEQ ID NO: 247932 - DNA, 538 bp, Homo sapiens
aaatgtcattctacatttctcctcccctgacaaagtacttaagaaggccctccatgtgagctgagtagctactttttcaccccacattttcagaatttgtcttgacacacaggaaagttcattcagaaacacaaggaactccgggatttttaaaaaacttcttggctacgttgggcagtagagaagtcatttccaatttgcctgaagaataaaccaaatgaagaaaacaagagaagctctgaaatagccaagtggggaaatggagaccttgggaagtggaaatgcaggtagccttgaggaggacaattccacaattacacagagagatgtatacatagagatgccaagagcatgggctctgaaactgacctttattagcaaggggcaaattacttaatccttctgggtctccattttctcattgatacttagataaatgtagctcaaagaatttttatggggataaaatgtatgtaaaatatttaccataggacttggtgccagcataataaagtatttgatttattatcattattat

SEQ ID NO: 247933 - DNA, 377 bp, Homo sapiens
gagagtgggttttgcatacgccacctggtttatattctgagacagaccacccaaaacccactctccaaaattggcagaaatctgcccagtcgttttcctgtgatatggcaataaacaaagcgtcagtttgacttataaacaaacacatatgatgtgatgtgagaaaggctataattcagctgggggtgatgggctagaggagagaggggctggctctcccgtagagggcccagggtgcaggagaagggggcaccaggcagagggcaggatgcacacaaagactggagatttaaaggcctgtttgatggaactttaacactgcagcctggctggacggcaacttcattttcaaaagaagagcccaagttttgtacaaa

SEQ ID NO: 247934 - DNA, 389 bp, Homo sapiens
tacaaatggggaatttgaggctcagaaaggctaattgatgcaggtgtctctctgtcgtcaaagatagttctacttccactatacttaaagcctctggagaaggaattgcaggctgagagaaagagatctatcttaaatgagggaagaaatgcacgtttcattgcctggtctgggtagccttcccggtgttggagtgggaggtgggaaggttttagattcacaggtccttagattgaagggactctggaggaacaccacatagcaccccccgcattagctaatggggaaaccatatctagagattgtatccatgccagaaaaggcagagcaaagacaaccccagtctcttggcttctaggataggatgttcttccgccacccgccattta

SEQ ID NO: 247935 - DNA, 408 bp, Homo sapiens
atcactgcccctgtcttagcccttccttccctagaaaaaccatttcaccttttcattaacgcaaacaagggggtagctttaggggtgcttactcaagaacatggggccactgacaacctgtggcctttgtatcaaaagtttttgacccagtaacctgtgggtggcccaaatgtgttcaatttatcacgcgaccgccttgttaactaacaaaagcaggaagctaacctttgggggaaacttggtggtgaccacaccccatcaggttagaacaatcttaaaaggcaggaagatggctcaccgactcaaggattttaaagtatgatgctatcttactagaaagaggtaacttaacattaaccactgataattcacttaacccagcaggtttcctgacagggaacccaaatc

SEQ ID NO: 247936 - DNA, 541 bp, Homo sapiens
acttaatcctaagctctgagaggcacaggaagtaaaagaaaagttaaagatgacaattaaggtgttgggcccagttagatatagtgaagtcagaattttccctcattaaaactgttagaccaatttcattagacggaaatgcacccacatatgtaaatcttctttgtttaattggagacctattgattgtaggtaacataagcctctctaagggaaacagaacccaactgaagataagagtttcttccccccaacacatacagcattcatgattttatttctctaggcgtgttcattatcaaaatcattctactgcagactttcccataaagtgtttctgtctggccctgttttcatatctaaaagcttctagtggtttcagcaagaaatgatggaaacattttgacagaatatatatttctttttttaaaactaagatcttaaaattaaagagaaacaaaaacttacaaaatcacatgaaaatataatgctttaaagagactgagaataattgtcttcttttgtgctttcatagaatgct

SEQ ID NO: 247937 - DNA, 385 bp, Homo sapiens
tgcaatgaatccacatgtacagtgaaggagagggacatgcagagccctggcctagtgcaggggtcacagatggcttctgtgctgaagggtaagcaggcaccatccatcagacgctgggttgctgatggaagggtgacgctgggctgggagaggagtttagcagcgatgagctgccagaaagcaaggtcaagtgtggtgaggaacattcgtggttgattgcaagggaaccaagaaactccatccatctccctgaagaccgctcctttcttgcctttccttcagacagtagcccatcagaccatcccaaaagcctggagcctggatgccccagtctttagggacccgaaggactgggcaggggaggcatgggatgcctgagttgcag

SEQ ID NO: 247938 - DNA, 199 bp, Homo sapiens
ggccacctcaaatttattcttgtaagagaatataaataaattgcattttaaagtaacattgcttctcatatgaaccccttgatgttacaaagcaggcacagggtctttgctgcagatgaacctgtgtctttagactccaaatacagtgctttctgttgcacgcccacagacagtccttcctcatgccactctaacaatt

SEQ ID NO: 247939 - DNA, 459 bp, Homo sapiens
ggagaatcaaatcttatttaacaaaggccattgtcataccaaataccataaagtaacattggattagattcaacctaaatataataaaagtgtgtttttctttttgattttggacgctgacatttaggggataatttgtcagaagttaatttcttgctgacaatttatcgtctggccttttgtttctatgaccctgaacaagttgcaattccagggagctgccatatactcaacgcaaataatgtcaggtccataatcacgatactgtgtcccctgcatgaatgctttctcccatgtaagcctgcgtgctctcactcttggaggctccgtttgggtcagctgctgtttcagatcttgactgggttccattaattcagcatgcctcttaccagaggcttcaggctaggaagacccctcagctaacacagaggcactgtcacatttttctagtaagcagga

SEQ ID NO: 247940 - DNA, 352 bp, Homo sapiens
tcaataagaatcaaaatagttcattatatcttcatgccaagagaacacatgatacaaattcaacagtaatttcaattaaacgagtcccctaccacacctcagggagaatatttgttaaagacatttctaaagtaactctgacatttttacttttctttgttatggtttctaatgtaaattttttcccttatcatcttatactggaggaaatatatttctatagtctcctaaacagagaaggaaaccaaatggtttcacatttaaagttattggacataatccttttactttgttcaagtaaaaatattcagcaaagccagactgaaataataacatgaatgggcttattaag

SEQ ID NO: 247941 - DNA, 478 bp, Homo sapiens
gggagcaagatggggagcgtcagaaacctaactccaggatttgctgggttctccaaactgtagcgggaacctcactcccaggccgatgcccctctagcgtctgcagctctgggccccagggagggaggaaggagccacagagggttcggacaacagcactgactgatgccagagcaggactccattctgttaacctgacaaagcgcacaggctgcgccggcatgtttttcttccactttctacactaatttatcaaactggaaggaagagatcagaacatcaaataaaaatccacagccacagagcaattaactcaagacctaacatgtacctggataaggggactcacaagaattccggtatctacaaggttttaaatggcaatgttttctaactttgtatcttgggttattggtcgtcaatgtttccaaaaataatcactcctctcagttacattttctgatcaattattgaatga

SEQ ID NO: 247942 - DNA, 371 bp, Homo sapiens
tctgttattagtctttcttcccaggaggaggtattagatgaaatcagcaagctcactattgcagcctgacttggctcctctatggctgcatgcattgacacctgcacacacactcacagagtgggaaccaagttgcattttcttcagaagagctttttccgaaggggaaaatgtccaaatgagcaaatttaggactacagaaggaagtcctgggagaagatagctttatcttggcagtgactaagcagggctgtgtcttataattatttttatcactgatgatagtaaactgtaataagactccatctcttgtgcttactttgctgcaataattaggtctttgtgcacagtgatgctgctgttgctctgtt

SEQ ID NO: 247943 - DNA, 722 bp, Homo sapiens
gattctcattgtttgtgatgtggaattcacagtcaatacagtgtaatttaggggatagtccatttactcctgtaagaaactttataaaatgctggggccatggacagggcctgcaggcctaatctttcaccttctccaaagtttcccaatagactatttgcgaagatggaataaggcccacatcccaaatagaagggtcagggcacagccaggctggaagggagcacagaacaaaattttctgttttaaaccatggaatttgtcttctgagaattagccatttgggtcacaactgcaaagtgtgtcaggtgattaagtaatagatcaatgaaagctggagcagatctgagcaaggaacatgagtcttgaaatgaatgcctgggcagagtcggcacctggaacaggtgatttccgaaggcttgcactgttacttggcctgcctcctcttggcttgagatctaggaggagaatatataatagataggaatgcctgtcatagtcacaggccattaaaaattctctgggggaatacttttttctctgagtaatttggctgaatacgagcaaatacattcttagagatgacatttgatataaacttcctgtatgccaggcgctgttcgaacactgtatctgaattaacaaccctgagaggtaggtattattccagttttacagttcaggagaatggcgtgcccgggatgcggagcttgcactggcgt

SEQ ID NO: 247944 - DNA, 373 bp, Homo sapiens
tgcagttttaatgtatacacacaggccacacatgtacccagtgtaggatccaggcctcatcaagcttgtgcctctggttctgtgcaggagcctcactcttaaagacactcattttgctgaatgactgacagtaggataacgaaaagaacttgaacttgttttgttccggtcttctggaacaaaacactctaattagcaatatcaccataaactatgcaaaactatacagttagcgcaggtttcaactagagacagtcaagtgtctttgcccacgtctgaaggttctgtagtataaaggcccatacttatagattactatgtgtagaagaatcctgtgtcaattttaatcttcattttgagttgtgctgagctc

SEQ ID NO: 247945 - DNA, 380 bp, Homo sapiens
ccttttgtttttgacttcacttagcatagtattttcaaggttcatccatgtcttagtatgtctcagaatttcattcttctttataactgcataacataatccatttatttatatggcaaattttgtatacctgttcattttttgatggacattccagttgtgtcttcctttggctgttgtggataatgctgctaggggacattgctatgcggggatccctgcttacttgcttgcttttcttttttcttatttgttagagacagggtcttgctctgttgcccaggctggagtgcagttttgagacgatggctcactgcagcattgaattcctggcctcaagcaatcctcccacatcagcctctcaagtaaatgggactaca

SEQ ID NO: 247946 - DNA, 335 bp, Homo sapiens
gatataaggtggatatcttgtccagcccggtgccactggactctctcccctgtatgtaagccgctaataaaaccctatgtcttgtttgctgggtttctggcctcttgaacctggtgtcttccctaatgaggttaataaaggttcggcacagcaaaaggtgtcatgtaaatacctttaagggttttggcctgaattgcaaaattgctctcccaaaaggctgtagcactcttctcctacaagtagtatgtaagactctgtttctccatacctcccccaaggctagctattattcttgtaatctttgccaatctgataaaaaaaattgatttgatttt

SEQ ID NO: 247947 - DNA, 640 bp, Homo sapiens
ccaaattaaacaactagcaacagaaatgttcaaatctgtcaaatccaagtgttaacagacctgggaccaggggttcctcatagtggcttagcacagcatacagaccactttcctttggcccaaccggccttggggtctggagcaccaaacaggccctgaggaagcgtgcaaggaactggaatgcggggaaagtgatgaaatattttgttggttggcctttgcttgtttgcaaaatatatccaatgctcacacctgagagacaacagacatccttatttgtgaatagtctgcactagataattcagatttcaagtcatctgtcattcgtacttgataatgatttgttcttcatttaaagtggcctgggtacagagcaacatcccctgtctttatcacatggagctctgcctgaggcagcttcagcaggtaggcaggcaggcagatggagcacagcccattctctgctggtgcactaggaacagcagcacgtgtggtgttagcagctaataattaaaacaacgtttaagcagtgggttgagatttttaaacacaaaccaactcaaaaacacttctctgctttctatgtaatagtgctcacatcatttgtatgattgtctcgtctctttaaaattggaaatat

SEQ ID NO: 247948 - DNA, 339 bp, Homo sapiens
acacttctcccaaaatcctgtgcttaacacattgttactgagcacacaggcgtgctggggcaagcgacgcctgggaatatgaagcgaacgccacacactagaacgcgccctgggagctggcctccggtgggggacgcaggtgttgaagacataaccgcatgaccgagaaacctcagttttgctctgaaggccttcaactgcccggccgaggctcacccacaccaaggggaatcccttctcttaaagtcaactgatggtagatgtcaaccacagctacaaaacaccgtcacagcaacacctgggttagcgtttgattgaataaatgtgactggagcctga

SEQ ID NO: 247949 - DNA, 264 bp, Homo sapiens
gtcagagcattcaaggctgtggtatcttatttctgtttcagctactgtgtctgtgctctcagtgtttcatatattgggtccctacgtatgattttattttttaaatttctactgctaataaaagtttcacagatgtgatagtgtccagtatttctttcaaatttgaagtttcatttgatttaatcattttatctatcatgtcatttagtgtaatttttgaacctagtaagtgtctaataaatatttgctggggaaaaaaatgaa

SEQ ID NO: 247950 - DNA, 504 bp, Homo sapiens
acaagacttcttttctaacttcaacaccatagccatcactttgagtgtcacttttatcacccctctccctcagatcttcccaaaatgcccacaacaccagctcctccaacgagcccggggagggacttacctattgggaccttacccaagtggtccaatactgatttgtaatgtacagcttctgttgtttctgaattactttcatttcctttaccttgattctcttccaaacacacagtagtggctactccaggctagggccggacctatgtgtttataaatcccacaggcctaccacagtttatggcaggtacttaacatgctagctgaatgaatatatgaatgaataaatgaagacattccgttctacactctaagcctcagcttcagcaggtgacttcatgtcctatttttctgaaatcaaaaatctcataagaatgcctgatttacccacatctacacacttaagtttccatccatcctccatgccttcactgtcatttc

SEQ ID NO: 247951 - DNA, 275 bp, Homo sapiens
aaagaagaaccaaagggtgatatcagtgacatggtggagtatctccaaaaatcctttcctccacaaaaacgagaatatttgtaaaaaattgtcaaataaacttttttagaactctgaaaattaagcaaaaacttgcaacaatgtgcacagtatttacctaagaaaaatgcctgaatctcaggaagaacagcttggtggcatttttaatttgtcatattctcacccctccacccaagctccgtaacaaccatgaaaaccaacagcctgcaaacatg

SEQ ID NO: 247952 - DNA, 353 bp, Homo sapiens
cccggccaagcaaggtggctaagtgggaaaggctccaccgcgttgggtgtaggaagaccttgaccttagctccagcccagccactgagcagccgtgtcgccttgggtgatacctgtccctggtcggtttccctacctgtgaatctgggtacttggaagccatgctcgagaagagcccatccccaggaggtgatcagggttctcctccaggtgaggaacctggcagccgtgtgtgagaaccttagaaaagggagagggaagaggctgtggcaggaagtgaggagggagttagtgataccctgggcaggatgccatgagctgggatggaaaccacaggatgaatgcaagtaatta

SEQ ID NO: 247953 - DNA, 929 bp, Homo sapiens
gctccaaagccaccttctcaatgcgactttccctaacatcttctctaaaatggcatccctgttccccaacacttcatgtcccccttccttgccacagtagaaagaataatggtcccctaagatgcccacatcctaatccctgaaacaagtagatatgttagtctaagtggcaaaggactttacaggtctgattaaattaaggaccttgagatgaagatattatcccagattatctgagtgggcccagtgtaatcacaggaggccttatacgaggaaggcaggagggtcagaatcagaggagatatgatgacaggtgtaagagagagagagaggagaggaaggcaagggagagagagagattggaagatgccgctgggctgactttgaagatgcaggagggggccaccagccagggaatgtgggctgcctctacaaactggaaaatggaagaaaacagattctctcctagagattccagaaggatcacatccctattgacccatttttggacttctgacctccagaactataagataataaatttttgtcatttaagccactaaatctgtgctaatttgttatagcagcaatgggagattaatgcacttgctttatgtttttcttagcacttattcccgtctaactcaccatatactttagttatttatcttgtgtatggtttgtgtcccccattaaaacataagctccacaagggccaggattaatttttgtctgttttgctccccattctattccagtgtctataacagtagctgacacatagtagctacccaataaatgtttggcaaacaaacagcttccccattaaattataattgtcatgaagacaaggaccatatttctcttgcacagggcttggagcattataatgcaacaaacgttcaataaattaattaatcaacaatatc

SEQ ID NO: 247954 - DNA, 294 bp, Homo sapiens
gaatgggcaccacaacctcttatggccatgtttcccaagggaaggcagtgtgcaggacagcctgcccaccctggactcctagttgacaccgagtgccactgtcagtgatccaggaccacagattctagtgactcttcagggcagaaaagcctctgttttggcttcctctgtgccagccatctgccacctgtgaactgtaaggataaaggtcgcatgagtgattaatagtggtgtgttagtccgttctcacggttctaataaagacatacccgagactgggtactttataaagga

SEQ ID NO: 247955 - DNA, 816 bp, Homo sapiens
atactttcatgcaagagggtcacagtgtgtgtggacagaggcaagtgtgtgtatgcacagattacttatctgcctgggtgaggatccttccttctggctgcctcggacctttggtcacaaacagacctttccatcgtttggacagattgagttttcccaactcatgttgcttctccaggaatgaagaacatggggctccaggaccatggggtcagtctgaccactcctttgaaaaaatgttttattaagtttttaaattttttattgtgttcatgtcagagctccacaccttctgtcttatgagacatgctctgtccaagggaggctggtgagcccaggggctggggaggtgcatcgcggcgtggcctctggcatttctttatgacagtatccttccagccattgtagcctgctccgtgcagaagcatggtttcaaattctgcccttgaaacatggattaagcaatgttgctaatacgtatttgtccctgcgctgtcaaacatttcactgattctggagtctgcagacagcttaatagccaggtcctctgtcagcatgactgcggctgtgtctgctttgctttaagatgccattgagatttattggagaaataggtgcagaatgatacctagttaagaacagcacctggttatgtatatatcatcacaactcacggacatccaaagtgaccagatgaaacggacagaccctgcttgccaacaggcaccagcctcagtgtgggaggtgagagcaccagcccctgcccatgtctccgccacactgtgcacacggcctgcggaacacgggcacctctgg

SEQ ID NO: 247956 - DNA, 779 bp, Homo sapiens
caaggcactctcctttcactatttattcagataatgccatctcctaggacttaattacagcctttatagccaacaattttctgagttttgtataaacttcctgtggtacattttttggccttttttttttttttttttttttggcacataagtaatcactgttttgcacctagggaaacactttaactgtaagagggaaaataaggtcatattttatttgtgaaagtccttctctagccttgcgtgagcctttctaaaaattttctttcaccagctcactgaagttgattcatatagccttctatttgaccccccgccccgctgtctcccattctcagctcaaggagaaatgtttctctttgctcaaggccttgtttgcctgttaaccttcagaagccactctgctcccagaatccctttcttagaaaaagcccatccgttgctctgtaagactaaccaagcgcgactttctcctccattgcggaaggaaaccggactgacccattcagcccagcaccaaatctagcgcctctccaacctctccctccctctcgtcgtccccaccctcggccagctgcagcactgcgcaccgcaggccgctccaggcccagggcaacgcgcagccgatgtcctcccaacggtccaggtcgaggtcgtagcccactacgttgcgggtaggcacctggcgcgagtcccgccacttgaggccgcccagcagcaacgctgtctcctcgaccacggccagcccatagcagaagcggtcgtagggcagcggccgc

SEQ ID NO: 247957 - DNA, 470 bp, Homo sapiens
ccattcacaattaacttaaaaaaataaattattggtcttctccttagagaaatgacattgtgctaagcaactatgatattaccaagttcctactgtgttaaaagatagatctaagcagggaagtggttttcaaaacatgagtcactaaacaaaggaaagttttatactgctttctcatgcttttcacttgttttcatcagaagatctgacaagcataaaagtgttaacatcttttattttacagatgttcttagttttccctcaaactgtaaaagatgctatatcagagtagcttggtaggaaataatttcaacacctcctttcacttacgtgataacttattgtttgtctaagcttgtggatacttttggagagagtgaattgaggcaagaaaagatagcatattgagatctaattgttctcattttgacatatataccagtcagtctatctgctatattatatagtct

SEQ ID NO: 247958 - DNA, 476 bp, Homo sapiens
aaagaagaaggtgataaaggaaaacagacgatagtggttcctatcaagatcttagagaaagagaacattaagggagacaaattggagtgatatccaactaatcagaagctggatgtagctgaaggacttcttgttctaatttatctggctgtgtcttcactgagcggaagtatgctgactgttttacatgtggtagctacaaaaatctcataaaatgtagagcaggatgcctagaggaaactgaggctgagaaagatgcaataacttgctgaatatcacagaaacaatacgtgattcaaagactcacatacagccctcttcatgattgcagaatctcaactttcaactatactgattctccacaatgatgcatttctcgttgtaatttaatataactctacaaggagaacatggaatgggaaaaatctgaccaacattgcataatatgataaaaataactcatgattaccttaaaa

SEQ ID NO: 247959 - DNA, 377 bp, Homo sapiens
atccgtgttccacccgggcatcatgccgctggtcgcctcacctgggctgagggccagggtcagtccagccagcagacaaaaccaagaaggtcttccccaaagctgggcccggtcaggcaggtggagggctcctctccacagaggcttggcagagcacagtgggaagtgcaaactcccttgggcaatgccgagggtcgggcaggagtatcccctggcccgtaaccaagaagcgagcaaggggaacgcgtcgatggtcacccgcagggatggagaagcagcgccacagggcagcagcggggctcaaaagggggcgtgaggcctcaagaagctcgcagacctccgggagggatgcggcccgcgcctccctgcagttcccc

SEQ ID NO: 247960 - DNA, 574 bp, Homo sapiens
ttttgaaggtaagttttgcaaaggccaataaaagctaccaatctccataagctgaatcaatcagtgtatgagtgtccattatcattatgtataagacactggtactaagtatggcaggagtgggagtagttaaagaggtataagaaattgttccaggattaagtatacaaattattcatgacctttcaaggtcatggggaaaacaatttcttaccaatttcatatcaagccattcccttttggttagaaactaatttctgtcatccatttttcatgtgcacttctgcagattttgtcccgattcattttcctgttgttaatgtgaatattgtcttgctgacctatctgatacacagtagagttttagcatttagaaggctttgggctttaagataataaatatttgaatacaaggtaactgaaattttctgtttcaaatatttcacaatccttagagaacttttccataagaaaaaagatttctcaaattatttgcttcagtcttcttggaataccacatactgttgttttgctattccaaaatcgtgtgaatgatgatgtggtggaggaacag

SEQ ID NO: 247961 - DNA, 344 bp, Homo sapiens
aaaaaactataggcatcaatattctgctctaagttacagctatgatcaaaccactggctcaaagtttttcagcagtggcctcattcagggaattaagtccacatattgagcttcccattagaatattacaataggttactacacaactataatgatcaccctactacacacactctaagatataaacctgccaaagcctatttcatttcacaaaattatcatgaccttactctccttctgacaccttaaatcactctttgagccccagttcaagtgccacctctttttttttttttttttgagacagtctcactctgtcgcccaggctgcagtgcagtggcgcc

SEQ ID NO: 247962 - DNA, 1006 bp, Homo sapiens
aggttttacatctaggtaaatagatagtagcattaacaaaaacggagcagataaagagaggactgggtttaaggggacagaggagaaaagttgtctttatcagccataggactagaattctagtgtccagatttccagacaaatctattttccactctccctattactccagtgtcagaaaacattaaattgccaggggactatggctgagtgcccataaaaagttgaaggcattgtgcctagtaagaggccagatacttcctatggccacagaattagagacctaagggtagaggtgattttcaaggtgatcatgtgatacctgagcaccctctgcatcattgcttccaaataattgcgtggcatctgcatgatatttccagtgacaggaagccaccttgcagacattcctgaaacgcagatgaatgcatggaaacagtaatctaagatctacctccccgcaactttgcatctttaagcctagttctggcctcccggataataatgggaaggaagctttcaaatgaacccctaacatgtgcatccctctttgttccttacccataatcttgcttccttggaaggcagctatgattactaatattttacaggtaaagaaactgagattcagtgagaacttgatttacccagggtcacatagttagcacgtggtctcagacttgaatcgagcgatttaatttttaagtctgctgctccatccatcaacacagtagctgcctttcacactttatataagacacatgcagcagaggcctcagaagccaggcttgggccgttcttttggttactggaagtcctctaattcatcaggctctagccatcctaaaaaggactttgacctctgcaaggaacccacgcgcgtgggttccttgcagatatcctgtgtctcaagtttcaccccttgcaggagcatgtggtgaaagaggagctgctcaacgccttgtactgtgaatttatcaaccgagtcaatgaggtcggggtcgat

SEQ ID NO: 247963 - DNA, 524 bp, Homo sapiens
ggtttctccctgttggccaggctggtcttgaactcctgacctcaagtgatcgacctgcctctgcttcccaaagtgctgggattacaggcgtgaactaccgcgcctggccctcagatatttttaaatttgaaaattaagagtatatattaatatcaagtagcagaaacagaatgaagtgttataaaggcgttaagtagtagggagacataaaacttaaatctttaagctagaaatagcttgaggaattatctgatgcagtactctgttgtaatatatcaaaaatggaatcacagttttacaaatcaggcagctgcagctcagagaggttaaatttccacagacctgtttatgcagcgcggtaaatgaggaagtagaactaaaattggggactctgctactctggccattaactcagcctcgctggacctgaaatcctgacggcggagccgaatatttcttgataatttctgggcttttgatttgtgtttttctttattaaaaattgtgtatatttaaaaatttct

SEQ ID NO: 247964 - DNA, 149 bp, Homo sapiens
tccctcctgatgggcactgcactgaggccttagtgggcattacctgatgccctcatcacccagtgtacaaacacctgctgacaagaagcgtccctgagcggaacccttctgctgggacaccgcaccttccgtgtcctgagtgggctgca

SEQ ID NO: 247965 - DNA, 389 bp, Homo sapiens
cacagaaagaaagccagtttcgggaaaccatgcaagggtattatttagagaagaagagagttattaaaaactacaaagaactcaaggagaatgggagggaaattatcagatatagagattatgtgtctttagggactttgacaagaacagttttgagtagagcatttagtcatatctcaatatgccattcattttgaagctttggattagtttattccatgattatcctcacctatcacgtatggctagtttaagagcgttatttaatctagagtaacagttctgaatgttttttaacaacaacaacaacaacaaaatagcgcatgtgacacttcctttacttctttgtcccattcctcctcttttctaaaataaacaaatatgtgtat

SEQ ID NO: 247966 - DNA, 350 bp, Homo sapiens
cctaaaatattctctccctagccagattccttcaccgtttctgactaaacatagaatcactaaaaatagaacgacacaaccacaatatcatcttctcaggcaattccagcctactttctcagcaaaagcagtttcttctctttctggctgcattccttgcaggcaatccgagctgcttgcaagaaaacaaagttccttgctcatctttgcagtcctgaaacctattgctgaggcaatgctttgccccagtcctgacgggagctccgttatcacaaaaccttctgtcggtttactcctttgttcaggggccactggaagagaaagactaaatgcattccacccagggcctg

SEQ ID NO: 247967 - DNA, 340 bp, Homo sapiens
actccactccatcccaccttctcccacacctacttccagtttgttccctcacttttagtagaatttgagcttaaaaagacaggattagagtgacttactgtaattttcagtgtcatacatacacacatattactattttttcctctagaggaggggaaaaaaagaacatcataaagaataagtgctatgttagccgggcatggtggcactgcctgtagtcccaggtactggggaggctgaggcaggagaatcacttgagcccaggagcgagaggttgcagtgagccatgattgcactactgtactccacctggaagacagagcaagactcttgtctcaaa

SEQ ID NO: 247968 - DNA, 655 bp, Homo sapiens
gcagactgaaagggaagtggcattatttcatctgatttaatgttcatttgcagttatttttgttatatgtttcatttgtatttcatttatgctctagttatgttaacatttgtttttctgtgatgtattatgtctgttttcataattttcattactttgagttgaaatcccaaatacccagtctatcctcctcctctctttgttttaaaatagatttcagagcaggaaaagcatcagataaacatgtatgtcacttggttttgtttgatttattgatacaagtgtctgtctttgtcttttgtcttatgttcgaagatcagcatataccaaatgggaagactggaatcatagtaggaactagattctatttccctttcactaattggaatgaacactctagctttgtgaccaccagtttttattgcttttttaaaaaagtagtagctacacaataaagaagaaaatacaaatgtgataggactttgctagtttgcttgaaatataaagtgttagagctataatttagctttcacttatgcatttctgaattaggttttgaactctaggagcaaacgcaaaccttttaggcatcaactgtcatcttctcccttaacatttatcttttttctttttttctcttgagacgaagtcttgc

SEQ ID NO: 247969 - DNA, 1255 bp, Homo sapiens
ctcagaagttagacaataacctcagccacctagaacagctctgaatctagaaactgaattaaaaacatagatttggcagcaaaaaagcaacttatttatccagcaatgatgaatctacagggggtgtgttggggaaaccacagattcaagtcagattgtaattatgtggttcataaatggaaatacccagcaagaaagaaagaaatacgtttgttggctggctttattatataatgccaagacattttccacataagccaagaaatataggaggattaagagaaaacagagatagaagaaggaatcaaaaggaaatccgttgataaataagaactattactctataatcctctcactaaattttgacatttgacaaaattcaacagctattccttataaaaatactaaaaaatagaacttatttaaaagcggattgggtattttttcccatagtcaacagtatatttaatggaaaaagtcaaaagaattttcattaacaatcagaagataagccaacaacctcctagcacaatcattattattgttttgttttagaaaagcctattcagtgtgtatatgcgatacaaaaagtactaaataaaatgaaatgaacattttattagcttaagagaaattgattgaatacctcaaatgagagaaaaaagtgattaagttaaatgatgagtttagtagagtgggcgtgctaaagtaaataatattatctatgctccatcagtaactaaattaaaaatataatggcattcatggtgacaacctcttatgaattacctggagagaaatttttaaaagaataaaaaagtagatgatattggtgggagattaggagactctcttagatccctgcaggctcaaaagatgacactctgtatcttacttacagggcatcatttcattgtgaatgtggtgtcccaagtatatgtacccatatacattggtgtgcatggtttgtagacatcttgagagcgaaaagttttatagattttgagtagcttaaatgctaatcattactgaagtctaaacgtctccttgctttatctgtttcctgcccctctgcaaactatgtcccgtctgcttgctcacttgcctccaagtaggttcagccaatggaaggcattgacagacaactacaaaggctaaaggagtggggcatccaggacccatcttcccctgtctctcactaactcgggcagccttttttggcagtagttacttgctcgttagccagctcctaaga

SEQ ID NO: 247970 - DNA, 441 bp, Homo sapiens
aaaaaaaaaagatggtttataactcttactcaaccaatcttacctcttgatgtatatgttttttaaaatttatagttctttatgaaacatttctcctaagtatattgcacgagaaggatgaaaggtatgagactattgcttattgtattgaaaacacttcctcttccagttggcaagtataaaacggtaccaactgtgaaggacttaaaaatatctttggccaggcgcggtggctcacacctgtaatcccagcactttgggaggctgaggcaggcggatcacaaggtcaggagatcaagaccatcctggctaacatggtgaaaccacgtctctactaaaaatataaaaaattagccaggtgtggtggcaggcgcctgtagtcccagctacttgggaggctgaggcaggagaatggtgtgaacctgggaggcggagcttgca

SEQ ID NO: 247971 - DNA, 408 bp, Homo sapiens
gagatcatgactgcctccccacagaggatctgtcccactggccacctcagagccagcaagcaggaaaaactaagtgtgttgaacaggagatcatgaccgcctccccacagaggctctgtcccaggaagactggggttctgtccgtaaacccctggctggagttgccggaattcctgaagggaggtgccacccagtgaggagggatggatccaggtcccacctaaagaagcagtctggccacaatctgccacagctactgtgctgcactgtgaggaattcttctctgtccaaaccgtccgatctttctggaccagcaggggaaaatggccaactgaaaccgcagtgatggctgcctcccctccccctgggaacttggtcatcttaggcagtctccagcctgctgccact

SEQ ID NO: 247972 - DNA, 650 bp, Homo sapiens
cagaaggacactgcacatgataatgggggtgctgtgagggaataatgggggcccgggccttatgcagaggtggtgtcagggaaggccttgcccaggggtgacatctgagtttagagaggtcctgagaagaggcctcactcaggtgctctggtcatcagtcccaggagcccagccttcgagtcatcccagcccgggcaccagacgtaagtgatgaggcttccagatgattcctgccccagctgttcagggctcccagcagagaagagctgtacccacagagccctgcttggcttcttgacctgcggaatccatgaccctgttacacccctaagttctgggatggttcattataacaacagatcaccggaccacggaaattacttctcctcttctactctttaggctaactcgtttttatataaacaactcatccccacccagacacacacacaaggccctagagcagcagtttccgaacagtgccgtatcccccggggatctctaaaaaatactgacacccagacaataggggggaatcctaaaaatacctgaccaagactattcaagattgtcaggctcatgaaaaacaaagaaaagtctgatactacatcctggatggaacataacattaaaactgagaaaatcggaaa

SEQ ID NO: 247973 - DNA, 250 bp, Homo sapiens
ataatttatgttccttttcttggtggaggggaaaacatcccttgcatttaccttctagttatgggtagaggcaccagccaccagccattatgaaacgcaagacaatttgtaagctgccaggaacaacaatggattagagaggaaggaagttgggggcggatggtggctatggcaagaaaacttgatgtgtatggtaagtgtaaatgaaggtctatcacaaatgcattaaaaattgttttatgtagccaag

SEQ ID NO: 247974 - DNA, 414 bp, Homo sapiens
ttatcattccagtgtaagaattcacttcttgccctacactatccatagtacaatctcccctctccctccatctttgatcccaactacaggccagcttcagtttcaaggcactagaaggagctgaagcaaatcaagaagcagagaggaaacatggctgcgagctgcatgaggagcagtcacagagcagagtagcacactgcaggaggctggtgggcagacagaggaggcagagaggcatgcagctgcaccagggaaaggagaggtgacctgcagacagaggggctgacccgtcgccaaatctgcaagtcacctttccgcacagttcccttgctggcctccctaactatcccatgtaactgagttggaaaaacattgttgatcaagagagaaaggcttgcccatcctcaatgcaac

SEQ ID NO: 247975 - DNA, 347 bp, Homo sapiens
aaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttca

SEQ ID NO: 247976 - DNA, 661 bp, Homo sapiens
tcttgttttatttatactacttgtcaaggtttatgcattagcatttggatgagattcattaaaaatataagggcacatttgatgtttggctcttaacaaaaactcaaatgtttaacctcaagtttttaacacattaacttcaaaatatctgcaaaatgtgttatacagcaggacaatatgggtataaggagaattaaggtaaacaaacatttactttatgcataaaccatagctccatccaccatggagctaatctccaaaggcatggatttgacctctgttgtgggcaagtttgtcttacaaccaaaggtcataccagccactgcaaggggataagtatatatggatcacctctgcaaatataaatcttgtaatttgaattactgttgcctttttatacattttactaagtaacccttagtattctggactccctagaaaagattttccaatatttgtatagctttacatggaaaagttagttaatacttcaccttaagacatagatcatagaaggaaaagaatgtttagttcagtgattttctagccaaataacttgacagcattatatgctatgtcttatggtaagcttgtcattctttctgattccaaaagttaataatagccttcactacttatttgaaatttaaaaatttgctgg

SEQ ID NO: 247977 - DNA, 197 bp, Homo sapiens
tgatgtgcttcgagagactggttggttgagctgggtcttcagtgtactttgggaggagcctggctcagtcacagtcacagctctggtgatgaggcatgagggattaagtatgtcaggatgggccagtgaggctagctgccctcagacacctatgctgtgtcatttgattccttttgaaatctttctgtagctctatt

SEQ ID NO: 247978 - DNA, 849 bp, Homo sapiens
catcttcttctacgtgtgctaagattacccagacttcactttacccttatttcccactgactttgatcccttttacttgtttttattctgtagtatgtatttttgtcatcttttcagtactctttggaatcagaataaattaatttccatagctaaatagatatggtagttgataaaataaaaataaagtatttggcttatatatattagcatagtatttggcaaattctttctgcagagggccagacggttaatattttaggtgttgcagggcaggtgatctctgttgcaactactcagctctgcgtcgtaatgagaaagcagccatagacaatgcataagcaaatgggtgtgactgtgttccaataaaactttattttcaaaaacaatggctacatttgactttcgtgttgtagtttgcctacccctgaactagtaagttgcttttagagaccagaccttgagaaccactaagcagcatcctttttaaatcataaagagatttaagtcataaagagagaacaacatacatttcctactctcaaatataactgtaaaggatgttcttggcttacatgtgggttgtattttagaaatttgcttgtaggttagtggcttataactcagactcctttacccatagaaatgtttgtaagtgctgtcaagaattcttattagttagtaaaatatttaattaataatataaaatgttaaatgtctgcagtaaaatgtaaaagaacgatagtattaaaacatgataattagaaaaggtggtgatgaaaaggagctcagggtactttcataggcttgagaagagtaaaagtactttgactacttctgcctcagata

SEQ ID NO: 247979 - DNA, 356 bp, Homo sapiens
gtaaaattatcctgccataccaaaagattgaaaacttcattgagtagactgcagagaaacagtcagtttcattcattgctggtagaagtataaaatggtacaacccgtataaaagggtttttgcaaaaagctaaagacatggtggacagatttacttttggttcagtaatcccactgttaggaatctacactgaagataaacttccacaaataaacaacacatgcacaaggttatttattgcaacattgtagtggcaaaggattggcgacaacacagatgcccatcaatagaaggctgattgtataactggaatatccacacaacggaatattgtgcaatgctttaaaaaaaaaaa

SEQ ID NO: 247980 - DNA, 355 bp, Homo sapiens
gcataagccaccatgcccagtccagcatatatatatatttttaaactggaactcatttttttaaatggaagcacaatctgaaaaaggaataaaacccaaagattgacaacgggctagaaaaccagaaatccccaattcagcttcttcccctcactctcccctttgaactcatgatgcgtctcaaagcccagcttgaaagccacagatctagagcttggatggcattctaatgagctaagcatctaaaccgaccacagttgggagccactgaaagtttttgagcaggtaaatgatagattgattgatttattcattttgagacagtcttgctctgtcacccaggctggagtatagt

SEQ ID NO: 247981 - DNA, 285 bp, Homo sapiens
ctccttggtctgagaattgtccacggaccactgtcggtgttcccggtagttggagagcaggcaaagtgctcccatggcgagcactgaacaaacgctagcccgagccaacttccttccagcccttggtgcacaaccggttcataccactgcacttgctgtgtgttctagattctgttttattcatttagtctatttcctgtaacatttctaggtattcatatcacctctgaaggacaagattaaaataaaacaaccctaaaccattaaaaaacaaacaaacaagca

SEQ ID NO: 247982 - DNA, 404 bp, Homo sapiens
tatttgtcagtttaaaaaaactaattgttttaaaaataaattgctgtaccatattatctctacttcccttttcagttgatcttagccaaatggccaagaagcgatcaacttcccttttcaaagtagttaattttgattaggatgcattttacactgactaataagcataccgtgaaacagtaaaatacctaaaatgtacgctagtatttcaatgatgcatttcaacgaaggtccatgtgaaaattgccaggagtgactctcgacaaagataaataatcgtgtttgtctcaattttattaccttgtcacaattctaaataccttctctggactacaacataccatcctcaaaggatcaaaacaaacaaaacccaaaaaacctgaaaaccatcatctctctctttt

SEQ ID NO: 247983 - DNA, 504 bp, Homo sapiens
acgccatttacattagcaccaaaaaaatgaaatccttaggtataaacaacaaaatatgtacaagatctatatatgatgaaaactacaaaattctgatgaaagaaataaaagatctttccaacttgagctacagattcaatgtaatcccaatcaaagtctcagcaagttattttgtaaactattgacaaactgactctaaaatgtatatggagagggaaaaaacctagaatagtcaaaacactattgaagagaacactgaagtgagaacaggggcggtaactgactgcaaggcctactacagagctacaggaaccaagacagtgtgggattgctgagaagaacaaacagatcaatgcaatggaacagagagctcagaaatagacccatgcaaatgcagtcaactgattttttacaaagaaacaaaggcaacaaaatgacccaaaaagagtcttcttgacagatggtaccaaaacaactggacatccacatgcaaaaaaaaaaaaa

SEQ ID NO: 247984 - DNA, 888 bp, Homo sapiens
agcagggtatggtggcatgtgcctgtggtcccagctacttccagctacttgggaggctaaaatggaaggatcgcttgagcctgggagattgaggcctcagtgagccatgatcatgccactgtactccagcctgggtgacaagagcaagaccctgtctctcaaaaaaaaaaaaacgcggctgggtggaacatctggaaaacatctttaaagaacgctgactcaatcaggaggagcaccattttttttcttgccctccgcccttcctgcctgaaacagataagcgccctctgtgtaccaaaaaggaatgtactgtttatagagacttcaaatcagcagaaaattcaaatagttataacttttctttataatccatcatgaaaaagagtaacgacaaataagagtgcagtggtgcagtcatggctcactgcagcgtctgcctcctggactcaaagaatcctcctacctcagcctcccaagtagctaggaccacagagttgtgctctcctgcagcgttttgcggacggctggctatcttacccagaatcaatcacactgggacactgaaaaaaaaaaaaaaaggaaaaaagagcaagggagtaattctagcctgtttttacaagaacacagtggctatagacagtgccagtgtgaagatgactcagcaaacgtggagaaccaaagattctagggcagcaccaaaactgggaaagcaattacagcagaagttgccttccccatggtagcttagcaacttcgtgtctctccaaggcagagaggaaaatcaagtctaacaggccttcccgaaggctaggtgtgaaataccagaagccatctttgtttctggcgatgtcactaaataaatatttgttgatataaagtattacacat

SEQ ID NO: 247985 - DNA, 759 bp, Homo sapiens
agcagggtatggtggcatgtgcctgtggtcccagctacttccagctacttgggaggctaaaatggaaggatcgcttgagcctgggagattgaggcctcagtgagccatgatcatgccactgtactccagcctgggtgacaagagcaagaccctgtctctcaaaaaaaaaaaaacgcggctgggtggaacatctggaaaacatctttaaagaacgctgactcaatcaggaggagcaccattttttttcttgccctccgcccttcctgcctgaaacagataagcgccctctgtgtaccaaaaaggaatgtactgtttatagagacttcaaatcagcagaaaattcaaatagttataacttttctttataatccatcatgaaaaagagtaacgacaagaagctgattcctgccaactgcatttcctgggctcatttaaccatgcccagaaggaattaggacaatgaaagataaaaagataaaggagccaacatatcctctcccctttgattcagacgacttctccaccatcgccttcttcacaatggccacttttcctctgcagttggggttcttcttccccagcaatggctccaggactctgttaactcagctcctccccagttctagaggtagacggtagaggcttcctgctattgttactctggggttccccttcttctccagtttgctttccagcccttccaactcctttgtaactagttcctggtatcaaattcacttaactgaactacctgaattc

SEQ ID NO: 247986 - DNA, 472 bp, Homo sapiens
ttgcgttacagcatggcagtgctaaagggagagttgttggcattggtcaatagtgaatgctgactagaggagaacttgtttccaaaattattttgtctgtcagatggccaacgtcagtgtcaaatgaaccaggatgacttacattcacctacagctttgtggctatctaacttacaaaaatgaagttgcaggccaggcgtggtggctcacacctgtaatcccagcactttgggaggctaggcgggtggatcacctgaggtcaggagtttgagaccagcctgaccaacaaggtgaaaccccatttctactaaaaataaaaaaattagccaggcgtggcggcaggcgcctgtagtcccagctactcaggaggctgagacaggagaattgcttgaacccaggaggtggaggtttcagtgagccaagattgtaccactgcactccagcctgggcaacagagcgagactccgcctca

SEQ ID NO: 247987 - DNA, 329 bp, Homo sapiens
cccaggtgggccacctgccaatgcacaggagagcccctaatccccaggaactctgccaaactggcctatctgggcatgtgagtgaggcaggggcaaggatgggatcccctcctgagccccagttactggaccccacagaatccaggtgctctgccagcccccctgcctctacctgttaggctgccaagctgtgggtgctggggagggggtcttcctggtcctggggcctgtctatccatacccagatctcacaccatttttttctttaaatgatggcttagaaacaaaaaataacaactgaagaaaaagattttttcttaaactcaaca

SEQ ID NO: 247988 - DNA, 368 bp, Homo sapiens
tggtccgaacttgagctcacaatttgggattagagcaaatccgagtatttttctgcttgcctgcccgctcccgggcgcccagagcctgctgggtaactgcctattatccgccggttccactccagtgccctccccaataaaacttttcatatccttataaacgaactcgattgctgtgttataaacatttacactgtgctaacagatcatctccgcacatcagaattggctaaattcccttttccagatgaatatattgaaggagattagagatatgatagcttttcagattgctgaacccagagaaattagtttagtgagcatttacagaggctaaattggaaccattaaatagtggattaaattga

SEQ ID NO: 247989 - DNA, 156 bp, Homo sapiens
gatccttttgtgtatgtttagagccagatgataaaaggtattgtagtttttcaatgttgataaatgacaaagaaaattgaataaaactcttatttaaaattttattttattattttttatttttttgtcagtggcatgattacggctcactgcagc

SEQ ID NO: 247990 - DNA, 257 bp, Homo sapiens
tgcatggtgttgctcttggctcaaagtctacaattaaatcagttgttggcactcccttgaaagcattactatcacagtttcccctacatatgtaagtcaataaatttgacctttaagaaggacagttggtgtagaccccctccactgggccaacacatattgcaaatttctgaactcaggccctgcaaagtactactgccaccttgcttctttaacagagaaggcaaaataaacagaggaggattccatggtataaa

SEQ ID NO: 247991 - DNA, 556 bp, Homo sapiens
ctgacttttgactctacgtctgcctactccctgacctatgctctttctagaaagtggacacttgcccagataacaccacttctatccacttctatccctcggggaggccctaccccatttcagctgggctcagagctgggcaaattcagacctagagtggatttcaactctgccacctgccaaagggtagaccccaacatgccatgtgtttctccagtgggcatccttgggttccctggctccatgcttaggaggctgggccctccacctgacttcttcaaagccctccccaagagccagctcctgcagagccaagagccgtgagccgatcctccaaaaaccagacccataggacaagaggccaggagggagcggccagctctcggtgaacacaggtacagggccttggcaggctcagcggtcaggacgtccaggtctcatctccagtctgcctcttgctagtcacttgacctcccgcagcctcagtttccccatctgtaagatgatgacgacaccctccagctccttagtaaaggaatgataaaatgacaattca

SEQ ID NO: 247992 - DNA, 454 bp, Homo sapiens
gccagtgattggcttaggaatggccacgggacccagttccaaccaggaagaggaaatgggacgagaagaatgatcctcctttagaatcggttgtatctaatcgggatgcagatgcctgaaactctgcagtttaggaaacactagggccctctctgtgaaacattgagatgtccaagtggaaagagaacaaatcctgtattcgaagaaacggtggaccgaggctcgccccggcggacctggacctgcgtgcctctgccttctcatgtgaactgatgtctcttgcttgaactcacttgagtaaaggttttgtgccacttgtagcatgtgcagatgtaaccatcaacacggaactcctacttcctggagactgggggggatttgaacttactgtaggttcacggagtgacaaagctgtttctagggccgatgcagccgtgggccatgtgaataggat

SEQ ID NO: 247993 - DNA, 324 bp, Homo sapiens
aattttgtctaagattccccataaaagaaagctcttactgggcggggagccatagctcacgcctgtaatcctagcactctgggaggcagaggtgtgtggatcacgaggtcaagagatcgagaccatcctggccaacatggtgaaaccctgtctctaataaaaatacaaaaaaaaattagctgtgtatggtggcatgggcctgtagctccagctacttgggaggctgaggcaggagaatcacttgaacccgggaggcgaggttgcattgagcggagatcacgccattgcactccagcctgcgcaacagagcaagactccgtctca

SEQ ID NO: 247994 - DNA, 724 bp, Homo sapiens
gctacattccagctatgtgatattggtcaatttactaaacttttcagttcttaatttttctacttataaaattgtgataataagaataattgcttcagagcaattgttgtgagaaaattatatataaaatcacaccataaataatacatataatatacttagctcagtttatggatcacagtaatagttcagcaattgcatattattattattgataatagtaaccgttattatgcaattgctccgtattgctcctcatcctgtgttcccattcttgataaatgttaccaccattcgaccaatttttagaccaatgtcctgaattatcattgacacatcttcactcatcttatttctatgcattgccgtattcttaagttcaagccaccatcatttcttccttgaattactgataacttcttccttgaattactgataaatgttaataaattagatataattcattttcataattccttgaattactgcaatagctaactcatctccctacatttcccttgcatactgtgcaattcatactcataatagagctggagagaattttggaatatttaagtctgatcatgttacctcttgcttaaaatgtctcagtagcctctcataacttctaatatgaagtctatccttgatatgagctataatgcccagcatgacatgtcctttgccttcccctgtgccattcatctcctctttatcacctttg

SEQ ID NO: 247995 - DNA, 394 bp, Homo sapiens
ctgtgggtctgtactgtgactcaggaccagagcactccttactcctggcagccttataaagtcatgccattgatcatgattgaggactgggcgggaaaggcctcccctctgcaaatctttcacaactacactcctaaaaataactcaagtgcatgtgcctggaagcgcagaagagtgacttcatgacataccaatcatgttgtataatataggttgtataattcacgttaaaattttaccgttctatgtcagcagtaattagaaattttttcctaagtgtaattaaagacctgcatatttggggcaggaggaagtagcgcttttgagtaggaatataccatttactgagtggcacatgaacagaatcttgtgaaaaattaaagtaagaaattaa

SEQ ID NO: 247996 - DNA, 464 bp, Homo sapiens
gcataaaaaactattacattgctaccctgaaattaacccttcatttttatttctcttcacttattttcattttattattggctatactaggaagaattataaatacatataataagcccacttggtaaacttggcttgataccctgaaaattcgtttattccctttttagaatttgactgcttgtaagaataactagattgtacaaatactattttcaaggacctattttatctaggggaaaaagtactatttcttttattgtatcaggattcacaaataaagtaaggttgaagtggaatcagtgataaacagactgttaggttttagtgcttatcttgatatgtggatttaaaactaatattcgtacttctctttggagaaaaacaatgtcaaacatagtaagctcaactttgttatacagatgtaattattccaataaaagtcatccaagcgttttcactaa

SEQ ID NO: 247997 - DNA, 471 bp, Homo sapiens
cattatcccctccctatccagtcagagggcattaccctcctggctttgctatgtgccaatacacatggaatattcccagccagtgaggctcctctcaagcctcagtattcagggtttttactggaacttcatcatagaggcatgcttgattgtccacgcagctgctctcagcttccggtctccagtccttccaggggtgaactaaagcccggactctaaatcacaaagtccattttcctggcctggctagtctccaccctaaatctcattattagacaatccatcatgacccaagatccgcaggcaaagatagtcctatcaggtattacgtgttgatggttacttcgcaggagtctaggagaaaggacagacctctttttggtcaaggttaatttttttttttttttttttttttttttttttttactatacaacatgccatcgttctgttattttttctgtttcatcttc

SEQ ID NO: 247998 - DNA, 413 bp, Homo sapiens
tgaaacctggctgcacttcagaagcacatgggagctgatttaatgtcaggcagcatgcagaccagtcctcacaacctgtcgatgtttttaaagctccccgggtgactccaacgcacaggaagctttgagcgtaactaagtgagcctcccgccctgaaatgagagaaaggctttcaggcttgtggtgttggtggactaagtgtggcttctggccattcacacagtcaccacactgcaagggagctgggaactggagcctgtgagaagcccctgtgaacaatgttctctgtcttaaaacagcttacacggacttctcctttttacctctaaaagattcattcccctttccccaaccatataccccagattgcaaccccttgctattctcaaataaactttttgttttggagtgtc

SEQ ID NO: 247999 - DNA, 471 bp, Homo sapiens
caggttcatatactgtccagcagtatggtctcagaaaactgacctccttaagcctttgtttgtgtatctgcctaaactcattgagagttgggactatttcacacatacagtgcctggcatgtagaagggacttaatgttgaaagaaggggaggcattttaaaatccacatcaaaaaaatgttgttctgtttgggagtggtggctcacgcctgcaatcccggcactttgggaggccaaggcgggtggatcacctgaggtcaggagttcgagatcaacctgagcaacatggtgaaaccccatctctactaaaaatacaaacattagctgagcatgggggcgggatcctgtaatcccagctacttgggaggcttaggcacttgaatgagaatcacttggacccaggaggtggaggttgcagtgagcaatgattgtgccactacctgggcaacagagtgagactctgtctcaaaa

SEQ ID NO: 248000 - DNA, 252 bp, Homo sapiens
tcccagctctgtgtttagtgacatcatgcggtaggttggaagtcgcccacggtgggagggtttgcacatggaaggaaactggcaaacactacaggccgggtcctccctcccacctcaggagctgtttgttaaacgtttgctggcatacctctaggcaaacacatttttacaattagccttccatatgtatgttttctgtttctcttcttttttctttctcacctaaaatatactaatgtatcttgctacata

SEQ ID NO: 248001 - DNA, 395 bp, Homo sapiens
ttgccatgtacttaaaatcacttttaggccttaggcggaaggggcagggtggaagagattaggtagtgtccctttaagagttgggcagacctgtgcagatatacaaaaacagagtcctggccgagcgcggtggctcacacctgtaatcccaacactttgggaggctgaggcaggtggatcatgaagtcaggagtttgagaccatcctaggcaacatggtgaaaccccatctctactaaaaatacaaaaaatagctgggggtggtggcgtgtccctgtaatcccagctactcggcaggctgagggagaagaatcacttgaaccagggggtcggaagttgcagtgagctgagatcccccctgcactccagcctggcaatagagcgagaccccctctc

SEQ ID NO: 248002 - DNA, 457 bp, Homo sapiens
cagccaattggcaggcaactgacagccgctggccttttgcacacagggcctcactggagctgtactttgttttgctgaaggtgacttattcacacatcccagatgttccctgtaaccgagagccctggaaacagctaccgaaaaacacatgtgttttctaaaggcctgacagaaataaatatgagcaaacagcctgaggttgctgtctgatcaccaggcagtctaagggctgaccccatctcttcatttcctctctgtgctgctgggcctcccttccctaatggggcaggatctgaacagctctggttgtagttttagggtttgctgtaagtagtttgaatgtaataaactcatagaagaacattaaaagtgttaaaaagagggcaaggagaacagaaaaagctggtattagcttgaaatgaatatgtggaaaatgcaagtatactttgaaaatgat

SEQ ID NO: 248003 - DNA, 413 bp, Homo sapiens
atgtcgtaagttactcaggcatttatcttccctcatattctctggtgaagtagagatagtcatctccgttgaaacagatgctcagggatgtaagtaaattgctttgttgagtgaacagggaattgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccaga

SEQ ID NO: 248004 - DNA, 2252 bp, Homo sapiens
  misc_feature (438)..(438): n is a, c, g, or t
  misc_feature (474)..(474): n is a, c, g, or t
  misc_feature (492)..(492): n is a, c, g, or t
  misc_feature (1969)..(1969): n is a, c, g, or t
  misc_feature (1986)..(1986): n is a, c, g, or t
  misc_feature (2030)..(2030): n is a, c, g, or t
  misc_feature (2065)..(2065): n is a, c, g, or t
  misc_feature (2145)..(2145): n is a, c, g, or t
acacacacacaatatcaccatgacaaatacacattacacacacacaacatcacaatgacaaacacacattacacacacaacatcacgatgacaaacacacattacacacacaacatcacgatgacaaacacacattacacacacatcacaatgacaaacacaacattacacacacacaacatcacaatgacacacacatcacacacacatcacaatgacaaacacacaacattacacacatatacacacagcctgagggccctccccagcccagactaacacatctcggggtgaggaccagaccttgttcataaccctgggcctcttaaccactgatctttgaaataaatggcaaatagttgtacctggatctgtctagttcttaggggaacaaactgaagaagggtggagaggaattgtcaggcctaaagagccccncagggaaagggaggagtcggatggggggcaaccatnagcaacaagtggtggctnctagaggcagagggatggaggtaatgacccatggaggtcattctacagatgaggaacctggacccagttggctcaagtccatgcaggaaatgtgggggaaaccagagacctcacgtctggatctggcttcctctccaatccacaattcctgaggaagtagaggctacatcccgcaagacgcccttattagacacatccaggacagaatgacaatccgccaagccagctggaagcataaaacacagggagctggtgggttgggtgggggcagataatgatatgcatacaaattagagggtctatgcaaatgagcattgctgcagtgtggctggagggaatccttagttcctaggattctaggatatgggtttcgaccccagaggtgaatgtattgttattattgttttgttgttgttgtgaatgacaagtcaaaatttgtgggttattgttgttatcgccaatagtattcttgtcattgttgcacagtacagagatgaaggaaacagattttgcaatcagatgatcctgggttctgagtccactctgccactcaccagctatatgacctccagcaatttccatcacctctcaatgcttcagtttccccatcggcaagatggttgtggggggagaggaacaacagtacagattcaccatcccaaattcaaaatgctccaaaatctaggccgggcgtggtggctcatacctgtaatcccagcactttgggaggtcaaagtggacggataacctgaggtcaggagctccagaccagcctggccaacatggcgaaaccccatctctactaaaaatacaaaaaattacctgggtgtggtggggggcacctgtaaccccagctactcgggaggctgaggcaggaaccctggaggttgaggttgcagtgagctgagatcacaccactgcactccagcctgggtgacagagcaaggctcccatctcaaaaaacaaaaaaacatgctccaaaatctgaaactctttgagccccagtgtgatgccacaagtgggaaattccacaactcatcacatgtgatagattgcagtggaaatgcaggcacacaccacgaagtttactcagcatcctcaaaggaaatccccgtcagtagctatatatcattttctcacatgccagataggtatctctcatcttttactgttaggtacttctgtgttgaataggtggaggaaaatgattgctggttagtagtatataaattcagagtcaggaaggatggtgatgtcggctgggtgcagtggctcatgcctgtaattccaatgtgataccctaccttgtgtttaacgtgattgactctcccttagctgagagggccaggcagactctattttggcttcttcgcttgcagtctctcacccaccccccttcctcaaggacttaagctgactcccagcacatccaagaatgcgattactgataagatactgtgacaagctatatccacanttcccaggaattcgtcnggttgatagcacccaaagcccccgcgtctatcaccttgtgatanatttaaagcccctgcacctggaactgtttgttttnctgttaccatttatctttttcactttcttgcctgttttgcttctgtaaaattgcttcagctcggctccctcttccccttntaaaccaaggtataaaaagaaacctagccccttctttggggtggagagaattttgagcgctagccgtctctcagtcgccggctaataaaggactcctgaattagtct

SEQ ID NO: 248005 - DNA, 382 bp, Homo sapiens
aatttttcttaatgttttggtttccagtgtacagactgaacacatctgtgattagatttatcaccaagtattcagcttgttttgtgttattgtaaaaaacaattgtctgtaaatgaattaaaagaagtttgaaaactgttgctatagaataaaaaatgtacaaaactagagtttgtaacaattacgtgtgtatacctatatatctccccttatggtcaaactacatttacttttataaaaagtaaattcacaagaagggtcatctatggagtgtgtgtgagtagagtagatctgaattagaaaggatacccagggactttaagtgtggattgtttgttctttaaaacaagacagaaaattcagatttagaagcagatatgat

SEQ ID NO: 248006 - DNA, 597 bp, Homo sapiens
cagaataagatagcttttctgagaaaagtaatttttttttcagttaaatagcttgctggttttatgcatggtatagcaatcttcaggtctgtttccttctctttttcctcctattcttatgtttaagctgacatctttccacttactctcttcatctctcattattttatgctacgttagactccttgctgcctacattgtagtaagtggtaacactgcttcattttggagagtgatctaaatctgttattcccaatgagcgtgtgtaccagatgtatttcgggaagttaaaagaaatggccatgtgtggtggctcatgcccgtaatcccagcactttgtgaggctgaggtgagaggatcacttgaggccaggaatttgagaccagtctgggcagcaaaacaagaccccatctttacaaaccataaaaaaattagctgggcattgtggcatgtgccggcagttctagctactttgggggctgaggctggaggatggcttgagtccagagtttgaggctgcattgagttaagataggcaccactgccctccagtctgggcgacagcgagagaccctgtctctgaaagaaattatattt

SEQ ID NO: 248007 - DNA, 880 bp, Homo sapiens
gtaaaggaaattacataactgaaatctgaaaatgctaataaagacctataacacagatgacaagcatgagcagaacagatttgtaaacacaatgcaagaggaacatattgtaccagaggacaattatgttgattgcacatgatattttggatcaaggatagagccaggtcagatctcaacattcatgctgatggcataaggaacagtataaacaatctgaaagccatttctgtctcaatttatatagtttcataaatgacatttaactacaattgtttttttcccagtatttaaaattaataccttggctataaactcattccttaaggataaatgattgtggaggaggaaaaatactcagacacataagtgacccgggaaggcatgttggtcatgagaaatccacatgttgtctggacatgagcatttgcttgcatctaaaggaaacatgacattgattcttccagtttcaggatttaatgttgcctataacttttaaaattgtttagacagtgtggaaattataaaaatatgagatgaaaagtttcttggagataatctaaacataacttattttccaaatgaacaaatcacagccaagagagtttaggtaagttacaaagagtaccatagcatataaatgtcagcaagaggtagactgtctgttgcttgagcctggaattcaatgggatgtcgaaacaatggtatactatacattggtaagggcagagtataaggaatacggtggagaacagaatgaggaaagaaaattaaagcggcaattagacatacatatttaacaccctcattttccaaaaggtgaaggttgtttctgtggagttatgaagagttagaacatactcagaatggaaggagaaaa

SEQ ID NO: 248008 - DNA, 307 bp, Homo sapiens
gagcatggcctttctgccaaaactgctaaacatattcattctgattatacatttggaaatgggggaaatgatcataatgtgggtttttggacccactgtgagagcagggttgggggtgttgagaggggaagacactgtggtggtacttcaggttcctgggtatcaatgccaactcagaccctgtaaccctgtttcccaagtcaaaaacttctgcatattcttttcccagtgtttggttgtgatattgtaaaatatgtatttggtctttaaccccttttcctggaatataacttctaaaatccttaaa

SEQ ID NO: 248009 - DNA, 859 bp, Homo sapiens
tgagttatgttcaatccaggcaacatgattgaaaaggctgtgctgacagcacttcatataaaaccaggcagacaaagtggaagtggacagttctttaaaatgtcaccttggtactcttttggcttgtatcttccctctgaactccgaaagttatttgtctacctttgtcttgaagcctgccaaccaccttgcccctcatactcttgttttatgggctgtgtcttccacctttggtatcttattatttttaatggcatttctcctaataaagtctcagcagttccacatggaacactaactggcagaacttatcactgctgccaggagggtgaggttggagtaggagtggggaatgccagtagtgaatgtgatgttctgcagaatgttgaagggagaaacttttatttatttattttttaaggactttgagactgaaagttattctagtgttggaggggaaggcagaaggtcatggtgtcacagttgcagatgaggaaagatggctttctccttagactacatttcttgttgaaaaatccattgttggcctgaagcaggtaaaccagttgtcaggaaattaatgacaaaggtcctttaatggatcatattctgtcagggggaaaggtccctggcttttaagacagaagaacattcccttttgcccattctagtattttattctactaccagagaggcttatagagattaagacccactgaataacagtagggccctaatgaaatttttagtattgacgtgtagttgatagaatctacatatatgtatgtgattatttttgttggttacttattgtataacttaaaaaatagatttgttgagatataattcacaaaaaaag

SEQ ID NO: 248010 - DNA, 444 bp, Homo sapiens
ttttaaaacaagctgacctcccaagtagagtacctgggcagccctctggctgtaagtaaggctgtggtctgttctcttttcggtgtaggcggagggccatcccgcttcagagccctcacttcacacacaggatgttccaatgtggatgatgcaattcttatcacaaacaatctacaaaggattgagatatgtttaaaatcatttcctggagtttgtggtgatatgcactctttctgtttgtctaatctgaaggcctgttgcaagaacaatctgagctcattatgtgactcaaaaaccagagagaactgcaatctctctgtgtgatgaggactgactgggaattagggtatttccagttgtagaaatgtctttcattctaacaaggactagtgcattctttttccttaaagagagaggagaaatagaaagaacaagtgtcatagc

SEQ ID NO: 248011 - DNA, 519 bp, Homo sapiens
tgggaagtagccctatttgtctctgatgtcacagaagaagagtgacagtcaaatgttggttacttttcctgttgccttagtgatcactgtagctgatgtttgctgagaaccgtttatgtgccaatccctgctctaagcacgtggactaatgcatcaactctcaacaacaacttgtgaggtgggaacgatccttaacttccttttacaaatgataaagcagccatacaaaatgaggatgacaacattctccttgcctactcccggcccacagggctctctgtgattcagcaatggttggcccctggtgaggggaaactgtggcctgggcgcctgcactatgtttgtgcaagatctgtattctgaaaattatgaaatattgctaaattaaagaagaaccgacccggcgcggtagctcacgcctgtaatcccaacactttgggaggctgaggcaggcagatcacttgaagccaggagtttgagaccagcctggccaacagagtgaaaacctgtccctacaaa

SEQ ID NO: 248012 - DNA, 234 bp, Homo sapiens
ccagtgccaacagtatgtaaggttttctattctgatagatcacagggtaaactgtcacaccagcacatttacctttaatcctaagaaagccccaataaataataggatgtgtttgtcttaccagtgttgctccttaccagaggtcataagtagatcctaatgtcactggtgaaatgaataatttttccacatgaagttttaaaaattgttatacattagacctgaaaaaaatta

SEQ ID NO: 248013 - DNA, 307 bp, Homo sapiens
tatttttatttgatgacataattggaattttgaacgtgactgcatgtttgattttaaataactttcctttaaaaatataataatgctgttgtggctaattaagtgttcttattttttagaaatgcatactaaaaattttttttaaatgatagggtcctgggatttgcttcaacaaaacacatgaaacaaagcagtatattcaggtggattggctatggtttaatggtttgagggctgggcggtggatatgggggtttatgctactgtttttgaacatatttgaaattctctgtaataaaaattcaaa

SEQ ID NO: 248014 - DNA, 596 bp, Homo sapiens
agaaaaggtaacatctactttattcactcaacaactattaattgagaaaaaagtaagtgctggggatacagagatgaataagacagataaggtcactgtattagagggacacagtacacgaagaatggcagattgtggtaggtgctctgtggagagtaaagcatgctagtccaatgaagagtgattgagcatggactaaggaggccagggagggcatctcaaaagagatgatatttgagccatgacctgggtgagaagtagcagcaagccatacaaggaatattcaaggcacagggaacaccaaatgcaaaggccacaggtcatgtttgaggaaaaaaaccaggccagtatgtctgcaatgcattagacaagacaggagaaggcacaaaaggaggtgagcaaaggaggcagagatcggatcatgaagggctatgcggaccctgacaataggaccactggaggaaggtaacagagaaatgacatggaactttctatgtgtctgctaagtgcgtgtgaatggcagcagggagtctggggcagtggagttggagaaaataggcaaatttgttatattttggaggtagacctggcaggac

SEQ ID NO: 248015 - DNA, 581 bp, Homo sapiens
tatttacatgatctggctgagtaagctatgttcctattcatctctcagtgcctttctgtagtctggcaaagagaaggactggttggctttttatgttgttttttgttttttgggtttttttttggtaaatggccttaaaggcttccaaacaagctcttattttaccctcaagataatcctgtaaatcagatagaacaagcattatcgccatttatttgaggtatttcaactcatagcagttaagttgtatgaagtctagtgatacatgagcaagtatcacgtaatagctggttagtaaattatttttgaaaacatgtttgattactcaattcttttgattactgagactttagtttcagcttcttagcccagtttattcagtaaatgatttactcagtaaaatattcatcaaatatttcttgagcacctattacttgctacacattgttctaggtgctggatatagagcagcaaacctgctcttgtggggcttacagtgaggtacgctgtgacaatatgggatgtcattctcatgggagtgcaagggaaaataaagctcttatgatgtttaatacagaata

SEQ ID NO: 248016 - DNA, 381 bp, Homo sapiens
ctcacacagagcatgagtgaccagtcatcccagttcacctctaggtgtgccaaggaacaggcaggccacacaaggaagaggaacgtgttccacttataaattttttgaggttatcctcattgatccattccataaaactatcagaggaaatcttgacacccagcagatcaccaaatctatccacaagcatggggagatgtgtgggctgacatcctcaggctgcaagagccatggccttggaaagggccgtaagttctaccacgctattggtggttctcaccatgcaacttggagaaggtgcaatattctccagctctaatgttatcacagatataagtaacgtttgtaaaattcatacctaataaatttagaacagtcatg

SEQ ID NO: 248017 - DNA, 456 bp, Homo sapiens
actcttgttgcccaggctggagtgcaatggcacgatctcagctcactgcaacctccgcctcttgggttcaaataattctcctacctcagcctcccaagtagctgtgattacaggtacctgccaccatgcccagctaatttttatatttttaacagagataaggtttcaccacattggccaggctggtctcaaactcctgacctcaggtgatccacctgcctcggcctctcaaagtgctgggattacaggcatgagccaccgcgcctggcctagtccaagaattgaaacaaagcttatactttattagtaataaacacctaatgagtgttaaactacccctcacttcaaaactacccctcacttcaaaataacttactgcagaattactttttcaattccagaagcaagttaatcacatattttaaaggaagaagccccaaactgttgaggatgacc

SEQ ID NO: 248018 - DNA, 910 bp, Homo sapiens
tcggcaaaactttcaactgctcctctccccgcacccagctcactgtgccagggccagccctcataccagaacctcctacctaactgagagcgcatctgagcaggggcagggcagagagcccagtaggccctggggagagtgaggagatactggtagttgcctctgaatatccaatctcttttttcttttttcctttcttctttctttctttaccttctttctgcccccgcccccccgcaagacagggtttcactttgttgcccaggagtttgagaccagcctggacaacatagtgagaccttgtctttacaaaaaaacaaaaacgagagagaaaataaccaggcacagttggtgttgcccctattttcccaattaactgtggaaggccgaaggtgggaggatcactttgagcctgggagatcaaggctgcaatgcgagccggtgattggcaccactggcactcccaagtctggggcacacagagcaataactggtctctcaatggatcaatcaatcactcaatcaatcaactacgtcttccactcactcactcacacgggggggggaaaagcctccttatgggcatataccgtgcaaatctctaacgtagacaaagcaaatcactccatggtcacacgcttatccaaaaataatcagggggccctaccagggtgcaattgacaacccatacacccagatctaaacggaattcatgttcggatagcagttgggagttccacataacctttggcccaaaagctgtgccattcatgtctctagtaaacacaagctcgccaatttggtttccccaatactggtccccgggaattaagggacttcaccatctcaagttccttaaaagctcgcacattggtcaccttgattaaaaccggggcccagacggcgcacc

SEQ ID NO: 248019 - DNA, 514 bp, Homo sapiens
tcggcaaaactttcaactgctcctctccccgcacccagctcactgtgccagggccagccctcataccagaacctcctacctaactgagagcgcatctgagcaggggcagggcagagagcccagtaggccctggggagagtgaggagatactggtagttgcctctgaatatccaatctcttttttcttttttcctttcttctttctttctttaccttctttctgcccccgcccccccgcaagacagggtttcactttgttgcccagggtggagtgcagtggaacaatcacagttcactgcagcctgaactcctgggctcaagcaatcctcctgtctcagcttcccaactatctgggtctacaggtgcatgccaccacacccagctaaactgtatttttttgtagagttggggttccattacattgcccaagctgccattttttcttagtaacaaactctcattttgttttccatactgtacctggaataaggactacacctcttagttccttaaa

SEQ ID NO: 248020 - DNA, 392 bp, Homo sapiens
gtaaattgctgctaaagataagtactatgatggaggcttatcaagcattcattcattcaatgataaatgtctattgattatgagacaccagtcagacctgcactggaaactaaggatgcagagatgagaaaacattctggtcctgtccttgtccatctgtccatcctgtctaggagctgcttggcactaccagcattcttctctctccttttctcagtggaaatgaattcaaccagtgttgtagttggccagcagtttaaaataggacagtgaataaaacaagcattttccccctaggaactcagacagttggggctaaaggatttcactcttatccctttgtaccagatcctgccttgaggtaacctgagacggctggcttttcaaatcct

SEQ ID NO: 248021 - DNA, 368 bp, Homo sapiens
caggtttttctacagtaaagttacagttttaacccttttccatgctgtactctttgaaaggaagtccttatgaacagcctacacttaaggaatgtagatactctacctccttggtggtggagtatctgcatacattatttggaattcttctgcattcatctggtctccatttacttacttatttaatcatttatatgagtatggactcatagacttttattttataccttgggttatagtccaatactactttatttcattgctcaaattgttgcagctttgaccattgggagcgctttcctttgactcctaggtctttttctgtttgtttgtttttgtttttgtttttctgagatggggtctcactc

SEQ ID NO: 248022 - DNA, 433 bp, Homo sapiens
gctgttatttttacacagtgaaccatgaatactgattttaattccaaaggctcacaaattaaagagcttccttgaaccctggccctcaggattctttcagtctcctggtttttctgtctgctttgtcatttctcagtggaatgactaaagccagaacctgctgggttagtgaatggaaataaagtattggtggatgtactcttcctgccctgcccgtccaagactagactgtgcggttggaatccatgtttcaatacccaaacactgcaccagctcacgactacaaaattagatgagacccaaaaaaatacaaagagtcaatattccaagaagatacttgcggttactgggtccaagatgtttgaattataggtagactctatctctgccagggactgaaatacggccagggcataaaaaatagcctgtttaa

SEQ ID NO: 248023 - DNA, 331 bp, Homo sapiens
aataggcatgccaacatactgcttgtaggagtaaaaaaatcatatacctttcttggacagccatttggcaatttctatcaaaatcttaaaagtactcatcctttgaccaggcaattccacctctgggaatctattctacagaaatattcacagaggcaaatgtagataaatgaataaatatattcccagcagtcaggtttgtattaaaaaattatacatatcataaatattccttggtaagagaatgattagctactaaagggtagctaaaagaaatgaggtagatctatttatggacatagaagtatctataaaatatattgtaaattaa

SEQ ID NO: 248024 - DNA, 465 bp, Homo sapiens
agatttttttttgtatcgtataaaatctaaatttccttggagtaaataaggtacatagaatatttaccaaaactcttttagcctatactgttgggtggcatttgtaataactcattttagcaaatgtaggtctaagcaccatggtgtagggtctgtactctttgcaaacgagctgtgtgcctttgggcaggcaccttatttgcttgcaggttttggttttcttatgagtaaatcaaaggctttaggttagataatctccaaatccccacttcttaaggtaccacaaggtgtttttggagcttgataattccccatagcctcataaaatttctgactcattccctaaatagcatatttacctgtgttttgccctttgcagcttcactctctttgaggagaaaatcaagaaaagtacttgcttctatacatccttctgttattaaaataaaactttgaaatagaatt

SEQ ID NO: 248025 - DNA, 323 bp, Homo sapiens
aatgtgatcttggcctgtaaagaaacaaaagactacttttaagacaaaacataaactgcattacaagccagggagtagggttgatgggaggactatgggacggcagtggggggaaattagagagttgggcacagctctcccagacagtgtctgaagaaaaaagactgtgtttgttcctggaacagaccaaaaagggaggatgtgaagactgatgaaataccaaagagagacttgggataaagacagttctaattgaaagggaaagaatggcaggacaaaagttcatggggaggagaaagaggagctcagtaatgagacagcag

SEQ ID NO: 248026 - DNA, 179 bp, Homo sapiens
agccttaaaagataccagaaccactcagctcagccacagttggattcctgacccacagaaacgatgagatacttggctggggtcaggtctgctctatgcatatttcatcctccatggaccagagctgatttttgtcatggtgacgacagtagcatgagaagaaagaaccccactgtgca

SEQ ID NO: 248027 - DNA, 340 bp, Homo sapiens
attttattacttacaactagtaaaaagaacactgggtatagatagctcccaaagcaatgcctccctgagctccaggctgtgtcaggttttataagcatagggtaatgaggcatgatctgactggatcttgcaatgaggtaatgccaagaggcatgatctcactggatcctgctaatgagtgatgccagagctcaatctgattgcatcgtagatccagccatgcagtgtcaacttcctaattcagtccctgctcctctgagcacttaggttcccccctgtggctacacacttggttcacctgggcctgctcaggttacatgacctgaagctccattagcaa

SEQ ID NO: 248028 - DNA, 227 bp, Homo sapiens
ctgggcaacaagagcgaaactctgtctcagggaaaaaaaaaaaaaaaaaaggagggggcgcttcatcttgactaacttcctgcattggtggagcttgatagagtggtccttcccagatccttccctgcatacagagcctgtctcttttctgattggtccctaaggccagattacctgtccctaatactgagcagaagctggtgaatgaaacaggagatccctcagtc

SEQ ID NO: 248029 - DNA, 100 bp, Homo sapiens
catctttgttgttgttttctcctgggattccctttacctcccttcttaatagtcctttctaggaatattgtgatggcaacctacttttcctcctattgat

SEQ ID NO: 248030 - DNA, 406 bp, Homo sapiens
acgttctctccaaattcacatattgaagtcctaaccccagtacctcagaatgtaactgtatttggagattcggtctttaaagatgggattacaggcatgagccaccatgcccagctacattctttttaaacattcagaaacaggtaaaactgaaaaatatataatttagacacaacacttatgtgaaaagaccaagtttaggatgttggttacctgtgacggggcagcaagattgtgggaaaggaaggaagctacaggtatgtgacagagagttgcattagcccaaatctctacagagctggtgtcaaggatgaaactattggtgttttatttggaagatacaagcccaaggcgaggtgagaaaaaagagaagggaagcaaaagaagacacaaagtgacacaaaat

SEQ ID NO: 248031 - DNA, 499 bp, Homo sapiens
tcccaggttcgagcgattctcctgcctcagctgcccgagtagctgggactacaggtgcgcaccaccacaccaagctaatttttgtatttttaatagtgacggggtttcaccatgttggccaggatggtctctgtctcttgacctcatgatccgcctgcctcagccttccaaagtgctgggattacaggcatgagccaccatgcccagctacattctttttaaacattcagaaacaggtaaaactgaaaaatatataatttagacacaacacttatgtgaaaagaccaagtttaggatgttggttacctgtgacggggcagcaagattgtgggaaaggaaggaagctacaggtatgtgacagagagttgcattagcccaaatctctacagagctggtgtcaaggatgaaactattggtgttttatttggaagatacaagcccaaggcgaggtgagaaaaaagagaagggaagcaaaagaagacacaaagtgacacaaaat

SEQ ID NO: 248032 - DNA, 457 bp, Homo sapiens
cttgcggcactaagacttgagtagtaggcatgttttagtgaccctagggtcttgtgagtgtaaattagtgcgattgactaggggaagggagcctactagggtgtagaatggggatgacaagacagggcggcggagattgtgttggcgtgaagcgagggaaacactcggccgcaggacaaaactaaaacagcaagggggcaccgaaagactcagtagtccacgtgaatatcctgattatgttgtagctgagataatgtagggtccacccctaccgggtctgtgggttttctcttcgcgtgtgtgcggagacgagagatcgaagagataaagacagaagacaaagagataggaagaaagacagctgggcccgggggaccactgccaccaaagcgcggagacagacaggtagtggccccgagtgcctggaggcgctgctatttattgtagtcaaggcaag

SEQ ID NO: 248033 - DNA, 603 bp, Homo sapiens
gcaccgattgatacgcggctgatctgactacgcggctgatctgactacgcggctcgatctgactacgcggctcgatctgactacgcggctcgatctgactacgcggctcgatctgactacgcggctcgatctcactacgcggctcgatctgacacgcggctcagcacagctccattagaactgaccacatttccagggctccctagatacctgtggctagcggctgccatactacaccgtgctgggctgtagaatggggatgacaagacagggcggcggagattgtgttggcgtgaagcgagggaaacactcggccgcaggacaaaactaaaacagcaagggggcaccgaaagactcagtagtccacgtgaatatcctgattatgttgtagctgagataatgtagggtccacccctaccgggtctgtgggttttctcttcgcgtgtgtgcggagacgagagatcgaagagataaagacagaagacaaagagataggaagaaagacagctgggcccgggggaccactgccaccaaagcgcggagacagacaggtagtggccccgagtgcctggaggcgctgctatttattgtagtcaaggcaag

SEQ ID NO: 248034 - DNA, 922 bp, Homo sapiens
gtttgttctttaacacatttgtattatctttcagttaaaagtatgtctttatgcctacatatttcaaagtaatatgagagagaacattaaactgtgttgtattgtgataaaattcttggaatcttaaacatcataatacctcaggttatttggtcactgctcttgctagcaaggctaagtagtttcagtcctttagagctttatatttaatggaaggttaaaaacaaaaacgggatgggaaggaacgtatcgcctaatacataattcttgtcattagatgatttttcctgtaaaggagctaataagaatattctcgtaatttattgtacattatgattttgatatatacttagtaaagataagtaaggtacttggcccagccaggaagaggtgatacatccttagaaagctaatggtcagtcctgacaggactgggtggtgggcaggtgttgctgctccacattgccctgaactaacagtggggtctggagtgcccagcatgggggctgtttcatgtcccctcttactgatggttttggtttgcttgtgtggaagacagttgttcggctttggtttatgttttatacaagaagagatgtgtcaattaggtaaattactggcatcttagttttcagcagttttgttttacaagaaactagcctggtaaagtataagaatgcaaaatactggctgggcgtggtggctcatgcctgtaatcccagcactttgggaggccaaggcgggcggatcacgaggtcaggagatcgagaccatcctggccaacatggtgaaaccccgtctctactaaaaatacaaaaattagctgggcgtggtggtgtacgcttgtagtcccagctactcaggaggctgaggcaggagaatcacttgaacccaggaggcagaggttgcagtgagccgagat

SEQ ID NO: 248035 - DNA, 461 bp, Homo sapiens
aatagcgttagatttatagagaagttgcaaagaatgcagagttcccgtgcactccataccaagtctcctcttattaacataggacattagtatgacacacttgtcagagttaatgaactgatattgatacctactaaagtctgtactttattccttttttttttgagatggggtcttgctctgttgcccaggctggagtgcagtggtgcaatctcggctcactgcaagctccgcctcctgggttcacgccattctcctgcctcagcctcccgagtagctgtgactacaggtgcccgccaccacgcccgtctctactaaaaatacaaaaattagccaggcgtggtggcacatgctgtaatcctagctacccaggaggctgaggcaggaaaatggcgtgaacccaagaggcggaggttgcagtgagccgagattgtgctactgcactccagcctgggtgacag

SEQ ID NO: 248036 - DNA, 428 bp, Homo sapiens
taaaacacgaaataatccccctaggatctactagaaaagtatcttatgctataagaacactgatcatttctgctacaagcaaacatagaggttgtgttctaaagtgttaatcttcctctgggggtggctagagaacagcttaccaagggggagaaatctggctcatgtcgacaaagctctcacagctcttcagaagagaagtattgtgtaagtgcaaagctattattatataaaagcattcagaggataatattagccataattgtattaaatattaatattaatgcaaatggtggctaagagcttaaagaagagcttataaactgtaacagtcaataacaatggagtaaaggtatataaaatttgtatattgtcaaccatgcacaccagacaaacccaataaactgaaaactaataagttgctaaaa

SEQ ID NO: 248037 - DNA, 435 bp, Homo sapiens
ttcactcaggccctggctgctccttcactggtctacactgctgcctcctggaaccacccactctgcaaccaggtctgatgcccggtgtggacattcagggatgaggtcccctggggctaaatgaatgaacagattctgaaaagcagaagctacgtccgggggtctctgggccacaaatcactttctgacctgcagccgtgaggcgtgaggctcactcggaagctcccggaacctggagactgccctcactcaacacttgaacaagcaaggggccaggttcaatgaaacacctgcccgcccggcacaccaggctcaaaagcaagcaagcaagcaaacaaacaaacaaaatcaaatcaggccttcacaactccccaaatcatgtgtgagtttctacagagcagaagccaaaaatatatgttatctaactaggtccta

SEQ ID NO: 248038 - DNA, 340 bp, Homo sapiens
taaatgttaagattgaccagtggattcgtgttgtctgatgcctgatctctcagttgtgaagttccccatatgttattcatgtagtagtttttgtagtagtcatttagtttttgtcattgatctattatttcattctgggtttccttttctcctttctttttgggaaatctttcaacatataagtaaattgcagttttttttttttaagtgactgcctgttaaatgtcaaatgctttaagtttggtacctgggtcagggtgcagtggctcatgcttgtaatcctagcactttgagagactgaggcgggtggatcccttgagcccaggagtacaagactagc

SEQ ID NO: 248039 - DNA, 735 bp, Homo sapiens
cagaaagtggccactggttatttcacctggccccaagacgatgcaaggcacccactctgctttttttgtgatgagatggagcatgactggccttgcacatgaccttcagtcactgcctctttgctctttggttgttgactttgtcggcagggaattcagagggaaggagagtcagcgacgtgctctcgtaaggtcatcttagaagaccactctctccaattattttaagcagctctttagagctttctacattgtgaagttctttatcctacctgtgtatccctagggctttacagagtggagattcagtaaatattttgacaagagtgagcaaatgatttaacagtcgatggagtgcaaattgccaacaacttactgtagcgtttccatccacagcattcagggtcagtggctaaaatacttgtcgtaaaggtgccaagcctccaggcatctagcagggcattagcacaccgaagcatttattagactcaggaatatactctttattggctcatttcaaacaatacctaaaaaagaaacctctttttttaaagccttcaaaagatggcaggatgtattttttcctaagacccataaaacaggtaacataaactgttactatttcataagaaaaacttaggtacagaaatactcaaacacttatccaagggagctggaatttgtgtcaaattttcttgaggaattacatggctcgtactatttagaccatgttct

SEQ ID NO: 248040 - DNA, 221 bp, Homo sapiens
  misc_feature (206)..(207): n is a, c, g, or t
ggggatgaactctgtgtcctcctcccatggcggaaaggatggaaaagcaaaagacgctcaggtgctcgcttcaccctcttttgtaagagcgctaatccattcatgagggctctgctctacccccaaagacccacttctttttttttttagacagagcttgcagtgagccgagatcgcgccactgcactccagcctgggcaacatannggggatccgtctca

SEQ ID NO: 248041 - DNA, 555 bp, Homo sapiens
tctctgggaaagcctacatatacaacaaagataagactgtattcatcatctatgctgatataatatgttttcagtcaagtaagtcttttcacatttattattgtgacttaatttctgttccatgaggtagccaggggctaaggggggagtggtagatcgttgctaatgatacaaagtacatcaagaaagaccacactttctacatacaatccagtcctcctgtaccaagtccttgaccataacactcctgatacaaatatctgcaggataaagcttaaacacatctcttgtccattcaagaccctggggcatctgtttttgccagcagctcctcacaggttccattccatcaaagctggttcagttatttaccctgtcccagaggccatgttttgcctgttgtcacttggtatgcttctcttatgcaataatattttgtatgaaggtttctcccaggcactgtgcttggaatcttacaccatatttaatcttcacagcacccctaggaggtggagactattgcccaaacagtaaacatcgcctattgcttactga

SEQ ID NO: 248042 - DNA, 912 bp, Homo sapiens
ctcccctctaccagcacaaactgtcagtggacacttctgcttcaactctctctcacactggactctgagatcctggaaagcagggactttaatatttggatctttaccctagtaagtgattgagaacaaatgaatgacaggatggaaggaagagaaaaaggagagaagagaaaggaagatggagaaagaaaagggacctacaaccatagcttatgagacattgcttaaatgatgccatgtcatgcccaaataacattgagttaagcttgaatccccttgactatagcaaagagtgaaagaactcaaagttattgtagtgtaaagaccacgttgctatgtctggggagaaaagaaaaaatattcatgtgacagagactgatttgttctgctcatggaagtaaggagatagaagatattctgggcggcagcctgacaaagcctgcccttttctgcagaaatgacattgctaccagaggagcattcatccatggtgaaaagggttaggggacctacgctggtcatcatgctgtccttgtctcggagtatcagagactggctacagctcgggataccaaaggcacaaattaggaatttcctcaaggatcacttagtaatagacactcattatgcagaagtaatcactgtaaaccagaaaaggtaaatgacttgctcaagatcacactgctggttagtaacagaaaaggattttttaccctatgcctcaatgtgccttcttcagcaataagaaaggaacctaacacgcctgctcatcaattatttgtgaaaggttattggtattttattttactcaggtattttactctaagaaacataaaaccattaaagcaacattgactgtatgactttgtgtaaggcactggattatagaaacatctttgtatgtaagcaaga

SEQ ID NO: 248043 - DNA, 520 bp, Homo sapiens
cagaatgaggaggggagtgaaaagaggactgattgagggtcttcccatggagtactcagatccttaatacccctcccctatcccatgcagaataccagcaacacagagtttaccccctttcctccagcccaccctttttgcttacaccttacctctcaaattgttgaattctgatccagggaaactaaatcacagtaaggaaaaggttttcaaatacctacatttagaggtcccctgtaaatgactggctcccaaaccagacagagcacagtgaatctattccatctagaatgcctgtctgtgccttaggaattcgattcagcttttattaattaactcattcttaaacatcaatgggtaaccaaggatcatcagtcatatcaggaaagacacaaattaaaaagactggaactaaaacaaattattaggagaaggaactctaaatcagaagacatctttaaaagaataataatccttagaaagagacagaaacatacagcattttatgaagcaggatgtc

SEQ ID NO: 248044 - DNA, 559 bp, Homo sapiens
ccctctcgaagaaggagggatgtgaggaggtcaggatagtcacctgtgctgagccatcatggagagtgagggcctgtaagggtggacacagtatgcaggagggacaaatcttcctcaccggacaggtggggatccctgcggtgcactaggggaatgcacacagggggcactatgacctggcggcccacggggcacggggacgcaccaggtagccttgggatctgcaagtccctcccggaccctggggagtgccatgacggcttccagcagcagtcactgtcctgggcgcgtcccgcgctctagcccaggtgggtcccacaacggtgtgaccaaggacgtcctatgaccaccccttgacaggtaaggaaactgaggcaggagaggcgaagcaactcgcccaaggaatgggctgtgccggtagcttctccaaggcctggtgcgccctggcctgtgcgcgtgatcccgggcggggtctcagtgcgaacaggggcttcgcgatgtggccagcgcgggcttatctccgtgccgtgacgacaaggctagaagcctgggcggccgc

SEQ ID NO: 248045 - DNA, 402 bp, Homo sapiens
cagactgaagagaggccagcccccattcctggggctccccgaggagctggctttcagcagggtttagagcagcacgaaaagtgaactgaccctggaaaaatggtaatcttctcatctgtgaggatatggaaccccaacctcttcctggacacctgatgatctgcttgtgatgggctcagagtcttgaaacacagaactatgagctcatctcatatcccaatccagcagcatggaaacctcagactgcaaggcccaagactggcacttgttctctcccaactcttttctttctctctctcctttcttttatcccttaattccttcttgcttccttccaagatttatactattaccttttaggcaaaacatcctgaacatgtaaaataaactaattaaaatcaa

SEQ ID NO: 248046 - DNA, 362 bp, Homo sapiens
gtgctggagttacagatgtgaactgctgcactcggtccacaccacatttttaacatcaacaggtaatcttctcatctgtgaggatatggaaccccaacctcttcctggacacctgatgatctgcttgtgatgggctcagagtcttgaaacacagaactatgagctcatctcatatcccaatccagcagcatggaaacctcagactgcaaggcccaagactggcacttgttctctcccaactcttttctttctctctctcctttcttttatcccttaattccttcttgcttccttccaagatttatactattaccttttaggcaaaacatcctgaacatgtaaaataaactaattaaaatcaa

SEQ ID NO: 248047 - DNA, 364 bp, Homo sapiens
tcaggaaggggaggcgggaggatctcagcccccacctcattctaccccagtgggagtggcctcttcatgtgcagttggtcccaggatcccctaacccatcatcatcctgggaggaaggcagtggctcctcccagcagagagctccaggacccgccctgccctgtgggcggcagggccctcctcctaagcccctcttcctgcccataaatgtatttacacttgtattaccccaggtacgtggctgtgacaatggcatccccagcctgcatggaggacaggaattgaactttagtctccaggcaatgaaggtgcagggactacactttattaatggttgttatgtaataaaaaacgataaaatggc

SEQ ID NO: 248048 - DNA, 468 bp, Homo sapiens
gcttgcaaagctcaaggaaacatttacaaatgtttaccggtttattatgaagctgtgaccaagaatgtggatgaacagcagatgaagaggtggatggggtttagctgcagccccgcccaccctggaggctgggggtgggattatcctaatcccagggttggtccatctggtaaccagcccctttcctcctagagtcacctcagtaatataaacgctggtgtagttgaaaggggcttattatgaataacagaattccctattactcaggaaattctgagggttttgggagctgtatgtcaggaacctaggaccaagactaaacatacactttttgccacaccacagtatcacatgaggccataagggtggccctggttctatatgactggtgtccttatgagaacagatgaggacacaggcacatgcaggggagacatctgcaagctgaggagaggccaaagaagaagc

SEQ ID NO: 248049 - DNA, 420 bp, Homo sapiens
ggccagtccgggggaagcccacaggatgctggggcacttcctggattacagaggaatcctcgccttttcagtctcttattttctcagccatagacctactctaggattgacacagccttctataaaaagtgttcctgggccgggtacagtgactcatgcctataatcccagcactttgggaggccaagatgggcggatcacgaggtcaggagatcgagaccatcctggctaacacagtgaaaccccatctctactaaaaaatacaaaaaaattagccgggtgtggtggcgggcacgtgtagtcccagctacttgggaggctgaggcaggagaatggcgggagccttggaggcagagcttgcagtgagctgagatctgccactgcactccagcctgagcgacaaagcaagactccatctca

SEQ ID NO: 248050 - DNA, 521 bp, Homo sapiens
ccattctggcattggttcagaagcactcatttccatcaagccatcttctgctaattcctgtgatgtagtatctattaggtatttaatttctccaaggttcatatcttgaaacccttcaccctctaccttttttgccgtatctacaatctgtttcatgatttcctttactgaccctgttgtaaatcctgtgaagtcatgtgtacaacatctggacacaattttctccaacaggaatctattgttttggggcttgatggcattcatgacttttttctataataatggcatcttctatggtgtaattttccagactttcatgatgttctgtctatgggcctctctttcatagcgttgacaatgttttccacagagtgttgtgtttacatgagccttaatggtccttcggatcccctgatttagagattttgcatttaagggggtagatcactttgatacttttggtgttgaacttatggggttctcagtgggcagaggcattgtccaacattgtccaacattta

SEQ ID NO: 248051 - DNA, 649 bp, Homo sapiens
gcaggcagctgtccccagcggccagtgtcccccatgccggatctctaggatctggaaggccgctgctgccaggaacaagaagtcagagagggccaggctgagcaggagcagcgccagacgcgtgccagctccatgccgggcctgggagccggccagccacgccatcaacccattggctggcagcccaaggagcagcagggccaccaggaagaccgtgtcccagccaccttggggtcccaccgacatcgtcctgactccctgcacgacgctgctcagaggacatacgggcccctgctcaatcgagtcttcgggaagcccaatatgagcaggggatgaaggaggaaggatgacagagccgtggctggccctggggacatcctggactctccccctgcaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctg

SEQ ID NO: 248052 - DNA, 1103 bp, Homo sapiens
gcaggcagctgtccccagcggccagtgtcccccatgccggatctctaggatctggaaggccgctgctgccaggaacaagaagtcagagagggccaggctgagcaggagcagcgccagacgcgtgccagctccatgccgggcctgggagccggccagccacgccatcaacccattggctggcagcccaaggagcagcagggccaccaggaagaccgtgtcccagccaccttgggggtaggagtcctcatcatcaagctctgtgcggggcctgtggccagtggcacccaggtcagcttccatggtagtgtccatttggggtccccagagtcctgctggacacggagtgggtgcctggtgaatcaatgatggtgtgaatgaccgagtatgggagagacggtgctgtgcatctccagagcaggcaagggggcagcagggcccaaatctggccattggccgtcagaagccccctgcgggggttgtgactcccaagagtgatgcagaggagcccccgttgaccaggaagaggagcaagaaggagagggggctccgagggtctcgaaagcgcactggcagctctggggagcagacaggccccgaggccccggggagcagcaataaccctcccagcactggagaggggccggcgggcgcaccccctgcatcccctgggccggcctcttctcgccagtcccaccgacatcgtcctgactccctgcacgacgctgctcagaggacatacgggcccctgctcaatcgagtcttcgggaagcccaatatgagcaggggatgaaggaggaaggatgacagagccgtggctggccctggggacatcctggactctccccctgcaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctg

SEQ ID NO: 248053 - DNA, 678 bp, Homo sapiens
gcaggcagctgtccccagcggccagtgtcccccatgccggatctctaggatctggaaggccgctgctgccaggaacaagaagtcagagagggccaggctgagcaggagcagcgccagacgcgtgccagctccatgccgggcctgggagccggccagccacgccatcaacccattggctggcagcccaaggagcagcagggccaccaggaagaccgtgtcccagccaccttgggggtaggagtcctcatcatcaagctctgtgcggggcctgtggccagtggcacccaggtcagcttccatggtagtgtccatttggggtccccagagtcctgctggacacggagtgggtgcctggtgaatcaatgatggtgtgaatgaccgagtatgggagagacggtgctgtgcatctccaggcaagtcaccatccctccctgcgccattgtcatcaccttttgagtaattatcctatgccaaggacttgaagtggatgacctcatggagtcctcatacaatctactttacaggcgaggacaggaaggttcagagaatcagtgaaggtaggaagggagctactcaggagaatcgcttgaacccgggaggcagaggttgtggtgagccaagatcgtgccatcgcactccagcctgagtaacaagagcaaaactctgtctcaaaaaaaa

SEQ ID NO: 248054 - DNA, 390 bp, Homo sapiens
ggcagagatcacgccagtgcactccagcctgggcaacagagcgagagcctgtctccaaaaaaaaaaaaggtgacattaggaaaagaataaaaaattctgttggaaaccaaaaaccaatttaaaaaaaagttctgggcttcctaatacaagcttaatttgaacacgagaggagaatttatagaaaaaccagtagtgaagaccaagaatctgatccattaataaaagccagcatctgatgttgaaagtcccatggctaaggtattgcacttggttgctagagggccttgggatggaggcactgcctcagcacatgacagtataactgtgcagagtcagttattctctcactgctatggtttactggtctataaatagcatatgatgtcactt

SEQ ID NO: 248055 - DNA, 392 bp, Homo sapiens
actgaccccttcaaactcatttactggtagaaagatatttactgaacccacatagtaggacttcgtggagttgtgtacagcttatggaggggtacatctgaaacgttcctgtaaatgcatgaaaagcaaaatcaaatgctcccaaacaggagagtaagcttgcagggcaaatgtctcagctgagatttgagaaggatcccctcacccacagctatgatgtgatactggggaatggatattggtgggatgtatctgttgtatgcaccaggatgccatttgaactgtatcaacattactacttttgaaaaaaaagttaatgaaatggttaaaaaaatcaaactgttttattctggctttatgttgggactgcttatagagggctttaggttcct

SEQ ID NO: 248056 - DNA, 263 bp, Homo sapiens
gtgtagattttttaaaaagctgtattggttgtcatatgggctgcaatgtgatggtcgccaaatcaatttcactctgtattttatattgacctccagttttatttcaaaatgctttttgctgtttggtaaggaggattttccaaaatcaaactttctcattatttaatggaaacagctttaatatgatcatatctttacaacttgtattagtccgttttcacactgctgataaagacatacctgagactgggcaatttaaaatc

SEQ ID NO: 248057 - DNA, 409 bp, Homo sapiens
ttttttttttctttttaatctctatgtacccacatatggttacactgtgggatttaagttttatgggtgaatgtgggttttaaattgtggtagcattaaggcattcaacaattaaccacactctttaatataggaaataccccttccggttcccacatacacacaaaataacccattttagtcacgctctgacagccatataaataaacaagcagcgaaacgtcagcagaaaacagtttcataggggccaattgtccaagtatggctcaccatgtaattttcatttaacataatatgacaaaatggtacacacagaaaggaggttccccaacggactttttacattctgttctttgcatttttcctgatgtgcgttaagactatcattgttaaaatttgggtgtttatt

SEQ ID NO: 248058 - DNA, 441 bp, Homo sapiens
gccatcccagagaaatagccattggaccctctctttaggtgtagtcctggcttttaataagagagtttgggctactgaaacgcaagtaattcatcagtcccttcaaagtatagataagagccagtcataaacttaatttcatacctagcattggtagttacattgaaactgcagtaatacaatcaaattgcattagccagctttatatttaagacctactgctttaattactttaaacaacacagtcttgtgtggaagcaaagaaagtcttgctataaagtggcattagcttaggaaaccccagattctttgaaggagaccgttctaagaactcctaccagaaccaaagtcaagcagccaaaaggaaaaaaaaagataaagcccggacttcaatccttgttagatggactaacccactgagcagaaaaatccccagtacag

SEQ ID NO: 248059 - DNA, 219 bp, Homo sapiens
caagccacgtgtagaagaatgaaactggatccacatctctcaccttatacaaaaatcaactcaagagggatcaaagacttaagtctaagaccttataccataaagttgtagaagataacatcagaaaaacacttctagacgttggtttgggcagagttcatgaccaaggacccaaaatcacatgaaataaataaataaataaataaataaataaataaa

SEQ ID NO: 248060 - DNA, 226 bp, Homo sapiens
ggttgaggaatgtagtcttttacctagatagcaatttgtccagttaaaataatatttattgaagtagaaaactgactatgtcagcaactgtgatggtttcttgatgtgtgaactccagcaggttgaactatagtcccaaggcattcaaacaaacactgatgtagataatgccgtgaagtgattttgcattatctgattatgacccctactcagttgactttaagct

SEQ ID NO: 248061 - DNA, 171 bp, Homo sapiens
aggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccg

SEQ ID NO: 248062 - DNA, 482 bp, Homo sapiens
aaccaaggtactaccctcacagttcttccacattgctagggagtacactttctgatcatatcttttcaagacatgtcctcacttcttcagcaccaggggagggtaaatgggcagagcatatactaatgttctattttcttccagaagaaatgaaagaaacccacatccagaaattcctctgtaaagatcctacattggctgggtatggtggctcacgcctgtaatcccagcactttgggaggctgaggtgggcggattacttgaggtcaggagatcgagaccagcctggccaacatggcaaaaccccgtctctactaaaaatacaaaaattagcctggtgtggtggcacacacccgtaatcccagctacacaggaggctgaggcaggagactcacttgaacctgggaggcaaaggttgtagtgagccaagatcgtgccactgcactccagcctgggcaacagagcaagactccatctcaaaa

SEQ ID NO: 248063 - DNA, 246 bp, Homo sapiens
tacaactgagaatgaaaaagaataggcagctattaataattgcgttttctcaaccaacatcgaccctttgagcaggggtgggtaaagatgaacctctggcttcctcgggagttacaccttctgtagtgtctatcatggatctgcaccacgctaggtggttcatgctgataatgccttaggttgctatcagtacaattaagtagtaatagttatccctattactgatgcagaaaccaagactaaagt

SEQ ID NO: 248064 - DNA, 382 bp, Homo sapiens
atggcgtgaatccgggaggcagagcttgcggtgagctgagattgtgccactggactccagcctgggagacagagactctgtctcaaaaaaaaaaaacaaaaaacaaaaaacaactgagaaactgaatactgtcttaaatatagaccaatactaaggtcgatctcagaaatacaaaggtgtcttaacattagaaaaatccataataatcctctaaattaacaaaggacacaaatatataatcatctcaaagcagacgggagtttgagaccagcctgggcaacagagcaagatcccatctctacaaaaaaattgaaaaattagctgaacgtagtggcacatgcctgtggtcctagctgctcaggaggctgagacaggaggattc

SEQ ID NO: 248065 - DNA, 201 bp, Homo sapiens
gtgaccgcgtgtccacaaccctgggattccctcgccctcagattccagaatccaatttcttggatttcagtgtttttaaggtgggaggtctcgctatgcttcccaggctggactcaaattcctgggctcaagtgattcccccgcctcagcctcctgagtagctgggactacaggtaagtgccactgcacccaccttgtctt

SEQ ID NO: 248066 - DNA, 1460 bp, Homo sapiens
  misc_feature (59)..(59): n is a, c, g, or t
gccgctaccagccgcgccggagcccctgcgccctgcagcccgctccccggggaccgggnccggcgccatggaccgaggccaggtgctggagcagctgctcccagagctcaccgggctgctcagcctcctggaccacgagtacctcagcgataccaccctggaaaagaagatggccgtggcctccatcctgcagagcctgcagccccttccagcaaaggaggtctcctacctgtatgtgaacacagcagacctccactcggggcccagcttcgtggaatccctctttgaagaatttgactgtgacctgagtgaccttcgggacatgccagaggatgatggggagcccagcaaaggagccagccctgagctagccaagagcccacgcctgagaaacgcggccgacctgcctccaccgctccccaacaagcctccccctgaggactactatgaagaggcccttcctctgggacccggcaagtcgcctgagtacatcagctcccacactgatggaccttgggctgattgcaccttttggctatggtgcttggatcagatggctgcagcccctcacactcgattgtggatggctactatgaggacgcagacagcagctaccctgcaaccagggtgaacggcgagcttaagagctcctataatgactctgacgcaatgagcagctcctatgagtcctacgatgaagaggaggaggaagggaagagcccgcagccccgacaccagtggccctcagaggaggcctccatgcacctggtgagggaatgcaggatatgtgccttcctgctgcggaaaaagcgtttcgggcagtgggccaagcagctgacggtcatcagggaggaccagctcctgtgttacaaaagctccaaggatcggcagccacatctgaggttggcactggatacctgcagcatcatctacgtgcccaaggacagccggcacaagaggcacgagctgcgtttcacccagggggctaccgaggtcttggtgctggcactgcagagccgagagcaggccgaggagtggctgaaggtcatccgagaagtgagcaagccagttgggggagctgagggagtggaggtccccagatccccagtcctcctgtgcaagttggacctggacaagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgtgggtaacccggcgggaggacgctgtgccgcctgattgccaccactgtttaacactctgtat

SEQ ID NO: 248067 - DNA, 267 bp, Homo sapiens
attcacactgcctcctgccttctgcgagctcctgcctccctctccctcagcctctctctccctaccctgctccgctcccctagccctcttttttgtccccttgcaggcggccgacctgcctccaccgctccccaacaagcctccccctgaggactactatgaagaggcccttcctctgggacccggcaagtcgcctgagtacatcagctcccacagtaagttctggtcctcttggtggggctggggacttcctgtccctgagaagcc

SEQ ID NO: 248068 - DNA, 556 bp, Homo sapiens
aacttcacatttagttattagaggaagaaaagtcatttagggtagggtgtaagttgatgtttttattataaatcatgggaaacaaagaaataacccattcaccgctctcatcacttgggcacaccacccgctcagcattttgatgttaaaatacattttaaaggttcttttccttctttcacagaggaaataatagaggaaatggcttaaactgaggccagaagcattatggtggatgtgagtaaatctctgcattattaagagagattaaaaattgggatgggtaccttattgaggtcctgaaatctatacttgaaaaccttaaagcatcagagagctgccattttccgtgatttcggtaaaaagcagctcaggttatccttcctttgaggccattctagggggtcccacaaatctttttaagcaaaataaaaatattaataattattaaagttgttttcacattgttgaggtatattgcattaagaatggaatttgtttttccatcataaaagtagcacatactaattctaggttttgaaaatacaaatataaa

SEQ ID NO: 248069 - DNA, 288 bp, Homo sapiens
atctcacttgtagagttgaatgaaaaagcagatattcattatggtcggatatctctttggcctctcagttatattttggtgaaatttcagatgaaatcccatctttgatcattatctgtcctctcattatctgttctgtccatttctcagaacctgaagcatggagatgctgaataatttgctctttctgagatgcagggagtgattttagtgttcttataaaatggactgcgattaaatgaaacagactaaaagacctcaccactctttcttttattttcccacaga

SEQ ID NO: 248070 - DNA, 610 bp, Homo sapiens
aaagaaatcacactttgtgataacaatgtcatggggagaggttgtctggctctggtctgaggtaggaggaaggcacaattcctggtgctcagagatctgctctttgggctggaaccctgatgggcctcctttagtaggaaatggagatggagagaaagcgctgcatctttctccttagagaactctggggttgtgctggcctcagagacagtggagggggtgagggtcctctgagggcgggagcggccatatgcaggaggctgcgctgaggatgcagggtggctggtggccctgctggggggcggcctggccctctggagacagagcttcccatgccagtggctgtttgtgctgtgtggagtgtgattttcacactgaccccccaccacccccaatgtaggcagagtgtggtcccctgcctggtggtcatgttactttggaggataaagagtaggaaccctggtccatgcagggtgatgggcagtgagagatgggagcagggctggggacagccgatgcagcctcagagctgcagaggcagctgccgggctgttaaagtcacccggagggatgcaccccgccgtgcatgcggtggacggctcctgcaatt

SEQ ID NO: 248071 - DNA, 475 bp, Homo sapiens
tcactatacatttttatgaatctctacaaaccttccatcaaattaatagagatcaactagagatcaatagagaacaaaaacaaaaagacagaaacaaacaaaaataaacagcaacaacaaaatccagtgcatccattggcatcaagaccattggctgtgtaacaatagttgtacagagaagtgtggagaatcctatcggcagaggagtgcggaaattattgagcgttcttaccagccaaaacagtgcttcttaatgaatgagaacttaggtggtaaaccaggaaactctgagaaacccttataccttccagtgtctgatgagtcctgtcagacttcacttaaacacttagcggcccatgaggaaatttaaacagttttgaaacaacctatgcttgctagagcctcaaaaatattcaacatatagtcccttttagaagggattttaaaagtctcttttagaattttgacctggaaa

SEQ ID NO: 248072 - DNA, 442 bp, Homo sapiens
tgttcttttgtttctgaggcagggtctcgctctgttgcccaggctggagtacagtgttgtgaccacagctcactacagcctcaacctcccaggcacaagagatcctcccacctcagcttcctgagtagctggaactacagggctactttctcatgttttgatggaagtcaagaagataccagtggaagaggggctgtgcactacaatcccttgtgcatttgaatttcccaaagaacccccaagcaattccatgatcatgcactactggctcaacaaaaacatcagctccctggtagctacaaataaacccaatgctaccattggtgataacaccaaggacaaattttacatgactgggaatcttgatgaagaagactgtaccctactcatccacgatatactcaaagggaacagcataatatatttattctacgcagatcta

SEQ ID NO: 248073 - DNA, 179 bp, Homo sapiens
gttgaagtccagggcgtcgcacacgaggacgccgtccagggcatcgctaacgaggacgccgcccacggcatcactaacgaggtcgccgcccacggcatcgcgaacgaggacgccgcccagggcatcgcgaacgaggacgccgcccagggcatcgcacacgaggacgccgtccagggcat

SEQ ID NO: 248074 - DNA, 364 bp, Homo sapiens
atttcactcttctaggtttgaggcgtgatctctcaacctgatagtaaacctgatattaaaattcagagatattcctattgatctgtattaactcctgtggtagaggctaggaatacagccctgaataaaacagccaacctcccctttttttgcaggaagaaggcagacattaacagaacagggagctcgtggattcagcactcctggagacaagacagccagattttccttaaaaagtgacccaagggctgaaaaccaaaggagaagtaggatttttctcaacaacaacatcttgaggtcataataataagtaaaaaacaatgcactgaatgtgattaaagcttatatttttccatagtaatta

SEQ ID NO: 248075 - DNA, 413 bp, Homo sapiens
tctacctagaatcccctgggggagtgggcagaatttcccccacctctctggccaagtacctgtttatatttcctcagtctacagttctctggaacactgttggagaaacactgctctccaaacagagggctatttcgtaatctttatgggacgacactgctttttgatgatgtaattgtggcaaagtagagttcttttaaaaagctgtaaagtgtttcagaagctagagttatgaagtagtagagactttgtagtctttggtatttagttaaacttgactttatagcagtgggttctttagttctttttttagtttctaatacctttgagaatctgatggaacctacagccccccgctctggaaaaatgctcctgtctgtgagagcttgcatatggtttcaggagattcactc

SEQ ID NO: 248076 - DNA, 403 bp, Homo sapiens
aagaaaggtaatggaattactgataatgagaaattagacattttcctagttgtagttctccctaagctttgtattaatttttcctcccatgtaaaaagacaaggaatgttttgtggactgttacatagaaaattttaagtttaatggttttgattttatggccttaaaagaaaatttacatctttaattttgctttcaaaaacaaattccagaaactgtcagcttatagtatttgtgtgtatgtgttttaattgatttgaagtttgatcaacggagattttggaacttgggagttttttttgttttgttttgtttttttgagacagagtctcgctctgtcgcctaggctggagtgcagtgatgggatgtcggctcactgcaacctccagctcccgggttcaag

SEQ ID NO: 248077 - DNA, 745 bp, Homo sapiens
acacctatttgtatatttctttatttttgcaagaagggtgatcttcccagtagtccccccaaaaaatgaaattaatccaataaggatgatggaggagactaaaaaccaaaagaaaccaattctaacttatttcaaatcagtaacaaccacattgaaataaataatccaaggaacttttatactcagtagtcagtctagagaaaagtgactgcaaagaaatactaaactccaacagtttttttgtagtgatatgctgtaatgcttctgtaactatttaaatgtctaaaagggttgagcaaatgagtagataggttttgttaagagccagcattctgttgaaaaagacacaaatgtgaagtgtgggaaagtgagaaaaaaaccctgtggggatggcttggagttggggatttaagtgtgaactcataattttctaaaatacatgtgtgtatatatatgtcacatacatgtgtgtatactttgtccagtggaaaggcccagaagcaaagagatacccaaatagcaataagtacattgaatacctagatctttatttcttatatcattccccactaaaagataccaaggctgttaggagaaatgtttggttccagggctgggacagagaaatggttataagataagcctggagtatcttattatgcaagaaagtaaggaaatgctcagaaaatgatagaggcatgtcagaatgacacaggagtaggctttaaggggctcccactggcct

SEQ ID NO: 248078 - DNA, 373 bp, Homo sapiens
cctgatcctgggaacctgtcaatatgtgaccttatgtggtaaaagggactttgcagatgtgatcaaatttaaggaccttgaaatggggagagtaccctggactatccaggtgggtccaatctcatcacaagttcttaaaattggggaactgtttcttggctgcggaaaaccagagagatggcagcatgagaagaactttgccccttactgctgactttgaagatggaggaagggctcctgacccacaggatgtgggcagcttctaacagctggaaaaggcaagcatggattttcccccagagcttccagaaaggaacgcagcccttcttggcaccaataagttgtgttctttttctactttatactggctgca

SEQ ID NO: 248079 - DNA, 354 bp, Homo sapiens
cttcctcctttctccgctgtcagatatgtccactgatccgcatcttcatccactccctggatgtgaatgtcattcagcaggtcgtcgataatcctcagcacaaaacccagctgcaaaccctcatctgaagaggacgaatgaggaggacccctgtggtgcatgctgattggttcccagtggcttgccccacccccttatagcatctccctccaggaagctgctgccaccacctaaccagggtgaaagcctgagtccccccagaaggaccttcccagataccccttttcctcacagtcagaacagcagcctctacacatgttgtcctgcccctggcaataaaggcccatttttgca

SEQ ID NO: 248080 - DNA, 1532 bp, Homo sapiens
  misc_feature (369)..(369): n is a, c, g, or t
ggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcagcagctacagtgcattccaggccctggtctctatgcgggagaagccagcaaagaccctgtcctcaggaagcttccatttcagtgcgggaggacccacaatccatgaggccccgggcctgcgggtgtcaagtcctgcgaaggaaaataaggcagggaaacaggctggagactgcnggtgctgcgtgatgttgtttaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaagggcaaagccttgaacctaagtcatcttcgagtcctcagcacttcacccagagcctggcacacagtaggagcacagaaaggtttacatccagcaggagttggccctgagctctgagtccagatcattgctcttggctgaagcagcctgtctactcacaaagatgagcatggtccctgccacgaggaaactcgtggtcctgtggactgcggtgtggagggaaagcttgggattctgagcctgataatgcaccattacatccccactcactcgggctgtgtgaacccagcaagtcacaggatcactgggtggtgaaagaaagaaacactcacagaagcgtctgtgcttggagagccatctggtccatcattgtgactgctgctctcattgctatcatgggtgtcaccattgccatcactcaaggacttctctccaggccccgaagccaagctggtgcctggttcctctgggttgggagaggggctgggcatggacaggaggagggaaaagggacctgtgctagcaggtgatgccatccaagacatctgcatcctaatccctggaacctgggattccactaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgccttggggccaccagaaggaaccagccctgtcaacaccctaattttagcccagtgaggcctgtgctggacttctgacctccagaactgtaaactaataaatgtgtgttgtttctgccactaat

SEQ ID NO: 248081 - DNA, 1033 bp, Homo sapiens
  misc_feature (369)..(369): n is a, c, g, or t
ggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcagcagctacagtgcattccaggccctggtctctatgcgggagaagccagcaaagaccctgtcctcaggaagcttccatttcagtgcgggaggacccacaatccatgaggccccgggcctgcgggtgtcaagtcctgcgaaggaaaataaggcagggaaacaggctggagactgcnggtgctgcgtgatgttgtttaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaagggcaaagccttgaacctaagtcatcttcgagtcctcagcacttcacccagagcctggcacacagtaggagcacagaaaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgccttggggccaccagaaggaaccagccctgtcaacaccctaattttagcccagtgaggcctgtgctggacttctgacctccagaactgtaaactaataaatgtgtgttgtttctgccactaat

SEQ ID NO: 248082 - DNA, 430 bp, Homo sapiens
gcctttcatgcaaagaaaaccaaacacataagccacccttggcgtttctctttccttagtctgccactttcattagtacacgtgattagaaagagcaagcgtgctcgttcgcctcccggaggctgattcctcactctggtgggcttcagttcctggatggtgtgaggggtcttccatgcagaagtcttcagacactcctgaagtgtgtgattcttagtttgtttttttttgttttgttttgttttgttttgttttttttaaagaattcctggtggcaatatagacaggtacggagaccaggtagaaaaagtgggggaaatgaacaattaattacacatggattggtgatttgggattctattctttctgtcaacgaaccataaaatttaatgctaccccttaggatgctttagtgatttgtcggttgagg

SEQ ID NO: 248083 - DNA, 708 bp, Homo sapiens
attccattcaacagtgcaaaatttccagttctccccaaatttagctatataaattcagtgcaattccgataagcaaaatattccaacaggatgttcaatggaatttggcaggataagagaattttgaaaaatgagaacaaagagaggaaacatcccctaccagctatcatatatcctacagagctacaatgatttccaaagtctagaaatgacacgtgaacagactaagcatgtccaaagcagacacacacacacacacacacacacacacacacacacacacactaaagaaaaaggcagcaatttagggaatgaggtaagatcagtatgggacaactggctctcccgtattgaaaaaataaagctattctagaacttgatctttaaaatgtaaaagtggtacaaggacacagagaagcctctgttcttggctctggggtatggaatatgcacaccacgaagcatggaaggcgaaggcggcttggtgggtgcagtggccagcagccgaccaatgcattactcaagaggcccgataccacgccgcactgtgtgtgaaggaatcagtgtgcagccacaagccaacattccagaggaggggctgccaagacgggagctggcctccgcagcacagcctccggggtgtatttgcattctgcgcacggggcaagagactgggaatctggagtcttcccagacagagagccgttg

SEQ ID NO: 248084 - DNA, 131 bp, Homo sapiens
gtgaaacagcaaatctgtgaattaataaattataatatttacagattatggcaacagtggattttttatgttgaagcctgagtcagccagtgccttgggaagaattgtggactatttttccatttgaaaaa

SEQ ID NO: 248085 - DNA, 448 bp, Homo sapiens
cagcgaatgtaaactaagttcacacatatgaaactatccatatgtaagagtgtataataaacaagtaggcttaaatgtttataagagaatatgaaatacagctcaaatgcttatgttttcaaagacagtaaaataagtgttttctggagaaatataaatttcaaaattgactccatataaatctgagtagacgagaaaagaaatttagaaaaatcacccaaaatggcttttgaccagttttataggtcagttgttttgaggcacaaataaatcatatactgtaagaacttttcttgagcaagaaaaagtttggcaatgatgtctaaggacacaaaaaaagcagaagttctgaaaaaaatgataaattgaatatcagagtaaaacttatttttttcaaaagacatttattaagaaaataaagacaaattaggatttcaacataaatttg

SEQ ID NO: 248086 - DNA, 261 bp, Homo sapiens
gatgggccatacacaaggatcaagatatattaaagatagttcctattattttttatttttatttttagagacaggtcccgccctatttcccaggatagagggcagtggcacagtcatagctcattgcaaccttgaacttgcgggctcaagtgattctcctgcctcagcctcccaagtagctaggactgtaggcatatgccgccatgcctagctaatttttaatttgaattaaatttttaatttaaattgaactcctgggct

SEQ ID NO: 248087 - DNA, 834 bp, Homo sapiens
ttgctgtaaggcatagacgttaacaagcaaatacttgaaaatgagcctgtcatgagtttggtttagctgtggtgtacactaacattagcctctccatcggtggttctatttggggctgtgggttctgatagcagtttttctaggaccctaaaagcaggtcagcaggatgagaactctccgactccccaagactgcagagtgatgttagcacatttccccagagggcagagccaaggctcccatgtggatagggcccaggagtgtgcagtagaggcaggtctgcagagttcactctgagcctttcctgtgtgtgtgtgtgtgtgtgtgtagctataactttatcctccaaatacaaatacaactccaattgaacatgaatgctggcctctcatcagatgtcaggatgatgtggaatattgatccaatgaccatagtaggtccaatgtgtattactttgataacattggtcctttatggttctttgggttctcttatctagattataagcaacttaagtgtataaagcacagctgctctgtgtagttgtggttctgccagcagaattggaagctgtgtccaggcagaagccacagcatctctcgcctttctatccccacatgccacagcctgaagcagggctgggcacacagttccctcagtgcttttgcttgactgatgggatggactggcagacccacccggcttgcgaccatttatttatggtcagtatccaaggggggtctgacagtgctgctcaggcccaagcagatcagtgtggcttcttagaactttatagttcttggactaacctttctaagctgtacttgtaggaaa

SEQ ID NO: 248088 - DNA, 423 bp, Homo sapiens
ggtatgatctaaatagagacctgtataacgttctcttccaaccctttaattctttcactttcaatcaaaagagctagaagacaattccaagtataatttccacattggatattagggtgaactataagaaattgccattttgtaggtcaaaacagtcacatataggaaatttcatataattcaacctaatacaataattattacagtagttcatcttcactaaagcaaaaggccttaatatatttagtttttaggtaaaaatattggtatacatataaatgcctgtgcacataagtattggtaaagaacagggttgggactaaagatgtgtcttggataaaccacttatcggcatctagctcatccttctattgtactggacactggtgcctcctgtctgacttgaaggtttttcagactatg

SEQ ID NO: 248089 - DNA, 644 bp, Homo sapiens
tcacttcactactcatattattgagggcttgacttctgctaacaggttctcttaaaagactatctggagacagctttttaagagccttccctttccggatccctttgggatagaaaccgcagagtatttaatagtctgtgataacccttactttccatcctctgttttctgggcaactcttcgcacccacaaggtaatgactgcaaatgaattccaggcgggagcagaaatcctcctgcgctgtgcgtcgtctgccccgctcgggcctgcatatgggctccgcacactgctcgctctttgtgccacttcagggtcctgtccccttgagtctcaatcaagatacggctcattccacccttgggcaggagggcaatgctgatgaggctgtttatagcttcggtgcctgcgcactccatgttatttagttgttgttcctccgctgtttccaaacaagcagtctgtccaaaaaaaaaaaaaggatcaaatggaaaactttataaatactccaaatggcggaaacaggaagtggaataaaaatgatgtggctcttcacagaaaacatgctgtcatttttttttttctctgtaaatatacaccattcattttcagaaagaggctgtgcctaaagaagaattaaaaaaaaa

SEQ ID NO: 248090 - DNA, 415 bp, Homo sapiens
cggcctagatttacattttacatttatatatgagattcatttttagttaattgttgcatatgaaggaaggtatagatcaaagttggggtttttttgtatacagatatgtaaatgttccagcaccattgttgcaaaactatcctttctctactgaattgccttggcactgtcaaaaatttgttgtccatatatgtgaaagtctattactggactgtcttctggacctaatgtctgtgtcattatctctttgtgtatcttcgtgccaatatcaaactgtcttgattattgaagccttgcactttgaaatcaggtcgtcttagccctccaactttgttcttctttttcaaaatgaatttgcctattttaggtgcttttcattcctgtgaactttagagttagcttgtcatttcctaca

SEQ ID NO: 248091 - DNA, 450 bp, Homo sapiens
ggtctatgtgtctatccctctaccaataacacacagtcttgattactgtagctataatatcttaaaatcaggtagactgatccttcccactttctttttttcaacattgttttaactattctagtttttctttacacataaactttagaataagcttgtttgtacacaaatacatcttgttgagattttggtagaaattgcattaagcctgtcaaatttaataaaattgagggagaatcaacatctttaccatgttgtgtttcaatccatgaagatggtatgtttctccatttatttagatctttatcagcattgtgtagttcttagcatgtaagtcctatacatgttttttagactgacacctatttctttttttaagtggttgtaattggtattgtatttctaatttgtgttcacacattcattgctaataataaaatttttgtccat

SEQ ID NO: 248092 - DNA, 532 bp, Homo sapiens
tttgagaacaatatggatgaggaatatatgactagaccaataaaaggaagtcactgtcttttttatgctagctgtcttgaaagtatctgaaaatattcatgggtggcaacaaagaacatgagctatgcagacagagagactcaaccagactcctgtcagctgggtgaccttgggctggtcatttcacctctctgagccttagtttctcctcttgggatgggactgtgccttcctacagggatttttgtgtctgaataaggacagaatgagataatgtacataaaaacccccgttctgcttccctttcttagatcctacaatgcctggagaacagagatgaggccaaggaattcagagcccagtagccccacctatctttaattaactagaggacatcactccagcatcttctgctctccaggcttccatggtcctggaccatgagaatacatgctcctcatcattgaagatgcaggatgagatcttactctgtagagtacaaacagtatatacatcccttttctgggcaaaa

SEQ ID NO: 248093 - DNA, 485 bp, Homo sapiens
gatcagtgttgctgtgcacagtataaactttaaagaccttggaaataatctgaacctagcacttgtgatattgtcccaattggatatgtaaaaataattccataatgtttccaattccatattttagatgatgtctctaaaatatttttaggccagcacagtgtttcatgcctgtaatcccagtattttaggggaggccaaagttggaggattacttgagcccaggagttcaaggtgcagtgagctgtgatcacactactgcattctagcctcggacaagtgagaccctgtctccattaaaaaaaagttttttttaaagaaatgtatgtgataaaaatagaagattggaaatctcagatttagcaatatgaagagaagagttctgtatgtttctctgatgtaatttgcaatttgcttctaggagtttaactagttttttttccccaaaacattctttcaatgcttcttttttttttttttttttt

SEQ ID NO: 248094 - DNA, 428 bp, Homo sapiens
atatatacaacaacatggatgaatcttgaaataattatgcttattgaaataagacttaaaattatgtattaaatgattctatttatataaaattagtgaaaagcaaactaatctttagagaaggaaggcagatcagtggtttcctaggaatggagagatggaaagggaggaatgaatttacagagtatcaggagaaaacttttttgaataatgactacgtttattatcttagttgtggtgatggtcttatgagcacaagaaggtcaaaattcatcaaattgtaaagttcgaatatgtatttatattaattttgcttcgataaagctgtaagtttaaaaaggagagagaagaaggggaaaaggatgaagaggaagagggaggaaaagaggcagaggagattaaagaagagagggagaagaaaaaaataa

SEQ ID NO: 248095 - DNA, 867 bp, Homo sapiens
gaagtgccttgtattttatactgagagcttgagagtttatcttgatgggcgcagtggggtgtctttcggcagaagaatgatgctaggacgtcagtggcttttgactggttagtatcctgtttttttagtaacaaatcttatctttttcctcatggggaaccctttcctcactctcagtttacatgattgggtggggctgatcccattcttcaacgtcagcctgagcactgcatagcccctgtcaaagtgataggttcaagggcgggtgtagaaacccaaactagtccactgagagtcttctttgaactttttttttttttggggtggaatctctgtcacccaggctggagtgcagtagcacaatcttggctcgctgcggcccctgcctcccgggttcaagcgattcttctgcctcagcctcccaggtggctggaattacaggcacccaccaccacgcccagctaatttttgtatttttggtagagacggggttttgccttgttgcccaggctgctcttgaatccctgacttcaggtgatctgccacctcggccttccagggtgctgggattgcaggcgtgagccactgcgcccagccttctttgaacttttaattgaagcaattaggaaaggaaagttcaccttcttttagaattaataaaattgtaggatttggccctggaaactcttaaccactgagaagggactgcttgagaatgaagccacagagcagagtggagcagagtggagagaaggagagacatcgtcctgatcaacttgtttgggcaactggatccagccatgccagaataattcttcccctagaagattcacaagccaataaactcactctttttgtttgtttgtt

SEQ ID NO: 248096 - DNA, 382 bp, Homo sapiens
cacaagtgtgcaaatatctgcaaatgtaggttggaggacagtgtatggtcacgaatcaaaatccttcctaatgtatctgttcaacagagggtcccaggtagaccctgcccctgccttttttctgcctgggttgtgtctagctgcaggcagtggtaacaatccgaagggcttcatttcctttaggtgtttgtggcctcttctccacaatccagatgcctttgcacttacactccaccatattcctcttagagtcctgttcctaatggtccccatcggagcaaatacagtggattcagtcttatcccaccaccttgctcccacattaaagtccaagcctgaactcagtccttgtattcttttggcccagagtcctccatcagtc

SEQ ID NO: 248097 - DNA, 473 bp, Homo sapiens
ttttctttttgaggtggagttttgctcttgttgcctgggctggtgtgcaatggtgtgctcttggctcaccacaacctccgccccccgggttcaagtgattctcctgcttcagcctcccaagtagctgggattacaggcatgtgccaccatgcccggctaattttgtattttcggtagagacaggttttctccatgttggtcaggctggtctcgaactcctgacctcaggtgatcccctcaccttggcctcccaaagtgctgagattacaggtatgagccaccgcacccagcctgtggtttttcaaaaatagtttggtgggcagaggactaggcaatggatgctgctgattagttggggatgcaatagaggtgtgggaaatggtcctggtgctctgagtccacctctgggtaggggccacaggaccagttgagtcatgagttacaagtccaggtggggtcagttatttgccaga

SEQ ID NO: 248098 - DNA, 418 bp, Homo sapiens
ttgccatattgaagaagtaatagtatcagaatttagcttccatccctcaagggcccataaacacactgtgtggaagccaggtgatagatcacaggcttgtaatatgtacagttctcctggtttctgtacctctattacttttaaaacaagacaactggtaaattacaccacatcatggacaatccacttctgcaatgcacctcttcaggttcgtctgacagtgtttggcattcaaaggaaggatagctgccagcatacttgtctggccctgctcagcactgcctgagatattgaccttcttccccaacatggcctgtgggctggaggtgtgttctgagttctcaggaagtattgagtgccattcaactgcttcaccgtgtcagagttccccttttcaaggtttatgaaagggaaagag

SEQ ID NO: 248099 - DNA, 427 bp, Homo sapiens
cagtatttttctgatatattatgcatgtgtaaatttaaaattataatgaaacactttttttggtttgtttcccaaagtgattgtatctttcaatgtatatagtaaagcaaaatgtaacctatatctttgaaatattgtcagacacaataaaatcagtgataacataagccttccaggaattagaagcatatgaaaaaataaaataagcaaagttgaactattttaagtttattgttttaatgggaagtgaaaagcaatatgatcttaattattgctcatgtaaccgttttttaaaacttgctttaatgtagctgatggataatgcctctgactatccttattaaaagtgttctctggccaggcatagtggctcatacctgtaatcccagcactttgggaggctaaggtgagtggatcacgaagtcag

SEQ ID NO: 248100 - DNA, 452 bp, Homo sapiens
tcagagctgagagccccgaacagagatttacccacgtatttattaacagcaagccagtcattagcattgtttctatagatattaaattaactaaaagtatcccttatgggaaaagaagggatgggcccaattaaaggaataggttgggctaattaactgtagcaggagcatgtccttaaggcagagatcgctcatgctattgtttgtggcttaagaatgcctttaagcggttttctgccctgggcgggccaggtgttccttgccctcattcccctaaacccacaaccttccagcctgggctttatggccatcatgaacatgccacagtgctgcagagattttgtttatggccagttttggggccagtttatggccagattttggggggactgctcccaacatatgtgcactgtgtatgtgctcagcaccccttataaacatgtatagctttt

SEQ ID NO: 248101 - DNA, 392 bp, Homo sapiens
cagcccttactctctatacgtactctctgattaaggagcgagatgcagaagaaaggcaaatctaatagaaagtgggagttaatgctggtcaagtgatacatacagtggaaatcaccatagaagctgggaagccaggatagagcttcagcctgtctgtagtggcaggtgcccaggctggacagggaaggggctgcggtatacctgtatgggcgccaaatgccagaatcaaccaggatacaggaatgggttcctttccatctgtctgttttgctccttcctgatctattctgaactcacagaaaatagctataggtctagtggggaaagttatatatctaattttgattttttttttttttgagacggagtcttgctctgttgcccaggctgga

SEQ ID NO: 248102 - DNA, 682 bp, Homo sapiens
agggtcaatcctggtcattgttgtcttacgagagaaaaacaagagccttctcgggccccgtgttctctagctcttgatgtggcctcttcggtatcactggcagccccacagtctggtggtcagtgtgtcgcagcagagggtcattcaccgatgctgcttatccacagcaccttttctgtggggaatgggggcctctattctgctagtagactcaggtgtgtcactctgtgatactcttaagactgggttcattgaggacaggtctctttgctaacattcacacaaagtcattgtttggaagcacagtcctgcttctgaaatgctaggtctggaggagttccagcagcagccacatgggccctctcctcagatcttggctccaacatgggatactcagcagtgaggctagagatcagatgtccttcattccttgaccactaagcctagaggatggagagaaagaagtggaacatctgcactcttcaacctgagtccactccaactccatcccacaaggtgaggcaagttccaccagcctctccagcctcctgtctaatatgatcagagaaatcctcttctctctggactcaagacccatccctgtttccttccctaaggcgacaggtggctatagcaccctttgtcttggccctgcagccaccaatacacaaccataaaaata

SEQ ID NO: 248103 - DNA, 438 bp, Homo sapiens
aggaaggaaggaagggagaagaaagatagatgtgcacagttaaaatatttcagtaaacttcggtggtatttaaagcaagcacagccacatctttcttcatttagaccacctctttttctttccagtgatgtcctctgtgttttggatttatgttcaacctagaaaacagaggctttgggattttaatatagaagtttcatctaaaaatgttcaaaggcttatagctctaagggaaataaatctgggcccttttgttttttccaagcacgtgctccctagcagaaacacatgttacggttggttccatccacaggattgcatctttctgcactggccacaggtgacagcctgctgttctcaactcatctcaaaagatccacaaaataatccgatacatgctttccccagccctgccacccctgttattgaattgccaaa

SEQ ID NO: 248104 - DNA, 437 bp, Homo sapiens
tcttaacattttgtttattttgcattatatttaatagctgaagtcatgtctccctgacagaatggtttcctgttgcaatgcagtgatgttacacaacacatgatttctttcacacaaccactatgaatttcttttttcctcattctaccattatttactctaaagaacctgttctagaaaagcgtgtattttagatattttctttcattgtccctagaaatatgttcattctagacaggacaagcgtattgaaaatgtgctcagtttttccattcctcatgttctcaggtatctggcaactaaccaaaagcttataaagatcatcagagattctgggtagtatgtaaacctgtggccactctagttctctatggttggtaaactatggcctctggaccagctgcctgtttttgtaaataaaattttattggaacaca

SEQ ID NO: 248105 - DNA, 494 bp, Homo sapiens
agcatttcctccagccctggagaattcttcagatgatcataacaccttgtctgcaacctcattagagaccgcgccagacccacgtgactatattgctcctgatttcccgattccttctctgaacgtttcttttaagctgtagtggataactaatataccatttctcatgcttttgtttctgctctcatattaaaaggatatttgggctgggcacagtgtctcacgcctgtaatccccagcactttggcaggctgaggcggatggatcacctgagatcaagagttcgagaccagcctggccaacatggcgaaatgctgtctctattaaaaattcaaaaagtggctgggcatggtggtgggtgcctgtaatcccagctacttgggaggctgaggcaggagaatcgcttgaactcaggaagcagaggttgtggtgagccaagatcacaccactgcactccaggatgggtaacacagcaagagtccatttcaaaaaaa

SEQ ID NO: 248106 - DNA, 309 bp, Homo sapiens
tcccaggttcaagtgattctccgcctcaggcacctgagtagctgagacgtgcaggcatgtgcctgtaatcccagcactttgggaggccgaggcgggtggatcacgaggtcaggagttcaagaccagcctggccaatatggtgaaaccccgtctctactaagaatacaaaaattagccgggtgtggtggcacgcacctgcagtcccagctgttcgttcttgtaatcgcaaaaaataaagacacctaattggctgttttaaattttcttaataagttatcctgttacttttccctccccaccactgacatc

SEQ ID NO: 248107 - DNA, 569 bp, Homo sapiens
ttgtatctttcaatacatttaaagttttaaccttgtatttttatagattctttctgggattccctttttaaaaataactccactataaaacaatgctatagaaggtgtctgtttttaaatgagtatttcagtaagtctaattttcttaataacaatggttgaaatactaaaatttatcttgaaattgttcttcacaccctgactcttaacaaaggtggctcgctctagctaagggggctagagaaacatcttttacgtctgcagctttgctcttgacatgaaaaatattaaacacataaaatcaactacactagagcaacacaatactatatattaattatcccaaagttgggaaattcattagctttctcagcagctccaatgcctccataaaaaaggagagtattttcataaattggtcttagatgttgctatgtttaattaggtaatgcttattcagtgggaattctgcttattttacttattctgcagttctctgaactgaaaagaccagttgatgtttacattaaacctaaacttattctaaaatctgatgatttaaaaaaaaa

SEQ ID NO: 248108 - DNA, 254 bp, Homo sapiens
gtttggggccaatgagatgtgaatggaagttgcatgtattatttctagtttgtgccctaaaaaagaatatgtatgtgttgcccttgccctcttaccctctccactggctggggtgcagatgtgatggcaggaattggggcaactactttggacccagaggcagaagccctgtgatgaggatggcagaactgctctgttagccctggactgttacatgaaagataaataaacttgtatcttattcaagccactgt

SEQ ID NO: 248109 - DNA, 580 bp, Homo sapiens
cctgcaggcagagctccaactggtgggtgaaagttacaaggaggcaggtttctgaaggaagccctgtgtaataatcagagctgcccagcctgtatctaaaagtggtcaagatgcgggctgaagcgtcacgggtcaggaatgctgcacaggagagtctacggacaggctagatgacccttagcatggagggagaggacccccgacatctgtcagctctgcagtgctcgtggttccgtcatggtggagctgccgagtgacccgctggcctccctgagctgggcttgaccatatgtacgaaggaaagaaaaggcatcccatggatgtctcctagttccctcactgtggcccagtgttgtatatcaacgtcatcatggatacacctcctgtgggaggtgattaggccatgagggtggagccctcgtgaatggaattggtgcccttatagaagggaccctggaccctggacctccactctgcaaggatacagtgagaaggcagaacccagcctcaggtacactcatctcagacttgcagcctcctgaactgtgagaaataaatgtttgttgtctgtggtaaaaat

SEQ ID NO: 248110 - DNA, 256 bp, Homo sapiens
tctgcagtgctcgtggttccgtcatggtggagctgccgagtgacccgctggcctccctgagctgggcttgaccatatgtacgaaggaaagaaaaggtaccaagttctgcttgtttatttgtttgtttcagatcccagcatgtgctaaacacagtcccagatccttccctaaaagttatcttcctctatccttaccacaatcctgaaaatcaggtcttttttaaaaaataattttttcattttaaaaaaattataaa

SEQ ID NO: 248111 - DNA, 634 bp, Homo sapiens
tagtgtggaaataagctataatttccttgatgagcatgtcatactacaagacaaggttggctcaacctcctggtaactgtcctgccccagaatgggctagctccagcttaaataaattggaatcagattacctgggtactgaattgcatggcttcaggagagggtgtttggttctgtaaagccacatgtcatggtagtgaggtgagactgatggtagtatttgttcaagaatccgattttcattgagggcacaaaggctctgttgtgccacgctcaggatcttgttttcctgagattgcttcaggcagatttaaacaatggcctctcaacgtactggatttaaagagtaagtagttctccatgatcttatttctcattagtagggaaatgtaaacttttatctttggtcaaaattttgctcctgtcacctgaccccctgatgtcattatgattgtcttttccttgcagtattgccttgtcagttactcttaccagagggatttcatcatcggagtatctgcatgtctaagtccaattcagctctttacatataggccccatgccctaagtgttgctgtcattttgcctgtttagttactttacaaacactaatggcacgtaaggctcctgggaa

SEQ ID NO: 248112 - DNA, 103 bp, Homo sapiens
actagccacattaaaatagacttatttgctgactgcagtggctcacacctataagctcaatactatgggagactgatgcgggaggcttacctaagcccgggtg

SEQ ID NO: 248113 - DNA, 457 bp, Homo sapiens
aaaaggagtaaaatagagttgtgaatgtttgctttgttattaaacatatcaactcattggagctgatttatataaagttaaatcctgctagaatagctggattccttcctacatgggtggggtgggaatgctgagatcctggtgtgggcattccatgccagggtagaaatttcctgctcaggcacttagtgaaggagccaactgagggaggataggtgatgtgcccgcccatccggtggcacccagtgacctgtgcacaccaccccccatctgcccaggacccagccatgttgttcattgtacccttttcagactgctgacctccaggagcacttgtcttaaagtcacatagctgtatttttcctctccagaaaaattttgaatgtattttctaaatagctgaggtcattgcatggtcttcagtgaacttagctacaagtgaatgtgacctggagtg

SEQ ID NO: 248114 - DNA, 376 bp, Homo sapiens
ctgttccctttaatgtgttatcagaatctcatctcaatctagggatttttgccaagttgtctgaactctctatctccatatgtggtatctgaggtccttcttaaaccctgattttccccttatttggtattaatgcacacactattttcaggacccagcatcaagagtcaaggtgagtgttgtttgcaaatctatcataactcggagaagtccccatactcaaatgtcttagccatgttagcatgtactcagcaagaggccatgaacagtggctcatgcctgtaaccccagcactttgagaggccgaggagggaggatcacttgaagccaagggttcgagaccagcctgggcaacaaagcaagaccctgtctctac

SEQ ID NO: 248115 - DNA, 401 bp, Homo sapiens
ccctgctgggagtgcccaggtgccatcacctgggaacagctgatgacgcgagctaagaagttcagagttgcttttgctttacaaggcgcataggaacacactgtactaagaacgtgccagaagcctcaagatcactaaagatccccatttaccagaccggaaacaaaggagcaggggaaggaagcgcacacgtggggcttcgtgggctggaactgcatgacctcggcaagtcacttccctcccagagccactctttcccaggttagctggagacagccacaacctacaggcaggcgtggtcggaattaaagacagcaggcaccaaatgcgtggtgaatgggagacattatagtaactgttttattaatcttagattaaactatttcttgcaactttgaaaa

SEQ ID NO: 248116 - DNA, 332 bp, Homo sapiens
gcacctggtgtccacagcctgagctcctacctggagacccctggatcagggagtaaagaattctgggctgcaagtcagaagaaatgctccccaggggcttcagtggctccagagtctcaggaatcatctctggatgggtgactggggcaagggtgggctggggccctggtcttagtctcctcatcagtcaaggagggcaatgtgctttttgcccttgactctcctctgaccctggcccttcatacctggatctggcttgggagcagggtgaggccgaggcccacagaagccatagggtcagcctaagagcaagagtggaaaaagaaaaatca

SEQ ID NO: 248117 - DNA, 757 bp, Homo sapiens
  misc_feature (1)..(1): n is a, c, g, or t
  misc_feature (4)..(4): n is a, c, g, or t
  misc_feature (6)..(7): n is a, c, g, or t
nggnanngctggtttggtttaggtttgcattggtggatcatattgttatgttttaagaagtacaattctgcctctcagaatctcttggtgaaactgaaatcctattgagtgtggatgcagggaagagcaacaccttgaaataggcactgttgtcaccagtaggtcaacaaactaaatgcctgcctttgaattgtgtacagcgcagagaaggactgttttccagcatggttgctcttggttggtgtacagacacagtcttaccattcacactctggtgaacagtgtcctctgttgggaatagtgatacttggatgtttctctgagccagaaaaaagaaaatgtaaggagagagagattgacttctttttaaatcttgcccaccagtgtcactgcctttcacccagcattcctgcattttagattaaagagcctggttttcacttgaagtttctctgccttagctgcacgttgcaattttctgagatattttaaaaattagtgatgccgggaccctgaccctagggattttgatctcattggtcttgagtgctccttgggcttcccagctgtttgtactgggcagccagggtcacttcttacccaggctgtctcgaatctagtggaatacagtaaaagtgttagctaaatttttggcttgcttgcagagtaagaaaaacatcacaaacaaactgctttttcttgatgcctgtgatttgtacttttcagccttaggtacttttttttttgaaaaaaaaaa

SEQ ID NO: 248118 - DNA, 1532 bp, Homo sapiens
agcatatactctgtatgattttgatccttgtgtatatattgagacttgttttatggtgcagcaaaaggtctgtgttggtgaacatcccataaacacttgaaacgaatgctttctgcagttgttgaaagtaatattctacaaatgatttgctttgaaaccccactctaggtcttgccctcctcccatgttgaaaacattcaactgctacttgggacctgactaccaatgcttcaaacccacttacctagaaaaggttggccctgtgctgcaagatgtagcagcttgttctccgatagctacaggccctgggtcttgctgagacatgtggagcactatctgaaccacccaggtgcatcacacacctttgcctgctatagcacatgctagagtgcaccttacagatcccatcacctttcggatggggccagacattccctatgctgttgagagttctggaggctgatagatttcagccagtgtctcttggagtctctgagtggaaccaataaataaaagccctaaagaaagtgagaaattaaacaaagggcaagactgatgggggccacactactaaatttcttttgtttttaaacagctttactgaggtataattgacataacattcgcttgttttaagtgtgcagttaaattattttcagtaaaattttagacttgtgtgaccatcaccatgatcctgttttgcaacatttctatcattcctaagaaatcccctatgttcatcagtcaccaccactttttcccagtccccagctccaggcaacctctaattgactttctgactctacagatttgccttttctggagaccatataaatgaaatcatgcaatatgtggtcttttgtatctgtcttctttcatttactttaatatacttttatggttcatgtatgtggcagcacatatcaatattttaatcctgttaggggacaaatcctattaaattgtatggatagctcccattagtttattcatttatcagttgatacatatttgagtgtttctactttatggacaattatggataaagttgctatgaatattcacattcatgtgttgtgtggacataggtttttttcttctgggtagatagctagaagtgatagtgctaggtcatatggtaaatatatcttcaacattttaagatactgccaaactggtttccaacgtgactgcatgtcccatcaacaatgcgtgagtgttttagtttttccacgtcattatttcacttcccccaggtgttactgtccttttttattatagcattctagtgggtaagaagtggtgtctcactgtagttttgatttgcatgtccctgctgactgatgatgctgaccatcttttcatgtattttattgtctattcctacacctttttgatgaaatggttattcaaatattttgcctattttaaaattgggttatttatctttttgttgcgtagttgtaagtgtatttcatattctggatatgagtcctgtattaaatatatgatttgaattttttttctcagtc

SEQ ID NO: 248119 - DNA, 197 bp, Homo sapiens
ccattgtacagtgtcaggaacataccagacactgagaatagctcatgtcataaggacccagagcaagaggaccctgctgtgatgcacaaagaggaccatgcaagatatgataaagatctatgtcactgaattttggttctgtatttgtatctcagcttcccggaaataaaaaagaattctaacattcatactttcag

SEQ ID NO: 248120 - DNA, 326 bp, Homo sapiens
tcatcctggactcgggggcagcgggcctgctctgagccctcaccctggacttgtctcctctgttcagttcatgccatggaggaagtggtgaaggaggtggtgggacatgccaaggagactggagagaaagccattgccgaagccataaagaaagcccaagagtcaggggacaaaaagatgaaggaagtcactgagacagtgaccaacacagtcacaaatgccatcacccatgcagcagagagtctgggcaaacttggacagtgaatgcacctgctaccatggcccacccttcccaagtctcaataaaaagccatgaaatatgtacg

SEQ ID NO: 248121 - DNA, 624 bp, Homo sapiens
ctgaagtttagtttgaattttatagtatctcctaccttgctgtaccttaaaggactaacagcagctacctgacccaggattagccagtcatattttttccagaatttgtaattggaacaattgagatggtagtcttctgctggtagtttgaagagaggatatgtaaacttggtagctgtgtacttagaagcagagaaagcctgttttcagagagaagaatgaagcaggtaagtcatctggaaggacaagcagaagcacaattttgggaacagttgctttcagagtcctgatggcattccagccccttgtcctagtgccagttcaggcccaagtgtttggcctttgggacctatgatacagatatcctatttccttttaattaattgcctcttaaaattactattattaagctagcttgcaagggtttctgttacgtggaatcaaggaacctcagtagagaggaaaatgaagcactttgtggtggtgctgcacagggtatcattttgcagggtatatactgtgtgttttctacgttgactggagtctggggtcaggtgtaagaagtgttacataaacattgggttcaaatgagtcagaataaagtcaactaaaaaaataaaaaag

SEQ ID NO: 248122 - DNA, 140 bp, Homo sapiens
aagcctcttgcagaggcaaaagggctcagacactcaggtccttgttaatgtcagagggaaagaccctgagctccttgattcatatgatagaaatcatccttttcagtcttgatgcagcccctgatatgttgggtgtgact

SEQ ID NO: 248123 - DNA, 393 bp, Homo sapiens
aagatgaactgcaggctttgctctgagctcacagcctgacctcagtctagagctgggaatctttctctccctcattgctacacctgatcaattattgagtcccatccctttaactgcttacatggccttcaaatccatcttccctacctaagctgcccattcattgacctgtgccttctgtccatctgctgagagccaggtgctgtgcgagcctctgagaatgtggccgagaacaatatggataaaagttctgagccgggtacgctgactcatgtctgtaaacccagtgttttgggaggttgaggcagaagacttccttgaagccaggagtttgaggccggcctggacaacacagcaagaccccatctttacaaaaacaaaaacaaacaaaca

SEQ ID NO: 248124 - DNA, 396 bp, Homo sapiens
aaaagaactttaaaaaagtaacagagtgtcagaaacaatgaaaaacaactggcatgccaacatatgcaaaatagaagttccaaaaggagagaagggagaaagaagaaaaataaactactgaagatacagtagctgaaaatgtcccaagtttgctggaaaacattaatctacacatccaaaaagtttaaagaactccaagtagcctaaacataaagagatccacacctagacatatcatagtcaaaccatcaaaagtcaaataaaaagagaaaatcttagaagtagcaaaaataaaaaataattattcacatatgagaaatagtaagactaacaacttgcttcttatcagaaataatggagctcagaagtcaataaattgacatattcaaagtactg

SEQ ID NO: 248125 - DNA, 488 bp, Homo sapiens
atcatctcttatcctccaggaggattacctgggcttattcaatgcgaactcccagtggaaaccccatttccggcaaaaaagcacaatagaagccacttagccatgagactgtaaaataagaaaaagaaaaataatcgagagaagaataaaggtgttccagggcaagaaactaaaacatatttctaaaactgagctgcagatagaattcctggtttcctggtagttaaagaaagagacaaagtgtaaggagttacacagttattgtcattagctaaaagaaatttcatatttgtggcctaataggcatggaaataaaatgctagaaggagcagggcatgatggtgcacacctgtagtcccagctactcaggaggctgaggcgggagagtggcttgagcccaggagtttgaggccatagtgagctatgattgcaccactgcactccagcctgggcaacacagtaaaactctgggaaatgaagagacaaaa

SEQ ID NO: 248126 - DNA, 643 bp, Homo sapiens
cttagaggatagaaggagaaaaaaaacagagagagaatattgattaattttctcttagttcgttccagaaattttctcagaccaagttgtacttcaatcttttggttcctttagtcaccaccctcttcttttttgatttttccaatttgtgttaacacttgcctgtattgatctcttgcatttgcagccacatgaatgtgaaatccataagggcagagagttttgctggttttgttcactatcatgtcccttaacacctaaaataatgcttagcatgtagaaatctctcaataagtagcttttgcatgaatgaatgaattaaattaaatgaatgaaagaacaaaagaatattaactaaataaagccaagggtcaggaattaaacatatcacaaacatgcttggaatcttttactacataattgcctgcagaatatcattactatacagtaacacctagagaacatccgtaaattaaatagtttgatttactgaaaggactaattttatatgagcaaaaatgactttagtaattttcagataagcatttgtcaaacgtataatcttgaaactattttctttatctctcctttctataaatataatgaacaagtatttaataaaagacttcttgtttgtgacaca

SEQ ID NO: 248127 - DNA, 350 bp, Homo sapiens
gcgcatttaaaaatgagggctcccaaattagtctcatctagggatgcctattaatatgcagaagcttctaaaaagatttagagatggcacggcccatctgggagcaagtttgagtcttaccagtttgatactgggtgctgagcaaagtggcacgtgtctatgttttgtcacatgtattttgctctgggcagaatgaaaaatgttaatttggttactccaagcaaccccttgggctgcatcttgcaaagctgagtggattcttcctgtgattccatgattttccattgtgatgcagcttggcccccagagctataatgtggtgaggagggtgacagagcaagacgcaatct

SEQ ID NO: 248128 - DNA, 404 bp, Homo sapiens
ccctaagccccagtgtgatggtatttggaggtgggcatttgggaggtaattaggtttagataaagtcatgagggtgaagcctccatgatgggattagtatctttgtaagaaaaggaagaggccaggtgcagtgattcatgcctgtaatcccagcacttttggaggctgaggcaggtggatcacctgagctcaggagttcgagactagcgtgaccaacatggtgaaaccctgtctctactaaaaatacaaaattagccgggcatggtggcacatgcctataatcccagctactcaaggggctgaggcaggagaatcccttgagcctgggaggcagagattgcagtgagccaagattgcgccattgtactccagcctgggcaacaagcgtgaaactccatctcaaa

SEQ ID NO: 248129 - DNA, 193 bp, Homo sapiens
atctagtataatttctcttaaatgtcactatttcctgcaggattccaagatttacataaaaacctgatgggtgaatagtatgtttttacagattacacatctaaaatacttgaaactgtatcaccactgctatcagctccgtactatgcatttactcatgctttttatttattcttataatcatggtaaatca

SEQ ID NO: 248130 - DNA, 451 bp, Homo sapiens
taggtttgagtgatatctcatggtggttttaatttgcatttctctaatgattgaacaatgttgatcaactattcatgtgcttatttgccaccacgtcaaaaactgcaaatgttttttttgtagtagccatcctaatgggtacaaagagatatctcattgtggttttgatttgcatttccctgatttaatgatcttgaacactttttcacgtgattattggctgttggtatgtctttggagaattgtctattgcagtccttttcccatttgtaaaccggattatcttgttttttttgttactgagtggtaagagttcctttatgttctggatattaactccttattagatatgtggtttgcagatatgttctacaattctgtatattgttccttcttactctgtcatttgcttcctatgttgtgcagagatattaaaatttgatgtaatgta

SEQ ID NO: 248131 - DNA, 469 bp, Homo sapiens
gcagagccatgtattggaagcaaagccccagaagatgataaaacaattatagaggaataggcaaccaaaattgcagatttgaagagacgtgtggaattccttgtggctgagaatgaaagattaaggaaagaaaataactaaaggctgaaaaggccagacttctaaaaaggtccagtagaaaaggagctggatgtagatgctgattttgtagaaacgtcagaattacggagcttgccgccacattcagaaactgctacagcctcctcaacctggcagaagtttgcagcaaatgccgggaaagccaaggacattccaatccccagtcttcctcccttggattttacatctccagaacttccccttatggatctccctgagaatattctgaaaggatttatgaataattaaaatggaaggccacagaagaggggagaagaggaaataatacagtaatagttaatccagcaaa

SEQ ID NO: 248132 - DNA, 158 bp, Homo sapiens
gtatgtatgggtgtgtatgcttgcagaaaagtctacaaaaatattccctggattgttcacagtggctttatcttggtagaaggatttcaagtgatattttttcaaacttttgatttaacagatagtattgtgttaggaagctaagcaaaaaaaccctc

SEQ ID NO: 248133 - DNA, 299 bp, Homo sapiens
gagatagctagcactagcagggagaaatacaggtgatcagagtccaggctctctgaacatacaaacagtataactgttgttcactaaatggaaaaatcccaaaatcaaaaaccaatgcaaaacagtgaagtggcttgagctcctaggaggttaggtagaaattaaagagaatcagtggatgggtagaattttaagcagtaggtagttacccaatgtagaacgaggattagcttagacacctagtctggtggttctcagcctttcagcatttgcatacgataacttttaaggcttactta

SEQ ID NO: 248134 - DNA, 474 bp, Homo sapiens
cagtgcagagcgacctgaaagaaggtggttctcattcatctctctctttcatctccttgagaaatctagccacagggtaacacaggttttgagaggatgggaacgggacgtggcaaggatctgtgagtgtgcaggctgtgtttcacatatcattaaacatagtccagtgagggttctgcagataactggcgtttaagtttgttttattgaatcaaggaaaaagaaaaaatactgagaaaaaaatgacgcaacttgcctgccagcccatctgactgttacaaatttaatagtagtttttatttatcttctcatgtaaaggtccttggcagtgatacctaatttcctaagatagccttgctttatattgtgtgattaagatgtcatgcatatcagagtatctggaaattcttctcaacgtcctttacatacgtgattaatcacatttccaaaataacataccaaaatgaataacag

SEQ ID NO: 248135 - DNA, 824 bp, Homo sapiens
gggaaagtttccttcacatcttgggctccagtgggctggtcgttccaaaatcacatctttctcacagtcatttaaggctttcctgatgtctccaatcctcacttgcaattctttcatgtggttcatctttcaagaagatctcttgtacctccttttcagtatgatttttcttaatatatttgctctgacatgattattccattcccttccttagagctctttgtgttttaccattaaattttgttattgaaccatgtaagtcttacattatctgggctgtgcagaagagttctatatgttaaatgcaattaaaagcttccttgatgtctgggactgtgatttctctatatgaccattagtgtgctagttatatacaaaaatcaataaataagtaattaaataagtatttatacatatatacacaaataagtactgactcaattaagacctatgtagcattcacaatctattcattctcatctatctgctaagaagtttttaaaagtgctttatgtgagttatcacagtgttttagattttttattttataaatgatcaaacagcaaagagcaaatcagtttcttcatactgtaaaaatcacaaatttaaaaatcatgttattttcttttcaagtatggttttttactcctaaaaaacctctattttttctttcctttccagatgtatataatacgtaacaaaatcacaaatgtgttttcaagaacttaagaaaaaatttataggctattaaaatggttcctaattcctggatacattccaatatccaaaattattttcaaataaaggtctaaagaaatgagaaa

SEQ ID NO: 248136 - DNA, 264 bp, Homo sapiens
aactctgaacttccatgacttgtttctcaaatcttttgagacactaagaggtttctagcttgtctgaatataaaacctaattagatcacatttatttatttatttatttttatttttaatttttctgtagtaatgggtctcactttgttgacctagctggtcttgaaatcctggccccgagagatcttgccttggcctcccaaagtgctgggattataggcgtgagccattgcactcagccatagatcacgtttatatgcaatt

SEQ ID NO: 248137 - DNA, 430 bp, Homo sapiens
cacccaactaattgttttttatttgttgtagagatgggggatcccactatgttgcccaagctggtctcaaactcctgggctcaagcgatccacctgcctcagcctcccaaagggctgagattagcagtatgagatgagacactatacctggtggctttgttttttcaaaataaataactttctagaatggaaggggcttaatgaaaataaataaataaataaataacataaatggctagttttgctttccataagcaaatgaaatacagttgttaagaacaagtaaattagataactgtgaatgggataagcatctacaaataaacttgtcatagtttccaaaactttttcagtaatttaaaatcttaaagtcattgctgggattacaggcgtgaaccaccatgcctggcccgagaccccatctcttaaa

SEQ ID NO: 248138 - DNA, 534 bp, Homo sapiens
aacactcccacagccacacggacaggattccttccagtctgtgtctgtctgagcccagaaaaagaggaaatactgagctctagctggagcttcatccagcgatgataaataatctcgtgctccaattcagctcccatcctctcaagggcatggtcgccaccggaggtctaggtcttggggccccttcccccgacctggggtatctcttagggctttagtgtcctcaattagcaacccaggggaagcacagaagtgtctgggctctgttaagaggcggctttatcagccaggcgaacatttttttcagagaacctcagtttaggggaagcagttcctggcggggctttggttccaggctctccccctccagggacactcattcctaaggggagcaggctgggctgtctgggaacatttgccctgtaatatcagtttgcttcttattggtcctttgatagcagaacaagaggctctgtgatcctctggacctcagatttccttttaaactctcaaataaaaagatatgtgtgtgct

SEQ ID NO: 248139 - DNA, 369 bp, Homo sapiens
agcaaaactctgcctcaaaaaaaaaaaaaaaaattatcacaagcattgataagtccagcagtgaacacatctgtttagctttgtttagcccatacttatttgattatggaaaccttttactgagtagttctacttttatcctttcatagataataaactgcagataaaaattagttatctttcctgtatactaaagtaacaaattagaaaatatacttggtggaaaaaggattcccaattcacaacaaaatccatggaccatgaaggaataaacctcacaagaaatgtgcaaaacctgtatgaaaagaaatgatagctccaacctgaaggatatgaaataagacctaagtaaatggagacatataccat

SEQ ID NO: 248140 - DNA, 247 bp, Homo sapiens
aaaaaaaaaaaaaaaaaaaaaaaaaatagaagattagcccctgccccagaggagctttaacactacgtgggaaggcctgcctccaaaacatgagatgaccaaatagtatttttaaatgaatagatcgaataacaatctgagatactaacaaaactattattcagcaattggttggtcatgaattttcaactgaatggtactaagagattctcttttgggaagagaagagttaagatggacttctaaa

SEQ ID NO: 248141 - DNA, 676 bp, Homo sapiens
gtttcctaaagtacctggttcagatctcttgtaacactaactatattgtgctgtttatgtacatgtctctccaattagatccaatttctcaaaagcagaggctgtctctaattattgatatccccagggtccagcacaatgcctagcacgttgtcaacaattactgaaaaaatgcttaggaacaaactacactcaaaccagcatcatacgaaatgtatcactgatactccagagcgtcactctgtggttggctatgggtcggcagatctaggctgagctcagcggggaggctctccttcaagtgttggatctagttatcttggctctttgctgtaggctgagccatgtttgttcctgggacccaggctgaaggtgcagcagctgattagaagaaaaaattcccatagcgaaggcaacagcgcaaaaggccaagcccaatcacacacacacgtcaaacatttgcttatgtcatgctcactagtattttattggtgaaaggaagtcacatgatcaagctcgatattaataagatagggaaatacactccatgcttagtggaagaaactgcaaagccacatggcaaaaagtgtgaatatagagtagagtaaaaagatggaaatagtattgcagcctaccacaataagtactcaaaaaggcttatagaattagtgagttc

SEQ ID NO: 248142 - DNA, 491 bp, Homo sapiens
ttttaagtgaaagaagcaaaacataaaagcgtatctatagtatgctatccttcatgcaagcaagaaggtgatataaaatataaatgtaaaaaaaggtaatatatggagagtgtgtgtattaccatttttttacattgcatcacattttaccatctatatctatatctatatctagagagcaagcctgctcattgtgcaaaggaaatttaggaaggataaaccagaaacgaaagagactggataccagtggtggatgaggagtggggaagggttggagaggagggaatgagaatggaggagcaaaggtgaagagggagctatgagataccttcccatagctctgattcataaaaccatagtaacatttcatagactcaaaaaatacttaaacccagccagatgtgggaaaatctaaaatggaatacaaacagtagcaaatgaacctgattgcattataaatgaataacattgtcacagtgatcagaatcaga

SEQ ID NO: 248143 - DNA, 739 bp, Homo sapiens
tcttttacttggacatcttaaaattattcacaattaagtttttctcatataagtctttggagggtaacatcgttttcatttaaaaatgggaaatggaagcagaagaaaactagatgataaagttctcagttcttcactgtgattaacagctaagcagtggctaaaagcttgcatttttggtgttagattccaaatctaccactaaattttcttatcagtaaaatggggaaaagaacagtatttatttcactcagttgttgtggagataaaacgagaaaatatgtaaagggcttgacacttaggaagtattcaacaagcagtagccattattattaccacaactttaagatcactattgataagtttagaggaagaaactttttatgaagtgaattaccttttgggatctgggcactatggagaaaatatcaactaacaatctgcttggggactctatctctggaggagaaacagactacacttggggcagtaagtcagagttctaaatgttcttggaccatccttcatacaaatctcttaagtgatggtagggtgatctcaacctaaatcttttaattataaattccactctcatttcactatattctactaccttaccatagtgctcactttaactggaccacaagttcagtatagttttcattgtctgagactttaggactttattggttgtatcttcaaggataatcttctgaaatgtgaggccaaatgcttggag

SEQ ID NO: 248144 - DNA, 1352 bp, Homo sapiens
atggccggcctggggttttggggccaccctgctggacctctcctgctgctgctgctgctggtgctgccaccccgggccctgccagaaggacccctggtgttcgtggctctggtattccgccatggcgaccgggccccgctggcctcctaccccatggacccacacaaggaggtggcctccaccctgtggccacgaggcctgggccagctgaccacggagggggtccgccagcagctggagctgggccgcttcctgaggagccgctacgaggccttcctgagtccggagtaccggcgggaggaggtgtacatccgcagcacggactttgaccgcacgctggagagtgcccaggccaaccttgccgggctgtttcccgaggctgctccagggagccccgaggcccgctggaggccgatcccggtgcacacggtgcccgtggctgaggataagctgctgaggttccccatgcgcagctgtccccgataccacgagctgctgcgggaggccaccgaggccgccgagtaccaggaggccctggagggctggacgggcttcctgagtcgcctggagaacttcacgggactgtcgctggttggagagccactgcgcagggcatggaaggttctggacaccctcatgtgccagcaagcccacggtcttccactaccagcctgggcctccccagatgtcctgcggactcttgcccagatctcggctttggatattggagcccacgtgggcccaccccgggcagcagagaaggcccagctgacaggggggatcctgctgaatgctatccttgcaaacttctcccgggtccagcgcctggggctgcccctcaagatggtcatgtactcagctcatgacagcaccctgctggccctccagggggccctgggcctctatgatggacacaccccgccatatgctgcctgcctcggctttgagttccggaagcacctggggaatcccgccaaagatggagggaatgtcaccgtctccctcttctaccgcaatgactccgcccacctgcccctgcctctcagcctccccgggtgcccggccccctgtccactaggccgcttctaccagctgactgccccggcccggcctcccgcccatggggtctcctgccatggcccctatgaggctgccatccccccagctccagtggtgcccctgctggccggagctgtagctgtgctggtggcactcagcttggggctgggcctgctggcctggagaccagggtgcctgcgggccttggggggccccgtgtgagccagaaaccagggcttccctacccccagctgacactggaccccaacatgtatgctcagtagctgctctgg

SEQ ID NO: 248145 - DNA, 455 bp, Homo sapiens
gggaggctggggtgccttcctctgggagagtctaagctcttttttcccatcctcagggatcctgctgaatgctatccttgcaaacttctcccgggtccagcgcctggggctgcccctcaagatggtcatgtactcagctgtgagtccttgggaagcagtgccacatggcactgaggcacagggatgagggtgacagcgatttaggtgaggaagagcctgtggtcccagtggatctcagcccactgcctggggtaacccgtatctccaaaccctactctcaggctctaccattagtctggaaagagggaggtgacggtgttatgggaggaagaatttatgaataaatataattccttgttttctttaagaaactatgattggactaagcagtctgtccttccggaggagaaaggctgcttagtccaatcatattttgcacctacttgagcaatctt

SEQ ID NO: 248146 - DNA, 419 bp, Homo sapiens
cattaggctttttgtaaaatcataaggtcaggataagataatgataccatctaaaattacacaagattttgagtacttagtatcctctgactgacccagcaacccaacccaaaccccaacaagcatagctgaatttttggggttggcaaagccatgaatggaatgataggtttaggttcaggccccatgagctggcttgataagggaatgagtaatactgattcgatttatcctgagtcatagctgtgtactaaactaaaactttagcatacatcacatcgaatgtttctttgcttcagacaaagcgaaaagaaaaaaggacattaggaaccctcatttttattccttttcttaggaaagttaaacacttcctttcttctactttccctcttccctatcactttactccctaaagattt

SEQ ID NO: 248147 - DNA, 557 bp, Homo sapiens
gaccttcatccttctgcagcccctaggattaagggtcctcttgtagaagggaaaggggagatatgtgggaagcattcaaaccagagtgactccagtttgaataagggctaagaaaagagaagctgggtcacctaccggcaattaagggctgcacagcctgcaatcgcctagctaatgatagctaagtaataatgatagtaataatgataccttctcttttataaaaaagagggggcatgttgggaaaaaagctgagtgttgggggggaaaccgaggcagggcttgcataatgtcctctggaatgtgtctagacttgctggctccttgcttctagccttcctaggctcctaggtccctattcccagtatctcaagtagcagaacatgttccatgtaaatgctaaaccatcacagttgtagatcatgcgcctgcccttttgacctccacgttatcaccacctgtttctttgttggattaccaataaacactgtgggctcccagagctcggggccttcacagcctccacgatggccccctggtgtcccacctttctctct

SEQ ID NO: 248148 - DNA, 449 bp, Homo sapiens
gcaagaggacagaggctccaggttccttttgttttagtgctctgccatgtgtagggtgtttcccatccaaatgttccaagatgtcttaccactgtgtctgtattccaggcaatgggaaggagggaaggtgaaggggagagaattttccttccttgcaagagcatcatctgcaagttgtgtttctgctcacaccccattgacagagctttattgcttgatcacagctagctgcaaacgaggctaggagatgttttagtcagtctggtagcctttgtcacactacaatttctatgttagaggagagagagagagaacatatattagggaatagctaaccatctctgctacacctatgaccttccatttgtctcttacaatgagtttgtgaagttagaatttttatcccaagttttccactgagaaaaataaagctcataaacctgaaataa

SEQ ID NO: 248149 - DNA, 440 bp, Homo sapiens
gcacagggccttgttatatatcaggttcttaataaagactgaatgaatggatgagtgagggaatgaatgaatgtaaaaaaatcagtactacaatgtcttgtatgtggtgtcacaccagcccagtgaacttgctgagttgaagtctataccttagcaatatttacctcaacttctgtgctttacattagcatcagcattttgtgaggaaagtataaattgtgatgtctgctccgttcacaggaatgcttccaatggcgacctccaattcatttagtaaatttcagtcttcttggtcacagagtgggcaagaccaatcagaatatcccattttcctgtccacagtgatggatccaagaggcagtcagatgacctaaggaaggccagtaatagtcttccctgggatattttacattgaaatttcttttttcttttctttcttt

SEQ ID NO: 248150 - DNA, 423 bp, Homo sapiens
gtatgttgtctagcaaagatttctggttctcaaggactctctagtccctggataacactgggcataaccatgcttgatgttcaaatgaaattcatagcagtttaatcagttgatcccattgcttttttatattctgttattaatactgatttataaaacccagttattttcctcattattgcttctcagttctgtgctttctatgaattcgaattccaatttaacaaaagaatgagtttaccattttgatgtcactatctgcttgatccagggattatgtattggatttaaggtcccatggctgcaggttattacaagtatgtttgaatactgtgctttgcaaacatactgatttgcttgaaatgccaccttccttttctttcttatttctatgtttcatgagagacagcagaggacagtgct

SEQ ID NO: 248151 - DNA, 365 bp, Homo sapiens
ctcaggtactaagaacctgtactcagtggactagtacagtgaaatgtagactgttgtcttcagagccactgccaagctagagagcagggggttttattattaagcatttgtctggttgctgtaaacttttgattagtttccataatgccagtaaagttgattctgagagtatttgccagtttatttagtgcaattgtaaaaaaagataaattttgagggttccctactctgccatatttgctggcatcaagcttgatgacatcttaagacttattttcaagccaaaaaaattaaaatagcatttagtagttaaatcatagcaaacaattaataaatgaagcgtcacactttgacatggacaagag

SEQ ID NO: 248152 - DNA, 358 bp, Homo sapiens
gtaacagcaccatggggtgagttcattcccttctttgttcagaggaggtaactgaggtgcaagtgaaaggagaatggttggccgggcgtggtggctcacgcctgtaatcccagcactttgggaggccaaggtgggcagatccgaggtcaggagacagaccatcctggctaacacggtgaaaccccatctctactaaaaatacaaaaaattagctgggtgtggtggtgggcgcctgtagtcccagctacttgcgaggctgaggcaggagaatggcgtgaacccggaaggcagagcttgcagtgagccaaggttgtgccactgcactccagcctgggcaacagagcgagactccgtctca

SEQ ID NO: 248153 - DNA, 582 bp, Homo sapiens
tttttttttgagacagagtctcattcactctgtcgcccagggtggagtgcagtggtatgatcttggctcactgcaacctctacctcctaggttcaaacgattctcctgccgcagcctctccagtagttgggattacaggcatgcaaaaccatgctgggctaatttttgtagttttagtagagacaggattttatgttggccaggctgatctcgaactcctgacctcaagtgatccgtgcacctgggcctcccaaagggctgggattacaggtatgagccaccatgcctggcccagtatatttattttctaataaaaaaattataacttactttccccctcaaaagaagtttaataaaaggatattgtatttcaaggttgctccttggctaactgaaaaacaaatatctgtctttaattttccaagtaaagaaaggtttaaaatctgatagctgagccaagcacaaggttcatccctgtaatcccatcactttggaaggataaagtgggaagattacttgaggccaggagtttaaggcccccctgagcaacagaacaaggccctgtctctacgacagaaaaaa

SEQ ID NO: 248154 - DNA, 435 bp, Homo sapiens
ttacctaaataacaaacctgcacatataccactgaacctaaaataaaagtttaaaaaaatgttttttaaaaaacattttctttcagttaaccgttagaataagcaacccaaagaagctatgtgttccctccctgaaactattgaaggacaatagaggtctctgtttctcaaggccagaatttgttacatctctccttaaccaccttcaagggcctttcattgtgcttggaattaagtacaaacagcttcagtctttctcactcagcttttgtttctctctttagtccacctgtagccagtcatctcctcactagcctctgtagaccagccacatggaacttccttcgtgtcttcaaatgagccatgctctctcttgtccccaagtctttgttgcattttgtctggaatatagatccccctctcccaacccttacc

SEQ ID NO: 248155 - DNA, 693 bp, Homo sapiens
gggaacaaggttagaggcagatctgctgtaaaatgagtgaactctatgaacttcatgtttctcctctcctaaatacacaagaagtaaacctctcccccacataaagaggcgtaatcacagtgattgagccacgttggacagtgcagtgagaaactagcattgatatttcctaaattagtctgtaaggagtatgattttattctctctctttcttgtggaactctctgatgtgctgtaattgtttatctcatttgcttatttaaggctaactggaaatcagtttaagaaacatttgagttgtgcctttgtactggacactgtgttaggcaatgagaatactcaggtcaatgaatttagactctgccttcaaggtgttcactaactagtaagggaggaaagcatgaaaataaattacaaatccagggtgatgcctagaacaagataaataaatataagatgcaatgtagcataaaggaaaaatatatacatgtgtatatctatttctccatacctattttgaactctagaaataggactatgtggtgctggggtaaggtagcttctatggtaaatttaatacaacaatgaaactcctaaacctgttactactaaatcaagtgtgtcctcccacaatatcagttgccttaaattgcaattaaatgagttatgcccttgaaggttaaaaaggaaaat

SEQ ID NO: 248156 - DNA, 1063 bp, Homo sapiens
gcatgacatataagcaaaaaatgattcaaatgactgtgaacatctcatcagaaactgtgggggccaatgacattttcacggtgttgaaagaaaaaacaactgtcatccaagatgaagatttaatacatatgacaatgatattattaaggataagggggaggtgagtaaacatatcaacctgtaagagtcatacattttatataaagtagtgtgatgttaactctaaatagagttaagagaatttcaggacgtatattcctgagcaatcactaggaaatgttgcaaagaggaataggtaaaatgccaatagctgaattgaaaatcctaaaaactattcaattaactaaaaagacagcaagaatggaggaaaagaggtatgacaaatagggcaaacagaaaatcaatagtaatattcatacaatggaatgctacttagcaataaaaggaaagagcaactgatccatgcacccacaggaatgactgttaagaacattatgctgaatggagaaagccagacacaagagggtaaatactgtgatttcattttttatgaaattttagaacgggcaaaaccaatctatagtgaaaaatcatcacaacagcggttgcctcttgggtgttgaggagtgagtttattgggaaaagactgtcataaaagagttttctaaggtaatggtcatgttctatattacaataggaatttgggttacacaagtgtatgcatttgccaaactcatcaaattggacacttaagttatatacatttcattgtatgtacattttacctcaaaaaaggagctataaacaaatattagactctaagttgaggatatgcatgctgaaatgtttaggggtgaaatgtatgcatttttgcaacttactctgaaatccatcaataaataagaatgattgatacgtgatgtgataaagcaaatacaataaaaaattaattatacggtctagattttgggcagatgaatgtaaactgtacaattctttgaacttttctgttttcttgaactttttttaataataaaatgttgggaaaaattaacagacccca

SEQ ID NO: 248157 - DNA, 1021 bp, Homo sapiens
tagaataaccagagaagaccaaggcaagttttaaaaataacttggtacacatgtaggtgaaataaccttacctcccagtagctgagagaaaaaaaaaagatctcaatgctggctgttgttccaggatatttttagtaagatggccctgtcgtctttgatggtcaatgaaggaataatggcagaaaaaaatattaggcgaggagaaggctacgggcattgtttggtgtttcatttaatttccacctcatccaccagagaaaagcaaacataagcagaggttgatgatgagcacagtagaaaggaaaatgtgatgtgtcttttccttgtagttggttgataatatgtgatttgcttataccacattctgatgggaggtattttcagtctgtggctttgtaagttgaagggcctcctaagaaactcctgtttcgtaagatattctctgtcttaacttttttcaggaaaaaatatgattttttggagttgcttaatagtttttagcttttaaataagtatagtttatttaccacagcatttgaactgtcaggattttactgtgaatgctaccagaaaggtttgttctatttttacgagaatcttcttagggaaattgatgaacctggtaacctaattttagacctcctgaaatttgacagatggatggtatttattgtgttctgaatcggtccctattagacatttaaaaatagtcacatcattagagaatacattcaaaaaagaaaagatttttaacccaaaatctaatgcccagaaaatttttagtctcctaaactgggtgtgcattttggtaacagtttctaaaaagcctttttgtactctcctcattctctttcctgtgtgatgctgctgttgtcatggaaacagatcttggagttgctttgttaataccgtgtaagggactccctgaaatggagagttactgcaggtcattatcatcaacacagagctttaatatcaagtgttgtgctatgatgcgtacactacaaagcacagaaatctg

SEQ ID NO: 248158 - DNA, 553 bp, Homo sapiens
agcagggtgactttcaccctgcaacagtcacgctggagtactctggtgaaggatcaagaatattaccagttttctgatgaagaaaggaatatatttggtcaccagcaatctgcctttgaccatcctcaaagccaagtttttcatcgctgtctagaaaaatacttcattcagaggacacatatgtcctctttgaatgtctcctttttgggagcagtaggagaaagaaacttcaagatgtagaaagaattaatagtgtaacggaaagaaagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagtt

SEQ ID NO: 248159 - DNA, 384 bp, Homo sapiens
taatgacaaacttttaaatttatttagttaccttaagaaacttgtaaaaccacattttatggaggtaaactttacccttcttttcaaagaaaaaaaaatatatatatatgatcttttataatggctcttctttgtgagtcaaagggttaaaaccatctcttttattcccaaatgagtatcagcaccattcagaggtgccatgttttatttaaaacatactcttactcagtaaccactttgttctaattggcaaggcaaagccaggtccctaaagcacacagcccattacattcagtttggattaaaaaacacaggatgaaacaaacggcatcgaaatgtacaaattaacagctcaggagtatgggacagagaggtggaattaga

SEQ ID NO: 248160 - DNA, 225 bp, Homo sapiens
tcgatacgacttttctgtttctctctctctctctttctgtctgtttctctctttctctctctgtctgtctctttctctgtctgtctgtctctctctttctttttctctgtctctctgtctctctctgtgtctgtctctctgtctgtgcctatcttctgtcttactctctttctctggctgtctgcctgtctctctctctctctctgtctgtctccgtccctctct

SEQ ID NO: 248161 - DNA, 770 bp, Homo sapiens
  misc_feature (28)..(28): n is a, c, g, or t
  misc_feature (31)..(31): n is a, c, g, or t
  misc_feature (43)..(43): n is a, c, g, or t
  misc_feature (49)..(49): n is a, c, g, or t
  misc_feature (52)..(52): n is a, c, g, or t
  misc_feature (60)..(60): n is a, c, g, or t
  misc_feature (76)..(76): n is a, c, g, or t
  misc_feature (150)..(150): n is a, c, g, or t
ccagcaatttcctcttcgggggccaacngtntttttgcaaatntggaancangggctggntttcagactttctctngtctacctcagcggccgatgaccagagtggcagcgtggtgatcttggtgggcattactcttcttactacactgnaaggtctgaactgggtgccctgttaccgtgaagggttactggcagatcaccgtggacagcatcaccatgaacggagagggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacag

SEQ ID NO: 248162 - DNA, 882 bp, Homo sapiens
  misc_feature (28)..(28): n is a, c, g, or t
  misc_feature (31)..(31): n is a, c, g, or t
  misc_feature (43)..(43): n is a, c, g, or t
  misc_feature (49)..(49): n is a, c, g, or t
  misc_feature (52)..(52): n is a, c, g, or t
  misc_feature (60)..(60): n is a, c, g, or t
  misc_feature (76)..(76): n is a, c, g, or t
  misc_feature (150)..(150): n is a, c, g, or t
  misc_feature (525)..(525): n is a, c, g, or t
  misc_feature (534)..(534): n is a, c, g, or t
  misc_feature (539)..(539): n is a, c, g, or t
  misc_feature (562)..(562): n is a, c, g, or t
  misc_feature (579)..(579): n is a, c, g, or t
  misc_feature (584)..(584): n is a, c, g, or t
  misc_feature (588)..(588): n is a, c, g, or t
  misc_feature (599)..(599): n is a, c, g, or t
  misc_feature (607)..(607): n is a, c, g, or t
  misc_feature (630)..(630): n is a, c, g, or t
  misc_feature (643)..(643): n is a, c, g, or t
  misc_feature (646)..(646): n is a, c, g, or t
  misc_feature (670)..(670): n is a, c, g, or t
  misc_feature (676)..(677): n is a, c, g, or t
  misc_feature (692)..(692): n is a, c, g, or t
  misc_feature (697)..(698): n is a, c, g, or t
  misc_feature (703)..(703): n is a, c, g, or t
  misc_feature (711)..(711): n is a, c, g, or t
  misc_feature (726)..(726): n is a, c, g, or t
  misc_feature (739)..(740): n is a, c, g, or t
  misc_feature (760)..(760): n is a, c, g, or t
  misc_feature (783)..(783): n is a, c, g, or t
  misc_feature (801)..(801): n is a, c, g, or t
  misc_feature (810)..(810): n is a, c, g, or t
  misc_feature (817)..(817): n is a, c, g, or t
ccagcaatttcctcttcgggggccaacngtntttttgcaaatntggaancangggctggntttcagactttctctngtctacctcagcggccgatgaccagagtggcagcgtggtgatcttggtgggcattactcttcttactacactgnaaggtctgaactgggtgccctgttaccgtgaagggttactggcagatcaccgtggacagcatcaccatgaacggagagggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaaagtacttcccccagtgggangctcccacnctggnagatgaacagcccctggagaacnacctggatatggagtanttcgncacnatcggcatcgnaactcctncccaggatttcaccgtcgtcttngacaccggctccnccnacctgtgggtgccctcagtctacngctccnntcttgcctgcaccanccacnnccgcntcaacccngaggattcttccacntaccagtccaccnncgagacagtctccatcaccntacggcaccggcagcatgacacngcatcctcggatacgacnctgtccagnttggagncatctctgacaccaatcagatcttcggcctgagcgagacggaacctgctccttcctgtatatgcc

SEQ ID NO: 248163 - DNA, 706 bp, Homo sapiens
gtttatcacccagcgcctatcacggctgaatcggtgtcccagctccacttttattctccttttctccagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcatagaagggacacagagctgagatcgtgccattgtactccagcctgggcgacacagagagactccagctcagaaagaaaaaaataggtcactg

SEQ ID NO: 248164 - DNA, 284 bp, Homo sapiens
taaacatttttttttccatgaacaatatatgaggtctcaatatgcagtatatgcaacaatatacgcaacaaaaatataaacttctctgccctggaaggtagatctcactgttttttaaggacaggaaatggtcaactctgaaggtgagagaaacaaatttttctaaaatccttcatttcctttataccaagaaatacccataagtgaaaatttaacattgaaatttgtgtattttccagtatgcttaactttagaaatgatctgtagctgtagaaacccgattt

SEQ ID NO: 248165 - DNA, 417 bp, Homo sapiens
caaaccatccagacggcacagggggaggtcatgggaagcataaacaaactttacctacaccctcctgtaagttcctgttcatctagctgctaccataaacgtcacacggtgatatgtggcaaaattaaccagcaaacaacctcgggatgcggccataccaaagaactgcctcaaactcccctccccaatataaacccctccttctgtaagtttggggctgcttcctctctgactgttaagggggcagccggcaggttaacaaaaacttgcttgcctgactttgagtctatttttcctttctctcgggtaacctcacaccaacctccataatcatgtgagccaattctgtaaaataaatctttccctatatacatacatcctattgtttcttttttttttctggagaatccttattaa

SEQ ID NO: 248166 - DNA, 723 bp, Homo sapiens
ctttataaaaatgccttcttccttccttcctgaaggtctgctcagcaccctcaaactttttaccacctgaaaatcttttctatcaattttaccacaatggggggaggtgaatttccacaaaagatcttttcactttaaaaaattgaaatggccacataatttctcctcctaactgtgccgaagtacctaaaagtcacaggttggcattgctaggtcagccttttgcaggggccacacgtgcccaaggcccttacacacccagccaggtgttacagagcagcctctcaccatcaggctctgtgctagtgctgggaaaagattctgctggcatttaaaagtattgcacaaggaggccagatgcagcggctcatgcctgtatccaacccagaactttgggaggctgaagtgggaggattgcttgagtccaggcattcaagaccagcctgggcaacatgatgaaatcccacctctacataaaattgtttaaaaaattagccaggcatggcagcacgtgcctgtggtcctagctgctcgggaggttgaggtgggaggatcacttgggcccaggagttcaaggctgcagtgagccatgatcacgcctctgcactccagactgggtgacaagagacagacagatgaatgaaagaaagaaagaaagaaggaaagaaagaaagaaagagagagaaagaaagaaaaagaaaagaaggaaaggaaagaaagaaa

SEQ ID NO: 248167 - DNA, 641 bp, Homo sapiens
tcatgaaactagatggtcccatctgggggtgatgggacagaatgacacatcaggcattagattctcataaggagcaagcaacctagatcccagatcccttgcatatgtagttcacaatagggttcatgctcctatgagaatctaatgctgccgctgatctgacaggatgtggagatgcaaatgatggggagtgtcggtaaatacagatgaagctttgctggattgctctctgctcacctcctgcggtgcagccagcccgttcgttcgtaacaggccactggtactggtccgtggcccaggggttggggacccctcttctataggaaatgtgccaattcgagggagaaggatagataggtggagcacatcttacttttctactttgatatgtatgtgaaacaagatgaatgagttggtctttctattgctggaggtgttattaaaagggtggtaaaaacctctgctgcttcttataaaagatagcaaacaagactgcgtgggatctgtgacacgggcattttcaaaagaggttaaagaataagctgagaggtacaaggatcgcttgagcccaagagttgtcaaggctgcagtgatcgtgccactgcactctagcctggatgacagagcaagaccctgtctca

SEQ ID NO: 248168 - DNA, 226 bp, Homo sapiens
cagtcacctatctttttgaaaatacttaaggtggacttggtgatgtctgtcttctcataatttattataagcaattttaaaaaggttctgcttttaaaaagatcttttcaaatgtagaaagaacagtgtgaaatgtgaatgactggcttttaatacaagggttgtgacaaagaggcagtggcttttggaagccaaataaaggggtgaatacacgtgcatctgcata

SEQ ID NO: 248169 - DNA, 354 bp, Homo sapiens
cacacacctgtagttccagctactcaggaggctgaagtgggagagtcacttgagcccggaggttgaggctgcagtgagccgtgatcagaatttctaaaattcttttcattctacaattttgctgctttctatattaaaagcctctttgggtaatttatattttaaaaaaaattcctaattatctcaataaagtttgtttttcttgggtctttaagaatttagagagaattaaaatagttttgtgtttaatagctctgattctggaatcggtcaattaaggttgtaacatttaacatctaggacatccaggaaaaattaacctctctgagcctctgttttcttttctataaaatg

SEQ ID NO: 248170 - DNA, 162 bp, Homo sapiens
gcttcttttctgtaatgcagcccaggttttatagtggtgacagggaaggtcctgggaagaaaaggcctcttctggtagttggggagtgtgccctcaatcctgaaaagacacatttctacagaggtattcccaccatgcgtcttactctgtaatgggcagggc

SEQ ID NO: 248171 - DNA, 434 bp, Homo sapiens
ccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcaca

SEQ ID NO: 248172 - DNA, 456 bp, Homo sapiens
atatggaattgacctaaatgttcaccaacgtatgcgtggataaagaaaatgtgatatttacacacaatgaaatactatttagccatagaaaagaataaaatcatgccttctgcagcaatatggatataacggaaggccattatcttaagtgaaacaagtcagacacagacaaatggcgcatattcttgcttgtaagtgggagctaaaaataatgtctactcatggacatagagtgtgaaatgacatacaatagagactcaaaaaggtgaatgggtgggagtggggtgaatgataggagattacttaatgggtacagtgtacattgttgggtgatactctcagatacctgattcaccattgtatagtcttacgcatgtaacaaaactgcatttgtacccctaaatttacatgcacacacaaaagaataaaaataaacttaaaaacttagaaatgaaa

SEQ ID NO: 248173 - DNA, 612 bp, Homo sapiens
aagtcacatacaggtagaccttatgacatttccagttgaaactaggcttgctttcggtacacaggtgaagacttgaggaagccagtgccagagaggacgtgcctcacccctcagctggctgaatgcgcttcattggcttacgctttgctttctgtatgctttctgtccttctgggtggtgtcgcatatatttttaaaaccacattcagtgtgatgaacacttgttggtacacttctaaggttagtcatctttccttctctgagcagatccttgagaagggcattgacagtggatgctttaaatagtgttcagtttttaccagtaataatattttttggtggatgtcatgaaaacacatgacatcgtgttgtgcccatgataaaaagtcctgactttttattgaatgaggtgtgctggtcaaagagacagacgtggctgccttctctggtaacagccagaggaaaaagttagcaattctagatgggttctacagctttaaaaaacttgttgtatccttaggtcctcataatattaaatattttctaattttaacagattttaagagtcagatatatactttgacttgaatgatgtagtgttgcttaaggaaga

SEQ ID NO: 248174 - DNA, 262 bp, Homo sapiens
gaacgcatcccatcccaaactgcaaaaccacaagcatcaacagcaggagccgagcaaagtgctcggcggaggaagaggaagggcgagggagagaaatggtcgagtacagaagcctgcgtgtgggtaagaaaataccctaaccactcgcccaccggacgcagggcggctgggactgcgaatccagcagcagccacagcgtagcagcgggcggcagccgccgaggcagcaatgtcaggagggcacagctggaggaggcggccgc

SEQ ID NO: 248175 - DNA, 442 bp, Homo sapiens
actgctaccgactaagcagtacgggccgcctggaagaccgaaggcggagttcgctgatgcggaagccaaggcacagggcaataaggatccgcgccatttcttgtgatgtcacctgaagccttggcgggtagctgcctctcatccattcggaggacagggctccagccaccggcagctctgaaagagtttgaagaatttattgttcacagatggtatttaaatggacttatttctaaaagtcacattcctttattacttatttgttattagaagtacccattttcatatgtgtttaaaactatttgtgtctcaaattctcaggagattgatgcatcccagtttactctttttggcatatgtttttactcataaattaggttaaatttcatacttgttttataaaatttagttatttggttacattaaaatatttgtatccaga

SEQ ID NO: 248176 - DNA, 920 bp, Homo sapiens
atatttagacacattcattgtgacacatataacatgtgcattctttttatctttttctcaagtgggtctatagttgtgatttcacagcagattggggttgttggccattgtttgaagctctcctactctctttctagcatagtcagtgtgttgcagagaactaaagggagtaaaagacacagtgcctcattgaatcctaacattttcttcctggtagggcatatatcccaccttccatatatcctgctgtgaggtgccaataatgttcttttgttccaaaacagaacattacttagaactttctaaaatatgatagaacatgaatgtttacaatacagcatgtcagctatgtaaactgtaaaacgtaagtcacagttctttttgttctgtattggtgaatcattgcaaatttttcaccaagtgcaaaacggaaagaggaactatgaactccatcttgtagatttgtagattcgccacaaccaagtctgactgtgacactcccaagaaatctgtatgtaatcagcattgcttaaatattgttagatctaatgtgatcttctgctcttaaaactcaagtacatctaagggcattgagaatggaaagtctgagttctggtactagacaagagcagccctttaggccaggcgcaatggctcacacctgtaatcccagcactttgggaggccaaggtgggtgggtcacttgaggccaggagtttgagactagcctgggcaacatagtgagtacccttctctacaaaaaacaaaaaaattagctgagcatagtggcgtgcacctgtggtcccagctacttgggaggctaaggagggaggttcactggagcccaggaggtagaggctgcagtgagctgtgatcttaccactgcattctagcctgtgtgacagagtgagaccctgtct

SEQ ID NO: 248177 - DNA, 844 bp, Homo sapiens
ttataatcagtgtgcagtggtcggaaatgggggaattctgaataagtctctctgtggaactgaaatagataaatccgacttcgtttttaggtgtaacctacccccaaccacaggagatgttagtaaagatgttggcagtaaaacaaatcttgtgactataaatccaagcatcataactctgaaatatgggaacttaaaggaaaaaaaagccctatttctggaggacattgcaacctatggagatgcattttttcttctgccagcattttccttcagggccaacacgggtacctctttcaaagtatactacacgctcgaagagtctaaagcaagtttttcaccaagtgcaaaacggaaagaggaactatgaactccatcttgtagatttgtagattcgccacaaccaagtctgactgtgacactcccaagaaatctgtatgtaatcagcattgcttaaatattgttagatctaatgtgatcttctgctcttaaaactcaagtacatctaagggcattgagaatggaaagtctgagttctggtactagacaagagcagccctttaggccaggcgcaatggctcacacctgtaatcccagcactttgggaggccaaggtgggtgggtcacttgaggccaggagtttgagactagcctgggcaacatagtgagtacccttctctacaaaaaacaaaaaaattagctgagcatagtggcgtgcacctgtggtcccagctacttgggaggctaaggagggaggttcactggagcccaggaggtagaggctgcagtgagctgtgatcttaccactgcattctagcctgtgtgacagagtgagaccctgtct

SEQ ID NO: 248178 - DNA, 380 bp, Homo sapiens
ctatacttgaatatattaaattatagacataagtttctttgaaatatttagaaaaacaaaagttttagaatatggaaatccaagcttacattatattggcaaattatgtatgtttcaattattcactaaataaattttagctaaatgcttataaataaatatatatatgtaattgccaagttagggtttgctttgtattcacatttctaaacgctggacaatagagcttctgtggatgactgttttgctgtaattccaactgtctagttatgggaactaataatttattcttcaaaaggtattaagcatttaattttacgtggacaattatagagaatgtactaactgcattcgtttattaaaaaattgtcaaaatgtga

SEQ ID NO: 248179 - DNA, 550 bp, Homo sapiens
tgtttttatttcttgtaacatttttagttgggaactcttggctaataaaatcttctaattttttttaacttagaatctagagcaacagaatgtaatatataagctcagattcctaagttactcatgcctctgactttttatatgaggctagcaattcatttatttaacaatgtcatcatcatggtaatcatcaaaatgtacttgaggcatttatgtctgtgttcccatatctttcccactatatgaagtacaataaattgactaagacctcgtgtgtgggactttataatctaaggcagaaaaattaatacagatgagcatgcaggtcatctagacagctaggcaaacactgacacaatgtacaatactgtattaaaagcatatataatgcattgagtgactatacattagagtaaatgaaagatgaattataactgggcagagtggcacgtgcctgtaatcctagtactttgggaggctgaggtgggaggatcacttgagcccaggaattcaagactagtctgtgaaacatagtgaaaccctgtatgta

SEQ ID NO: 248180 - DNA, 421 bp, Homo sapiens
ctccagcgttagggcttcagcagaggcggttgctaaggcgcaccagtcctttacttcggaccagtctgaccttaacgggaaaggcaatttccctttctgtatggggaactcatttcctttgttgctttccttattttcctcccagggtcttttaattccatcctgattggggcctgagaggagggcatgggtgaggtgtgaaccagcagcgccctttcttccttctcgctccgcccccaggcaacaccctccagcacccaagcctaccctcttcctccaacggaaaaatgcacacggcatatccgtgtctgtccacatgccggatttcccggccagttctgatgtgaaatatcttgaaagtttgctaaggggccactttatattaaaagaggattaaaaaataaagaaaatcccatacctc

SEQ ID NO: 248181 - DNA, 305 bp, Homo sapiens
ctgagaaaccaaaatgaataatatcttggaacaatttcaaaacaccaagttaccaactgctggcagccgaggcccagcaagtcaaccacctgacagtgattatggagagacaatgacaacactctaccacaaatcacaacgcctctacctagtgccctgcccaacatggcatttcattggtttttgtgtctagccttctgagcccattccttagcctcacttgaccaaagaaaaaaatcgaaaagacccaagtaataaactgaattgataaatcaataaaataggtccactatttccttgaccaa

SEQ ID NO: 248182 - DNA, 401 bp, Homo sapiens
ttccctactctaatatttgttttgtaacttcgataccatgcacttcctcccacagttagctactaggaatataaggactagcagctaccagattattataatagtcacctaagtcagaggtcaaaaaactaccagctaaatttgtactgcacccatatttgttttgactttcatagtattccctttacacaaagcatgtgtctccagtttgtcacaggcccctaaactgtagacatttttttttaccctgagcctacttgattgtgtttcttgcccacatctgtagatatttgattttgcaaacaaggcttaatcaagcattattaagaagtaagtttgttgaacaaatcccaaaatattaaccaaagaaaaacattaaagcagatgggaattttttttaa

SEQ ID NO: 248183 - DNA, 540 bp, Homo sapiens
ccaaatttagctatattagggattaaggattcaacatataaattttgagaggtcacaaacattcagtccataaaagaatctagttgtttaacaaggattgttgagccctgatatcttgttatacctgcctgtgtccctacccccattcccctccactctcatttcctcacaaacactcagataaggattttttttgataccgtttttgttacttatcaaactacgtagtaacattatgaattataaatgttattagccattgagaaagtagctgtgcactgactgactgaccccagttgactgggagggctggatggtgccttctctgtggtggaagataggttggagaaatgtggttggtagtaaatgatgtctgatttgagcagctttgaagaagtctggttctagttggtttcagttctttccagatgccatttgaatctaaaccaattttccagttcttatcattacagaattgtcttctggaagaattatttctttgtattacttggtagcaatatggatgtagttttgtgaatc

SEQ ID NO: 248184 - DNA, 637 bp, Homo sapiens
agccatgtgtcgtggcttgcgactgtagtaccacctcctcgggaggctgaggctggtagaaccacttgaacccgggaggcagaggttgcagtgagccaagatcttgtcactgcactccagcctgggcaacagagtgagagaccatcttaaaaaaaaaaaattttgagtcattctgtataaataggttatccagattttcagttctaagtattatgtcatgatcctttccccatgacactgaatgttctaagaaaacatgatttttggctaggggtgatagctcacgcctgtaatcccagcactttgcaaggccaaggcggggtagatcacttgatcccaggagtttgagaccagcctagccaacatggtgaaaccctgtctctactaaaaaaaaagaaaaaaaaatttagctgacgtggtggtacgtgcctgtagtcccagctactagggaggttgaggtgggagaatcacttgaactcggggggcggaggttgcagtgagctgagattgcactgctgcactccagcctgggtgacagagtgagaccctgtctcaaaaaaaacaaaaaaaaaccatgatttgtaaaagttgcataatatttcattttataaataatatatttagccactcatctgta

SEQ ID NO: 248185 - DNA, 399 bp, Homo sapiens
cggtcctgttccttcttttgctttctgatcggttattacacttgtaagtagaggtgctaaggagttccccagaagagaagagtataattccttttgaagaccagtttcatttaattggatcatagacttttgaatactgtttgcactatactcattttggggaggggttgggggtggaaggaacttgttagaaactgcaaatttctgtgcttcaatcccagagattcagaggtagttggtctgcgggtggggcccaggagcctgcatttcatcctaggtgagtcagattttgatgttcctctggtaaatattagcctaagcaaggggtcagcaaagagacccgccggccacatctggcctgcagactaagaatggtttttgcatttttaaaggttgata

SEQ ID NO: 248186 - DNA, 447 bp, Homo sapiens
gttttagtgtacatgtgcacattgtgcaggttagttacatatgtaattaggtttagatgttctgaatggttttaaaaccaggcacctgaaaagtgaaaagcactaagccttaatatcatgtctatgcaaaaaaagcaaattcaagaactatgcatttagcttgtaaattaaaagtcatcatcatgactaatctgaataattctggtcaaagtggaccagatgtagataaagcttttatctacatttaactgcgcatcacttcatttgttaacagaagacaaactcatgagcaatagggtatctgagcgataatttgctgtttcctcccactcctgtttgacttcaagcaatttaaggatccaaccaatccctaaacatttaccagcccacccctgtttgctctccactgaatgtgccaatttgcatcatgacgcctacatgttgtta

SEQ ID NO: 248187 - DNA, 676 bp, Homo sapiens
cataaagggaagtagcaatggaaactatttcttctggcaacttggaatatgagaagtccctggtccttgggccatttttcaaatcagtgagtgtgggaggtataatatttgtgtgtaccaatttcttccttattccattctctccactgctgatgctgcctatactgaatgcaatgaaagtctggaacctaaggaagcctttgggtgttagcttaccttggagtcaagctgagcagtcttcttgttttccagagccatgaagtgagaagagacacaattgccaaagctgtgatggaaatcatacagctttgaatttgttttagtaacatggaattctaacatgtgtcactgttcattagtactggcttttcagagcctcgtgaattacttgggtacaaatccatgacattagaggcatgagggattagaagacaatccaacaccactctaggattgatagtttaggaagaaatgcaagaaatcatctcattttgtttggttggttcattcctaccccccattctccacatttttatgaaaaattttaagtatatataaatgtagacaaaatagtaaaattcactcttatgtatccatctttcagcttcaaaaatcatcaactcatgccaattcttctctaaccccttgttgtccccctcctctgattatttgaagc

SEQ ID NO: 248188 - DNA, 482 bp, Homo sapiens
cctaggagctagaaatgaagtggtaactgaataccagagcagtgaacagcaggcaggtcctgcagctcatctgggattatttactgattgtggaaaccagtgagaaggtggtttttgtttgtttgttttcattatttctagaataggaaacaacgctttgggccaatggaagagcaggaattaaatgcctaaataaggcagggaaattcttacctgccttgaaaggacaacataagtttgtccacaagtataagaaggcagcgtgaatatttgcctatctcagaatgggatctggatggggagtgaacaaagtatctgctgggaatttgttgctcctgtcctttctttaccaagctttgggttttgaatttacctacatgaccctggaattccgaagccaataaattaaataaaatttagtctactaaaaacttttgctgaagaagttactggagatgttcttcaagagaacacaaatctag

SEQ ID NO: 248189 - DNA, 424 bp, Homo sapiens
gacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtaca

SEQ ID NO: 248190 - DNA, 453 bp, Homo sapiens
tagatgatgaaggaggtcataaacagagagtagattaatataattatctttatttcatgtctatttgcaaatgggccattgttcacatagttgtctctctttctaaatggaagaatagttggagttgggggtggggaaataccagaactgagaggagtaaaggtgcttcaagacaatgcttcttaaactttggttttgtgtttgcatctcttggggatcttgtttaaagtaggttgagattcagtatgtttggggaggggcccgttaatctgattttataaaaagttcctagatgatgccatgctgctggtctctgagaagcaagagtctggggtcctttctaaagtgtttcctctctcctctatacagtcagaaaaggaaagtgcttactggtcagagatttaaaagacataggagatataccacacttctataagaccagaaacaaaaaca

SEQ ID NO: 248191 - DNA, 599 bp, Homo sapiens
tttgatttgcatttcccaaatgactaaggatggtgagcatcttttcatgtgcttattggctatgtatatatatatattctttggagaaataactaatcaagtcctatgcccatttttgaattgagctgtttgaggttttttgttggtgagttgcaagaataatttttttctttttttgagacggattcttgctctgtcatcaggctggagtgcagtggtgcaatcttggctcactgcaacctccgcctcctgggttcaagcagttctcctgccttagcctcctgagtaactgggactacaggcgtgcaccaccacacccggctaatttttgtatttttagtagagatggggtttcactgtgttggccaggatggtctcaatctcttgacctcatgatccacccgcctcggcctcccaaagtgctgggattacaggtgtgagccactgtgctcaaccagaataatttttatatcctgaatattaatcccttatcagatatatgatttgcaattttttttaattttgttgtcttttcactctcttgaccatgtcctttgatgcacaaaagttttaaatttttattcagcctagtttatctg

SEQ ID NO: 248192 - DNA, 629 bp, Homo sapiens
taaaacagtgttctgcttgttgccccccaccaccgccaccaaaagccctgacactttttaaagttaccatgggtgagttcaaagctgggcgtttgaggggcttcccatttttccccaacagtgttctcagagtggccgtgtctgggaagcggctgggtcccggggattgaactctggggttccaggctatgagccctacaccaggcttctcttgtgtcaacatgaagaatactccattttaaattccaagtgataactctgtattcccacaagtggtatatatcgtaaatattaaaacgaccattgtttttagttggtagacatcgagaagtaggaaaattcgcgatatcagaaagggactgcaggaaacgcctcccttcctggcttcccttgctccaggagatgcttgggaggcacccgtttcacgccaggaaactccgtaaaggctcccgggacgggcagaagccccgcgccccggctgcaccccgcgcacctgctcgtggcgcgccagcagcgcgggccaggcgcagaagcgcagcaccagcaggctgcgcgccagctcccaggttcgccagctgcagtacgcctcctacgcgttgccgaagtccacggcgggcaccagcggccgc

SEQ ID NO: 248193 - DNA, 518 bp, Homo sapiens
tgacagggacaaatatttcttcccttaaaacattctgtatcttcattaaaacaattatcacttttagtgctctcacagaatttataaatgtattggaaatgaaaggagcaccaccaaaaagctggttttctttaagggatatttttgaattgggtagtagggaaggctaggggctagtccagaagccaaagccatgctgcagggctggataagtgataggctgcattaaacacacagtctctcttcatgacactgacagtttttggactttcataaactgggcattaaagaagctaaaagttaaaggaagaaatttttgctaggtttttactaaaaatggaactcagtcctagcccagatcagtttttgatttgaccacaatagttatcttctcatgctgttttactataagaggaaagaggagaatctttatgggtagaagatattctctgaatatatacaggttgtttttttttttaaataacatctggctcgaaataaaaaaaaaatactatata

SEQ ID NO: 248194 - DNA, 731 bp, Homo sapiens
cgactgtctccaaagtttttgatgcaaaacagattaaactccccattactaaagagccttggatccaggtgtaaagaatgaagataaagggtaagtacaggcagtagagaaagcatagagataatgaaagatgaggctttcttatttgattttactagagccaatggaagtaacaagtttaaatgttctcattcatttccattatttaaacatagaagactacccagggacagaagggacccctcggaacaggattcccagaaatactcttatcccagcatacaactcctcagggacaggtgaggggcaagaactgggttttcaactctttctacatgtggggtttctgggagtgctgcatgtgggatcagtggagtcctgatgcttctgggcttgtactaggagacatttcactatggccgggatgaattcccaggccatggatgcctaggctgacattgaagccttctcatggctcattctatcagttcaatcttctggccagctctttggtcatctttgagattagattaagtagatgggatgcattccaagacatccttgaaggtccagagggcaaacacagctggcagaaagaacaagttgaaggatatccttggctttgatagcggatgaccctctagatctcaacagccagagactctgtcaaggatcctgtgtcattcagccctagacttcagaggcagcccgacaacaatggaaagagtgca

SEQ ID NO: 248195 - DNA, 971 bp, Homo sapiens
agatcatggagatctctatctcctaaacaacaaatattgataattttaaattactttttctccacctaaatttacctatttgatacgatgaatgaaggtcaacatggattaaaaatttggatatcagtctatcattagagaattaagagactggtatagagagaaaaaaatagatttaggaatacataccttcacgcagtacatggaagaaacacctaactgttgtgacatcaaatatgttaaagcgctttcattaacttaattttaggaatatcaaaatgcaacgtgtaaatccggttaataattagaggggatgccagcatgcacacagctcctccaagatagccagttaagatgatgtgtgagtaatagaaaaatcatttctatttttggaatggtttatataatttttcaacagaaaattacaggattagaaggaacctaaaaggatgatatggtccagtaccctgacgtcaataaatgagtggctatttttcctgatttgctcttttcataaaattgttgcagaaatgaaaactgcttgccttctctttttgccattccattattttaaccatctgtgggtcaaggagttattcttaattattactacgtttagtttctttgttgaaatagagaagagttatagttagtatcttttaaattaaacattttttgagtactagctcttactctagtttcttggtaccatatctttcagctttctctcaaaaggtattttcattcttatcaatgcttttcctatcattctggatacttcgttaagtttatcttcatttctctaagaagtgtaaggtgtagtggaagtattaatttagtattcttgtggtttctatttgcctgttttccctttgagagcagtacactccttttatttctgaatactctgcatcagagccccttgtctggcatgtagaatatgttcaataaatgtttattgaatgcataaa

SEQ ID NO: 248196 - DNA, 466 bp, Homo sapiens
tatgaattattctttttaactcactttggcaaataattgtcgagcatttactatgccttacacggtgctaggcttgtcccttctgtcaagctgtttatatttcactaaggataagagatacagataattagtttaagtgaaaagagttataacaaatgtgtatgtggcagaagataatggtggctgtggtgggagtggtccaggagggtgccacagagatagccgtggggctgggcattgcttctgaggagaatctcaaaggagggtatgtaagaattaattggataatggatatgaatgtgctttattagttgccacataaatgcagctttttacaactgtcaattcttacagaaggtgcctcttttctagaaaccttggctgaccgagtagaacaccatagttggagtccaaacttaattaaagtgagaagaaagattttagtagattgagattttatattaaa

SEQ ID NO: 248197 - DNA, 621 bp, Homo sapiens
tgtagatgcgggctgcggacagctgtcagctgttctagtccaggagtctccccatcccttttggatttccttaaccctgcctaactcagtcacaagcccctccatctgtgtctcttcatttgagccacctggggggaattctgtttcctgtggggacctcgaatgatactggggtggacccattctttattgaggacctacgctggcagccatctgcctaaaggcacacactgggaggaaggagtccagacctcccagggtagcacacatccctctgggagggtccaccattcacccggcttgctttcctggccactgacacccctccccaggccccaccgcaagtctttgtacaccaccttagtggagtctcgtgtgtggccctgtgaggcagggtctggctaggccctctaagggatgtggaaacggaggcccagggaggctggggctcttccctagggtcacccaactttgcacagcagagtccagttccaaatgtggggctagctggctccagtgctgagcaacttcctctgtgctgtgtgggaggttcgtcttgctcatgtagctcacgtagaacacacacacacacacacacacacacgtgcacacacaggccca

SEQ ID NO: 248198 - DNA, 392 bp, Homo sapiens
tcttagtatacacagttttggaaatttacaattccaaatattgagtgatagttgtgcctttctattttattaaactggaaatctttgtatcagaaatgtatttggggccatgtgctgtgactcactcctgtaatcccagcactttgggaggttgaggcgggtggattgcttaaggccaggagttcaagagcagcctggccaacatggcaaaaccctgtctctactgaaaataccaaaattagccaggtgtggcagcccacacctgtggtcccagctactcagaagactgaagcatgagaattgcttgaacccaggaggcagaggttgcagtgagctgggatcgcgccactacactccagcctgggaaacagagagagaccctatctcaaaaa

SEQ ID NO: 248199 - DNA, 454 bp, Homo sapiens
agataaattccacttcaaaaaggactgattgttaaagctgggttgatttttatagttacaaacgccaacaaagtttccaactttgagagctgtagttaagaatgccgtgtgaacttctccaccttttcgcgtcatttaagaacttctaggaggagaaaatcaccacctcaaagcctcgtggcataatgttacactactcggtttccgggctgtcgctgtcccccgcccccagcaagaggttcacagcctgctcctctctgagaccggttcgttttgaatcgcagtttacacgcgcgagtcggttttcgcatgcctcccccatccgttctagcagtttcttgcagacccttcgggtgcaccaggacctagccccggggcgccctcgctgtcaccacgtcctgccatagagcaggttggcgcccaggacgccgccgctgtactccccggcggccgc

SEQ ID NO: 248200 - DNA, 319 bp, Homo sapiens
  misc_feature (60)..(60): n is a, c, g, or t
agctcttccacacagagttggaacattttcaacccagagtgtgacttccccgcagccctngcccaggccctctcacaaggaggaggccaggagcacgtgcaactgaacaagctgtgaagccagccgggcacagaacccccggggtggaaggctcccctgtgaaaatgcaagaggaaaggcgcaaagggaatcttcccaacctctctacctggaagcatcctcatctgtgacatgaagcaaagaacagtgccttcccgtgcaggctctttttgggattacaccagaacataggcatgctcaataaatggcagctatttgc

SEQ ID NO: 248201 - DNA, 180 bp, Homo sapiens
ctggaatggctccacaataggggtaaagaataaactgggaacttggaaaaggaagtttaggaaacatccaagattatagaaataataataaaggaatgggaaatatgagagaaaagttgaggggcatggatgatatatccaaaagttcaattgctgtttaatagtagtgccaaaaaaaaa

SEQ ID NO: 248202 - DNA, 568 bp, Homo sapiens
tctgataactgcaaagttttgaaaatattaatttgattgtgttagaatccaggctctcatcattctcagttttaccactttcttgggttttacacagggctgcctctcacacttctgttaagtggctggccactgaaggcatgtaagtttatgtaacagctaaaattttgaactgattatttcaaaaatctatctgcacaatgaaaggttagtttcattagaatcacctagtaaagttataaaacatacagattacaaagcctcacctgtgaagctttttattcagaaggctatggtggagatagaaatttttttttaagttctacaggtagtagtgataagaagccaagtttagcaatccctatattaaagaattcataaagccgtttctaacatggagagtccatgatcttaaagtgacttcaggctggtaattattgtactatgtgtattatgcatcttaaatagtggtttgaagcagtgtctttaggaggcagttaagtttctgtcaaaagtattcttttcctaggaggttcatcagtaataggaagcctgaagattaaaaaaa

SEQ ID NO: 248203 - DNA, 494 bp, Homo sapiens
agagagcccctcacccaagcccagggccacattgcccaccgactcaatgtttggctctaccacatccccgatataaccatgagaccaagccccaactcagtcatctaagacggcatcaggactgggggcctgggtgtggggaaggttccccagaaactgcctgatagggtgcaaaggagaggaaaaatagctgctctgcacagaatgagaagctccaacacacttcttttttaaattattttttaaatagagatgggttcttgctgtgttgcccaggctgatcttgaactgctgggcttaagtgatcctcctgcctcagcctcccaaaatgctaggattacaggtgggagccaccgtgcccagcaccaacacacttctaaacagagttccaaaggcagaaatagaaagtagaaaagcattatttaaggagatcgtagctgagaattttctaggatgaagcatgagcccttaagctgaaaatatcaagcaaaata

SEQ ID NO: 248204 - DNA, 546 bp, Homo sapiens
actattgtgagagatctgcaaatttaggtttaggccactgctgatatcctaaactaagtgagatctgtaatgtctgcaagttagtcagaggtgaggatggaaagcagcaccagtatccacaggacaccagcaccatccatggagttctcaagggccactcaaaaaagcctgcattctgaacacttgttgttttatagtatttggtgcttctggtcgtcaccatgtcctcccacgcccactacacacatacacacatcccctgcatagtgcaacataacattgcaaagccacaaagaaatgtatcagagaactagtatatggacccaacaaagcttcaggaggaccttgttagacccaattaaagccatatggcatctagtgaacacatttttaaaaggctatcctgtagctcagaaattacaaaataccacagaaagaaatgtcaacaactccaattctttactacacattaagctactaaaagtaacaggcctcaagaaaatcgtattattcactgcattttcttcactgtgataaaaaaaaaaa

SEQ ID NO: 248205 - DNA, 553 bp, Homo sapiens
attggagaaagaatacgtctctctgatgtaactactgcgctcaggcaacccactgtggagcttcacagtggttctctgccaaagattctgaggtttttagcctgagatgataggtcaaaaccagggaggtgctcatgggggaaagcagcactggacagagtctagatgctgcttccctcaggctgtgatgaccttcaactggccctcatccccaagaacctcagcttcttcctctgtattaaggaaataaccatagccccgtccgtctgtcacaatgtagaagcggggatgagaagtgaaaagtgaggtcttgcaaaggtctcgcaagtcctctgcaaagctaaggggtattactggacagcgacttggatgaggatggccagacattgtcctccttcaggaccagcttctcagagcagagtctccaaacataatgtcgcttccagatgacgcaaatctgatatcagagaatgactaaaagcttgcaactttgcttttaatctgttgtggatcaagttttttttcaaataaatcaaagtctgtgaacttagga

SEQ ID NO: 248206 - DNA, 520 bp, Homo sapiens
aatctatgattctattggcagcaggtactatagggacaaaaaacaggttggagggaaaggaaggcaatgacattccatatcgcagcgctgtttaatctcagtagtaggaggactttcagaggtgctacacaggcaatagtgttgtacaagtgagccattctccacttattctcagttcttaaaatgtgacctgaggactgctgatagactacaagagtcttccataggcaatccatcttggcccttaaatttaatgtttataatatgaacacacaatactactttccagcaagaaaacatcctagcaacatttaataaacagttttcactttatgggaatctcattaaagtggtcccagtctttccatgaattccagggattgcatgttctttttagagggtcaatttttgaaatagtaaatacactatgggagatggtttgttgcatttgcaaactgaaaaatgtttaactgctaaccttctgggatctggtacatctttacaatgcttcaccctacag

SEQ ID NO: 248207 - DNA, 447 bp, Homo sapiens
aaattatccaggcagggtggtgcatgcctggtttcagctacttggagctgaggcaggaggattgcctaggcctgggaggtcaaggctgcagtgagccatgattgcaccactacattccagcctgggtgacagagtgagaccctgtctctctctctctccattatatatctttttgaaaaaagaagatcttgtttgtattaaacaatcatcatttaacataactaaacaccactactattatactccaaggaataaatactaagataaacaaaagtgttaaaggaaaattgataaattttattcctaaaaaataaaatctggctgggtgcggtggctcatgcctgtaatcccagcactttgggaggccgaggagggtggatcacctgaggtcaggagttcaagaccagactggccaacatggtgaaaccccatctctactaaaaatac

SEQ ID NO: 248208 - DNA, 337 bp, Homo sapiens
ctccgggacagttggcttgctggagcaaatcattgcggtgtctggtgtctgccggggggctgagatctgggctgtgtttgtctctatccaaacagacagaacgttagaatgaggttgtctttactgcgtatccctgatgttcgggagcctgtgtgggcgagccgtcacctcctggcactgcctcaaggcggcaccaccttgcagggtgccctgctggtccagcatgcgggagccctggcacccatcaaccccagaatgaggcacagcgggcagctggggatagagcccgtggcatcccagagggtgctgcccaggcatgtcctggcactcttctacc

SEQ ID NO: 248209 - DNA, 1169 bp, Homo sapiens
gagccggcgtctggccggcccggaggggccagagacccagatgggagaagaaggcctgcttgccagtattgcaaggcccagctatcaccagacgtgccccaggacacagagcacagtgtccagccttgacacgtcctctccggagtcgcttctgatgccaaaacacggctctgccacttgccggttatgtatgtgaacagttctgaacttaagccgccatttccttacctgtaaactgggggttcgttttccgccatcagattagcaaaaagaatgaatgataatgtccagtttagtccaaggcatattgaaacccgttgcgtgccctagcagctctaccaggagtggataattagagtaaaacttggcattacctacagacgtttttaaagtatatatcctttttcccggcagtttcacttctagacactagttataaagaataagtacacatatacaaaagtcatttgtgaagatgtttaatgccatattgtttgcgtgctagagaaacactgggtggggggggaatgtagattaacaggaaactggttaagtgaacgctgctacattcaatccgggttactaacatccatccaagaatgagctacatctaggtagtgacttttttttttaatacaagacattaagtttaaaaagcagaacactgcacattatataatcttatttattaaaacacaggcacacaagacctaatactacttaatgtcacgtgcactactccttttagatatttattgagagcctattacgtaccacacattgttttggatattgggaaatcaacagtaattaaaatccctgccttctagtaatgggagagcaaaagaaaatgcaaataataaaattcaggctggatgtggtggccaaagcctgtaatcccagcactttgagaggccaaggagggaggactgcttgagaccaggagtccaagaccagcctgggcaatatgagaccccgatctctacaaaaataaagaaaaaagaaagaaagaaaataagaatattagtgcatggtggcacactcctataatctcagctacaaaggcggctgaggcgggaggatcacttgagcccaaagttggagactgcagtgagctatgattgcctcactgcactccagcctgggcaacatagcaagatcctgtctct

SEQ ID NO: 248210 - DNA, 399 bp, Homo sapiens
aattaaagcaactagagaggcaaacccaaaacccatggatggtattttcaaagtaggtaggtggcaaggtagctgcaatttcctgagaagcccccatgtgggtctgttttatttcagccattttaatggatgtaaagtggcatctgaatgtcgttttaatttgcatttctttgatgaccatgatactgaacaccttttcatatattgagctatttatactttggtgacatatccaaatattttgtccattttgaaaattgggttgtctttttagtactgaattttaaacacaaacccttgaatacagttgtggcttttttcattttctcaatggtgtcttgataaacagaagtttaattctgaagttcaatttgttaatattttatggctagttctttt

SEQ ID NO: 248211 - DNA, 1221 bp, Homo sapiens
gctcatcatccttctccatagggaaaaaaatggcattaacttccaacaagaaactgctgctcttctaccgtatcccctttagaacataaaatattaagaaagggtttctgaagcattcacaggaacagaaaactgaagcctgaagcacttcactctgcagcaagataaccccttaaaaatcatccagaatttgggggatggaggtaacccgtcaacacccgcgacacccctaccctaaggtggggagcaggattccgtcaaacagaaaatgccactctccgccccctccgccatccggaacgctgaccggcgcggagtgcgggggcggccgagggcgggagcggcgaggaggcgggacgcgacacacgcaccacgccgagaactgcttcaccgcttttttaaaggtcgcagagggagcggcggccgcagcgccaaggaaacccaggaccgggagaggaggagcggcggcgacggcggcggtaactcggaaggagcgagaaacagccccagcgcgcgacaggggagggggcgacgggggcggggcgcgagccgacggactccgaggacggtcaccgcggcgacggccggccgggcgcgcgcacgcgcgctcccttccctccgcccccgggagcccgaaaaagattcccaccctcgctcgcgccgccggcccctcccccacttccggcgtctcctagcgacggcgggggtaggggccgggatgcgcgcgggagttggtggtgcagtttaacccttccggcgccgcccgccgcttggagcggctggagaagcccccgactccggcggcctttgttagcccggccgggaacacacaacctgctcagctggttcctgccgggtccttccgggactcatctcggctccgtccccatggaggtcatcggcctagggaacttctcgaaggcttttctccctctgcttgcttgacgggaggcgcgaggagggcacagctccactcttggggacctcctctgtggaaagatcacccttcaacaggcagggattaaatttccacgccagctgtcaatgcgcactggacttcattttgctcaggattggacctcatcctccttggtgcagtgattgcgagtttcctaacccaggtttctgcgcccgcactcttgcacttcccgtaaggtggttcctggcagataacccttcttcagggtgggtgcggggctacatttatgttgcattctttga

SEQ ID NO: 248212 - DNA, 1562 bp, Homo sapiens
gctcatcatccttctccatagggaaaaaaatggcattaacttccaacaagaaactgctgctcttctaccgtatcccctttagaacataaaatattaagaaagggtttctgaagcattcacaggaacagaaaactgaagcctgaagcacttcactctgcagcaagataaccccttaaaaatcatccagaatttgggggatggaggtaacccgtcaacacccgcgacacccctaccctaaggtggggagcaggattccgtcaaacagaaaatgccactctccgccccctccgccatccggaacgctgaccggcgcggagtgcgggggcggccgagggcgggagcggcgaggaggcgggacgcgacacacgcaccacgccgagaactgcttcaccgcttttttaaaggtttttaaaatgcagtttctccagccggagaattcccacccattcaccagccccagccctcacccagctccccacccccatcgggggctccgctgggccgtgtccccgaggcggcctcggccccacgccccgaggcgcgcggcccccggcgggggggtccccgacgcggcccagctggggatgcttcgcacctgtatgtagttgttctcgcagtaatcggccacccgttccagatttgtgtagctgtcgaagagggcccggcggccccccgggatttcctcttccagcagcatctgcagctccgccatcttcacatcctcctcctcctcctcctcatacaggtcgcagagggagcggcggccgcagcgccaaggaaacccaggaccgggagaggaggagcggcggcgacggcggcggtaactcggaaggagcgagaaacagccccagcgcgcgacaggggagggggcgacgggggcggggcgcgagccgacggactccgaggacggtcaccgcggcgacggccggccgggcgcgcgcacgcgcgctcccttccctccgcccccgggagcccgaaaaagattcccaccctcgctcgcgccgccggcccctcccccacttccggcgtctcctagcgacggcgggggtaggggccgggatgcgcgcgggagttggtggtgcagtttaacccttccggcgccgcccgccgcttggagcggctggagaagcccccgactccggcggcctttgttagcccggccgggaacacacaacctgctcagctggttcctgccgggtccttccgggactcatctcggctccgtccccatggaggtcatcggcctagggaacttctcgaaggcttttctccctctgcttgcttgacgggaggcgcgaggagggcacagctccactcttggggacctcctctgtggaaagatcacccttcaacaggcagggattaaatttccacgccagctgtcaatgcgcactggacttcattttgctcaggattggacctcatcctccttggtgcagtgattgcgagtttcctaacccaggtttctgcgcccgcactcttgcacttcccgtaaggtggttcctggcagataacccttcttcagggtgggtgcggggctacatttatgttgcattctttga

SEQ ID NO: 248213 - DNA, 380 bp, Homo sapiens
ccaggctggagagcaatggtgtgacctagctcactgtaacatcaaactcctgggcttaagggatcctcctgcctcagcttcctgagtggctgggactacaggcaggcagctaatttaaaaaatgtgtttgtagagacaaggtcttgctatgttgcccaggctagttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaa

SEQ ID NO: 248214 - DNA, 226 bp, Homo sapiens
tccccaacctctcatgagctcctggagtatagtagctagaccgggagcctgttccattcccttctggggcaggcactgagcctttaggctagctagaggccccatagatgaggcttggcagaaatgtgctctgagctcctgccatcagattgtcacattttgcagagtgagaggagttccagggcagtcttcctttatgtggcttattcccttcagtgatgtcctc

SEQ ID NO: 248215 - DNA, 802 bp, Homo sapiens
ctgggtcatgggcttggcttctatcattatgagactatgaaaaccaaagcctgagtttggcttctgtcagtagctaacctggcttcagtgctctgcttatctctctgaattcctgccctatcttatgttttgggcttataattctttaacattagctctttgaggcttttaagaatatatatttttcgccgggcgcgatggctaacacctgtaatcccagcactttgggaggccaaggtgggtggatcacaaggtcaggagatcgagatcatcgtggctaacacagtgaaaccccgtctctactaaaaaaatacaaaaaattagctgggcgtggtggcgggcacctgtagtcccagctactcgggaggctgaggcagggagaatggtgtgaacctgggaggcggagcttgcagtgagccgagatcgcgccactgcactccatcctgggcaagagagtgaaactctgtctcaaaaaaaaaaagaaaaaaagaatatatattttctgatgtatttagttttaaaaatcttagttgtagttgtgttctgtgtaattggccatgttattggagatggatatctccattcttttttgaatatgaagaaattaaggctcagagagagagagtagttcaggtaaagttgtattactagtaaatagcagagtttgactttcagaagcttatttatgatctaggagtgtgagcagttaggcttgcgtattctttcccatatatgactgtagtcttaaggatttctactgttttagccatgtggaaatgtctcagtcacagaggacaagaaa

SEQ ID NO: 248216 - DNA, 463 bp, Homo sapiens
ttaagggaagattccaaacaagttgagctgccactaacagccagctctgaggcttttgtctctgagtgtttacagcccaggaagtctggcatccactgcaggtgaccgggcagggtgcaggtgtgaggctggaagtgagagcggacagtgggactgaaatccggactcagcagttcccgtcaaaaagacattcagactctcccagcactttgaggggcggaggtaggtggatcacctgagttcaggagttccaggccagcttggccaatgtggtgaaacctgtctctactaaaaatgcaaacattagccaggcatggtggtaggcacctgtaatcccagctacttgggaggctgaggcaggagaattgcttgaacccggaaggcggagtttgcagagagccgagattgcaccactgcatgcactccagcctgggtgacagagggagactccacctcaaaaaag

SEQ ID NO: 248217 - DNA, 288 bp, Homo sapiens
caactcctgatcagttatttctatccttcttcccttctgaaaatctatgtttgcaggcagacttagaggcttctagtgtggatgtggaagcctttaactccgtgaccccactgtgtggccagtgcttgagttctagggtatgggcctctggatctattgtgcagtgtttggtctgattctgtcctctggaatcttactcgctttttttgtttttcaaatctgcaaaacgcacccctctcttgctgaccacctcttgcttggtgctacggatacctcctgaaatctggc

SEQ ID NO: 248218 - DNA, 426 bp, Homo sapiens
ggaagccctggagaatgttttacaacatccttggtggttgtcacaactctgcagattccttggcttaataggtaagagcttttgtaataaggaaggccaagcaaaagtctctgaaaccggatgtcccttggccaaaggagtaaatctaaataatattgaataccgagggaagtggcagaaattaatatcactcttaaagatttaaagtatgtgaggatagtggtctccattattttgtaatttaatgtctcagtctagatcctacaaaacccacacggattctgatggacaataaaaaactcttgccaattcatccaaggagtggccctgattacagatgctagaccgtgtgtgggatgttactagagcaggttaacatgtttccaggtacattgcatgtgcacatcaatctagcaagccattctt

SEQ ID NO: 248219 - DNA, 373 bp, Homo sapiens
tctgtcaggtccctactggaatatttaaaattctgtttttcatacttatcagctaaaagaattacagaaatatatttctggatcctgtggggaataagagcagaaatatacaaagcttcttctttcaagacggatcccagcagcccaagctaatgtcacagttgtgttaaagactattgattccagcaggttctgggctgggtctcagcttcccaggactgttccaggctgacctcctttccctggttccatctttttttgggacttctgtgggccttcattcagcatgtggcttgcgggtgtccaggtctgcaggcatacacacctctcctgatctgaatcagagaacaaaagataaaggatcgaggacaat

SEQ ID NO: 248220 - DNA, 425 bp, Homo sapiens
aggccagggctggagaagcagaaaaaaagcatcaagcctacaaatgcatgcttacttgcagcagaaatagactaattgcatgggcgtttccctgggatccctgtctccaggcttctctcatccatgcctttctaggcagcccacatcagcccttgcttaaaactctccaaggtttctcatgccaagctccctgcaggacatcccaggccctctgggacagcagctcacgggcctctccagcctcatttgccactgtgacccattctccagcactgattcatcaattagcccatcacaggcgtagctacaagattagttttgagactctcattctatatatttatgtacatcctccaaaactgataaaacaagaaagccgtcaagttgtaattgataaatatgtaattaaatgtctacaaaatgta

SEQ ID NO: 248221 - DNA, 241 bp, Homo sapiens
gtggagaaactggatgattcatacattgttgatggaagtgcaaaatagtacaatcactttggaagacaggttgacagtgtcttaaaaagctaagcattgcaaatactgggcaacccaacagttgcactcctgtatggttacctgagaataatcagaagtgaatagaagtgactcaccccccttaaaaaaaaataagaataacggccgggcgtggtgacgcacacctgtaatcccagaactt

SEQ ID NO: 248222 - DNA, 433 bp, Homo sapiens
tgggtatgtgtgtgtcattgcgatggcttcaacagctaacagtcaacaaggctaagatctcaacttcggttccctgacatcccattagggtctttcccactatcacaactccctctgacattatggctcagttctcctgactctcctcctcatgaggtttctgccaatgcccagactgcttcctgccaatgttgttcttcccatacatggtaacaccattgggtcagagctgggagagggcatcccttggccaaactgtcctctccaggctctggcactcagctcagaatgctcagcattgcaagcctagaacaagttccttaacatgagaattcacagatttgggtgtctgtttccagacctacgatatctgtcaacagaatactaatccaagaagatattttgacaggagagagaatagtgaccccagaaa

SEQ ID NO: 248223 - DNA, 505 bp, Homo sapiens
tcctggtcaggaccccctccttggtcccagttgtagcctatgaggagatggctcttggctctgtcaacacctgtctttgccactccagcctgagggagggtagtgatctcgtgttgctgctgatctctgggcctcacccttctacttttgtcttctctgctcttccaagacctttctaagtagttttctgtattaaagtctcactagcaagctgtctggaaggggttcgtttttctgatggcgccatgactgacacaggtgattatttgagaaaatgcctctaaagtacttagaatagtgcttggcacatagaaattgctcaataaagggtagctaacaaaacctacttactttcttccttacctagattctctgcggccaatttaacccaggcgggcaggcccctgcatacaacatagctcctgaatcattgcccacttcttctcttcctggttgaccaagtccatagacatgggcttctattttgattcacccttctctaatc

SEQ ID NO: 248224 - DNA, 325 bp, Homo sapiens
gccaaataaatcccatttttctcacccttctacgtgtctgtgagcctaatctttcctagtcacgtgaaaagaaccctaaggagaatgtctcacaacaatttgaccatgaacctctttttatgcaatatacctattaaggtctcatggaaaatactgccatagtgaaaactctaattgcagaagggggagcccaagccataattcccaaatcaatcctcaatccacaagatacagatgatttttaaaactccacttgagaccaaattgtctatcactgaaaggaaataagtcttaactttcccacagcctaattcaagactcaggt

SEQ ID NO: 248225 - DNA, 245 bp, Homo sapiens
aaaaatttagttcctttatttatttaattcctttaaatatctttgacctccaaatgcataggcactgttctaaatgccagggatacaaaatagacacaaaactccttaccctcctgaaggcttatattctattggagggaatcagacaataaaataagtaggaaaatattgtatattagatgatgggttgctaaataaccaatatcattataggcactaatttgggataactatatccatgtctt

SEQ ID NO: 248226 - DNA, 539 bp, Homo sapiens
gagaaacgtgtgactcttgaccattttgtttaccaaataatgtagtgtgagatatctctactacagtaataacttccggtgtaatttacattggcgtttgttaacagcaaaagacctctcctgtgggggttaagaatatttaatcctttaaagctgacatatataacatgtagctatgtcagctacagctgtttctaaacatcagtaacaaaattatagacaggttttgaagcttctgtggtgggaatgaatacatctgaggattcaacttgctgacagtgtttttgtaatttaatcttaccatctggtagaaagtaaacattttttataaaattaaagtttataaagtgaatcgcttatagtttccgattgttgtgaatgacaaatttaagtgtactttcattgaagaatgaatggagattctgccactgttttgagatgcatactagatcgcaactgattttgccatttgatcttcattggttccttgaacagtaaacaaattggcactttcatgtcagctaaggattctgtgtttc

SEQ ID NO: 248227 - DNA, 415 bp, Homo sapiens
agtcctgaagactgtcctagtttcccagacaagtctacttcccagcaggtctctgcacaggtaggttgtgtccccaactatagcaagaggggcagaagttgagactggaccccttcagaatctgctgtgggaaggaggctgatgggcctttctcattggctgagacaggcatgtgttactcagcaagtctctgcacaagtggagtagtttcttgcccataacaggaggagctaaagccaagactgggcctcctcagggtctgctataagatggagggtggccgggtgcctgtagtcctagctactcgggaggctgaggcaggagaatggcatgaacccaggaggcagagttttcagtgagccgtgattgcaacactgcactccagcctgggggacagagcgagactccgtctcag

SEQ ID NO: 248228 - DNA, 400 bp, Homo sapiens
ctttttcattcaatctcttgtggaatcataagtcatggaacctctgcaaaaagctaccacaaagagatgagaatgtgagtgaacaaggcaaagaatatactcattttaaaattatttatgggctgggcatggtggctgacacctgtaatcccagcactttgggaggccaagacgggtggatcacgaagtcaggaatttgagaccagcctggtcagcatggtgaaaccccgtctctaataaaaatacaaaaattattcaggcatgatggtgtgcacctgtagtcccagctactcgggaggctgagacagtagaattgcttgaatccgggaggtggagattgcagtgagctgagatcacgccattgcactccagcctgggcaacagagtgagactctgtctc

SEQ ID NO: 248229 - DNA, 443 bp, Homo sapiens
tctccaggaagcccccttgtctaggaagagaaattgaatatcagcataaggtggtgaaaagctgtgaaggagatgagtgccaggagtccatggaggaaggattctagcctggacaggtgattgtggtgaatagtcatgagaatctgggaactggctcctgctctgtctatcttggagatgcatcttttgtgagaagccagggcaagaatagggaggcttaggcaatgggaagtttctgagtagataaagcagatggcagagcaaagggacagagcctggcgagaggctactccctgtagcaacctgcctaagagtgagaggaaagcaaggcatggctatgagcacgtgtagtctcagctacttgggaagctgaggctgggggatcacttgagcccaggagttcaagaccagcctaggcaacatagtgagaccatgtctcttta

SEQ ID NO: 248230 - DNA, 770 bp, Homo sapiens
caggatggctccccatgtacacttccctcctcgccccagctcacctacactggactatgacatgatcaaggaatctttttttttaagctactgagatttctgtgttgtttacatagcagtttgtaccctaaacaaacacttgagattttatacttcaggaaactattcagatttccttctcattagcaattgttccaaaaacacttactctgctaatttctgctagaaagaatcacagttcttctaacacagaaacatttctgtcccttgagttgggaaacaagaccctatgttaacccagtcagagtgtggactgaggcattcggagcctatttaagcagaagttttctataaggacaagatttaaaggcttacaaaggtaaagacaatggcctggtgggaagaattctagtctagaacgtttgagatttgactctagttctaggttcatcttagctgggtgtgtaacgttgaaaaaattggccgggtgcagtggctcaggcctgtcatcccagcactttgggaggccgaggcagacggatcacgaggtcaagagatcaagaccatcttggccaacatggtgaaaccccgtctctactaaaaatacaaaaattagctgagcgtggtggcgtgcgcctgtagtcccagctactggggaggataaggcaggagaatcgcttgaacctgggaggtggaggttgcagtgagctgagatcgcgccattgcactccagcctggtgacagagcgagactccgtctcaaaaaaaaaa

SEQ ID NO: 248231 - DNA, 364 bp, Homo sapiens
ttaaagtacctgggtgcttagcaattcttgattgttactcagcagactaatatttaaatgtaattgctgttaggtttctctgatattgtccctttgactaaacaaaactagatgactagccacattttcttagtccttgaaaaataacctgccaggcacagtggctcactcctgtaatcacagcactttaggagactgaggtggggggatcgcttgagcccaagagttcaagaccagctgagcaacatggcaagaccctgtctctacgaaaaataaacaaaattagccaggtgtggtggcatgcacctgtagtcccagctactcgtgagactgaggcgagtagatcgcttgagcccaggaggtc

SEQ ID NO: 248232 - DNA, 475 bp, Homo sapiens
actttaatttttaattgagtgcttcctattaaagtagatttggtacttccaagactatgaaatctatatttacagctatgttatttttacatttctatgttattttatatttttattttacactgctattacatatagcaaagatagtaaattatgaattagccatctgagggaaattggaaaagcagaaagtatagtaacccctcatttatctagctcccagggattcaaaggacagatgagtttcctactaaggcaaagaagacccaacactggaggtaaaaacttatcacggaagttagaggcattggctctgagttttgtctaagagtcttccatctcaatgtttatttggaaagttttcactcaggaaatttaagcatctagagtttacatgtacaactgctgtcctcctacccagttgggccagcactggatacacctctcctgcttttgcatgagcctgacctttaaa

SEQ ID NO: 248233 - DNA, 471 bp, Homo sapiens
tcttggggggtggcgggggaggacgacgtgggggacggttggagggaaggtgaagagagggaagaagaaagtgcaactgggaggcctttgaaaaataaataaataaaagaaaagccccttcaggtaacaatagtgagccagattctttcagaaccaagcttttcagatttgaatattgttcccacccgtccataaaagtccatctatagagaagatatataaatgagcgagtgagtgttgtggaaatatatatatatgtatgatttatatataatggtgtgtataaagcttttcggggttggctgtagtgtaaaaagtaatgactttattacctctgaaaggttctgtggttcacatttaacagtcttctgaattacaattcattacacaattgtgtgcgctctgacgacggcaccctatcagggctgctatctgtggctatttccaataaataactggcaacattaaatt

SEQ ID NO: 248234 - DNA, 316 bp, Homo sapiens
gcatgtattaattgtctctgcaagcaaatgcacataccaccattaccatttggaagcatgctcttttctattgaatttgttgtaaagcattttttgattgtgttttgatgaatgctgctctaagttcagatttatcttttgcttcgtttctagcaaacaaacaaatgtccttttagctaactcctgagtacatctatatgagggatatttccaaatttgtaacactgaccatttggagaagggaaacttaaaaattattattttaaagaagtgttttgaaacatgtttctaataaaaatttatatatcttccctat

SEQ ID NO: 248235 - DNA, 374 bp, Homo sapiens
atgtttattttacacacatgtgatcaaattgtacatgcaattttagtatttctttcttccctttatatttataaatatagatttataacatgtgccatcccatgctgttaaaaacttcataaacttcctttatgtaggctgcataaggtactgttgcttggcagttccataatatatttaccattccatttatgttggacatttgcgttttttccagctgtttttttactgtgggacaaatctgttctctcgcgcacgctctctctcttttttttttatgagacagggtttccctccggtcgcccaggcaggagtgctgcagcgtgatctcggctcaccgcaacctccacctcctgggttcaagtgattctcct

SEQ ID NO: 248236 - DNA, 440 bp, Homo sapiens
catatatggggcctgcttccttaaatatagcctgtatcactggaatgtaactttaagagaaaaatgttctaagctggttctatttgtttacagctctttacccagtagagtataaaacctagcaattgtttatcatttttagaacagtattgagcagcatctttatgaacccaagtgataggaaataggcttttgatccttttgagaacttaaccctgggcaatggaactgattccatggggtctgagtggagctgtggtttccaaagacttgcacatttaggttggttgatttagaattcattgtttgtagaatggtgtgcttttccaactacagatttaatcctaataaccagggtatttaccatattatcaacactcttagaaaaagacctcataaaaatgccatttaaatttatctttgctgttagctaagttgaa

SEQ ID NO: 248237 - DNA, 547 bp, Homo sapiens
catagtttgtactgtctttaagttttcttatttttattttgttggtagaagcaggaatatatataaaaatgtaacagggtaatgtattggatgaaaataaattccaacttaaagaatgaactcctgaactcctgagaccacaagttaactcagtgattaaagcaaagttctaaagaagcagtgactacagtgccagctttctatgccatagtcacagactatactgtgatgaccctagcctggtagcacttcagctgaatataagaactaagaatgaaaatacatgaacacaagaagtacccccttcactgctgaaaaattcaaattatactcctattcatcatacttatttatatgtaaagaacggatgtggtcttaccatatatatacctatcactttgattgtgagggaacaaaagcgtgcagggccctgagcagtctggtaaaagctttgacatattcacatgtgtaaacaagttcattgagctgccattgttaaatcataaaggccgagagaattcagactaagtacatttccttagaggaa

SEQ ID NO: 248238 - DNA, 449 bp, Homo sapiens
acctggtttggggccaaaaaaccaatgatgcaggcacccaccagggtggttggtttaatataaaaaatagccattcgtaaaaacaggtctgtttaaagagcctcttgaacggtagaattgtttagtgatgtcgttgaaagttttctgcagtatctgagattcagggctcaaaatgtgagatctacaactcccaccttccctgatctgctttctgtgattgcaaaacacagtgaaatgactaaacactcatgccttcccacaaaggcagaagctgccagtcgcgattctgagcagtcttgtgaagtcagctcttttagaaaactgaatggtgtgtttgttttgaagtagtccatttttttcttcaccctttgggaagaacaattattgatatagatattgaatagcaattaggctaacaaagactgaaatgtaagctccacaaaggtccc

SEQ ID NO: 248239 - DNA, 295 bp, Homo sapiens
gggtgacagagcgagactcggtctcaaaaaaaaagccaaaaaaaataaaccagcttgcagcattcctggaaattctaactaacagatgttcttgcatattgatatgagccacctccagcagagcacaacatgaccacagtctggaacagtctttggttttcttttatgttagatgcatatctcttccattgtttgtgagtttcctgagtgtggatactatttatttctgtaaccttagcccctaacatagtgtctggcaattgtaaatacttaataaatatctaatgaatttaaa

SEQ ID NO: 248240 - DNA, 462 bp, Homo sapiens
cgcgtcgaccatttatatctttcctaatgtagcaaagtagcattaagcgtagcaatttcaagaggtaaagcagaggtgttagagaagccagatggctgccaacagaggtctagctcaatggtagtgtcctgtcccaagtctgtactcagattttcaggtctagaattggttctgtttgcacatccaaatttgactgggctgagagataacagcaaataactaaacttacaaaggattgatgtaaaaactggtatgccaattccgtagttatagtggtaaatattactatgaacagattacttataccccatattcagggacttcttttttaaagaatcttggtttttgggaagttgagtgaatttcacaaagatacctgctctatcagccgtgatgaaacagcactgtgacagagaaaacccacatagtatttcaaacagggaatttttactataaaaaaga

SEQ ID NO: 248241 - DNA, 288 bp, Homo sapiens
aagtataagttacaggatgtcaacagtcttcttattcagtaatatctatgccaacagctcaacactatgcctgtggggaacgggacgctgtctcattactgccaggtagggttgaagtccaggtctcccatgtggcctctcaacaccctctggagttttaacatctgcaggagatggtatttaaggccttaagcccatgctccacagaaaagttatgaaataaaagatgagaaaataaggacaaaacataacctattcgggatttccagaagagagaaagagaggcca

SEQ ID NO: 248242 - DNA, 345 bp, Homo sapiens
gggaaggtgaggctggcattccccccactcgccaacgatgaacttccctagctatctctctagggaaacagcttttcctcctgcccagggtggccatggctactgctcgtccctgtactcaagctgccctacagcatcactaccacctgaatccaataggacctgagcgtcgtggcagtgagctctggctctgcccagagagtagaacttcactgctttctagctatgcaaccccgggcaagttacttaagctcttcacgtttcactttcctcatctataagacagggtgatcatttatccattccaaagactattgaggattaaaagtatatgaaacattcaag

SEQ ID NO: 248243 - DNA, 221 bp, Homo sapiens
tcataaggaaataatccagcccagtattatttatagtataaaaaattagaaacaacttaatatggccagcagttggaaagattaagtaaattataataataaaatatgaaataattaaaaaggatgattttgtagatttgtagcagtacagaaaaatgcttgtaggctgggcatggtggctcacacttgtaatcccagcactttgggaggctgaggtgagc

SEQ ID NO: 248244 - DNA, 481 bp, Homo sapiens
cagaggaatattttgaaaacatccactcttgctttctccacactcccatccagtgtgcctggcttcttctgcacagtgcatattctggctctttgccagaggcctggaaaatcctgccaggcagccgttcacgcagttgcccccaggggcagtgactgaccaggagtgagacacaccactctcagcccagctgtctgctcagcgcagctcaaagcacttgtaccttgagggagagaaacccaagccacacgtcctgacagactgtcacctgagtcccttggaaaacacaatcaagagcttcctgcccactcatgtcccgagctggccgggctcagtagatgctgtgccgccagctcctggcttagccggcctccctggtgcgtctgccctcaactctttgtgcagctggagtcccagaagggagtaataattaaagaaaactttgtaaatgttcaaactgaataaaactgttgttgttgct

SEQ ID NO: 248245 - DNA, 457 bp, Homo sapiens
gtccacgcaccccctgtccagcccatctccttgaaaatcaatgagtacatccaggtacaaataaggagccaggataagatcatcttctgcttcacctatgaacagaagcagatttgtttaaacctgggcaccaggtacaagtttgtgatcccagaggtgctgagcgaaatgaagaagaaaaccatcctggaggcagaacccggcccaacagcccagaagatccgggtccttctggggaaaatgaataggctcctgaattacgcgaccacccctgatctggaaaacttcatagaggccgtcagtatatcactgatggacaacaagtacctgaagaagatgctctctaaactctggttttaaggcggggcttatctggcatccaccaaatgccttaggaagttggagaccttgggagctccagggaaaaaaaacccaaagacctgttgaccttttatga

SEQ ID NO: 248246 - DNA, 377 bp, Homo sapiens
ccaagggaaattaaaacctatgtctgtacaagcacctgtacatgaacatttatggcaacttttccgtaatcacccaaaactgaaagcaacccaaagtttcctcaactgattaataaacaaactatgctacaaccatgcaatggaacactacacaacaatgaaaaaggagcaaaccactaacacacacgacatgggtgaatgccagatgcattatgctaagtgaataatgtcagacccagaaggctacatactgtataattccatttatatgacatttttgcaaggtcaaaaatataaggatatcaaatatatcagtgtttgttgggagctggaagaactttaggggctacagaagaattccttattctgattgtggt

SEQ ID NO: 248247 - DNA, 411 bp, Homo sapiens
agcaaagattatgacttgctgaaggctcagatgactgttagcattttttagcaaaagtatttttaaattaaggtattctagggtacccgttttccccacttcctttctgtgtcttgaccaaaatcacagtgacccagccagctgtagccataggttttcctcagctggcttgaacccaaaccagcttgaacattcccaggcactgataataatgtcttggtttactggaaagaaactgaccccgaccctgagccgaattccttaaattttcatgtaaactccatcccctcaccccctggctacagactaatgtgggtaaaacatcccttttctcttgctgtccatcacaataatacattgcaacaccctgcaagttcctttaataaatgttttggactgatcactctggca

SEQ ID NO: 248248 - DNA, 1676 bp, Homo sapiens
attagcttaaatgttacggccacttaaaaattctacatatgactattgtttaaatacatttttcatgtctctgatgtagtccttatttgacataagtattttattcactgcttaattgttagatagattatagacagctgttactaagtaatactgctccattagggcagaaacagaaactttattttaattaaatgtgtactaatgtttgagtttctatattttgctacagtgataattccagtaaaataaactgtaggcctctagttgttttagaattttaaaactgtaaatggactcagagaatcagtttcttattagacgtcatgagagtatatttttttcattatgctttaagagggaatttgtaacttgctcaggtaacattcaagttttctggtttgtgtttgtccctacaattaaacacactgaactaacaggaaaaggttacatacatttaggaacaattgcacttttaaagggagagaatgcatagttgctcacatatctcagtgtcagtcacctaacatggatcagtgctttatttgagattacaaaactagaaaatgacggagtcaaggctaggaccaatattctgttcagtcttagataattatagaatacacattaaaatcagatatttgaattttcttaattttgtaactatttgtcattgaaaggagatactaaaaaaattatatatcgtcctagaaagtacatgaactaataatgcatttctaaaggtgaaaaaagaataggtatttttctgtttaatattcaattttatagagagtagtacgttaatttttttaaaccccagaagctcaggatcttatcattttaaaagaaattatcaccagttctgtgtgagtaaataaagtattataacactttgtgtttttcatccatgataccttgtatttacttacctgagctttttttctagggaaagaaaaatgctcaggtaataacagagccttgaaaaatttggattttcaaaactacctatttatgtataggcctttagatcatctgatgttgaatactctttaagtgatctaaaggcctacatataaaaaggtatttttattaaattctggaattaaacatttcagcattacaagaaaagaaagcaaatccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaa

SEQ ID NO: 248249 - DNA, 669 bp, Homo sapiens
cagaacaaaccacaccaactttcaaggactaagcaaaaaataaaccaacagattttactattagattattaatgctaataccttatatatttaaaagattactataaatttgttgataaaaatgttcatacattttatttaaaattattattttagccaccatagaaaccatgttcaaatgaattactctgggagtctatagatgcccagaacattactgcctttagcatcagtttacatgatcagaggatgttttgtaattgcaaaggtaatacatgaatacattcttaccataaaagttttactgcacagatcagtgttcctttgtccttacttccttcccaggcacagctgtcagtttgctgtgggtccttcctgacctttctctacagatcagtttgtaactcggacgtcagtctcactaattgagtcgtgcttgcctttgcaccaaaattgtatcatttggtttgatcacccatataatgaacaagacttaactctaaatggattttggctggtaccaaaaatcaaatctatccccaagagcaaaactatttgctctttgcaaaggaagatttgccattgtggagaagcttttaaaaaatttcccttgattaaaaaaacaaacaaacaaccaatcagtgcatgcttaggcttgtatcacccttt

SEQ ID NO: 248250 - DNA, 554 bp, Homo sapiens
gtatattttccagtgcctttgagtagttatttgttatattttatccagtcttattattttctgctgcagggttcttgtgaccatttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattaccca

SEQ ID NO: 248251 - DNA, 482 bp, Homo sapiens
tactttgtatagccttgttttaatgtatgatgggcatatttttgtaaataactgcagctttttgactactgcataattttccattttatagttgcattatttaacaagtccccttctgtagctcatttaaacttattgcaaatttttgctgttttaacacttgagccattatcctggtccataattgcctgaccacttaagactaatctttaaaaatagatgatattctcactcacaagtgtttgtttaaaaaatatgttcacatggacttagagagtggaataatagataatggagactcagaagtgttagggggtaacaaggtggaggaggatgagaaattggttaatgggtacgatgtacattttttaggtgatgaacaccctaaaagcttgaccactatgcaatctgtgcatgtaacagaattgcacatgtaccccataaattggtacctcctcaaaaaggtagatatgttagcacca

SEQ ID NO: 248252 - DNA, 418 bp, Homo sapiens
tccaggcctgaacaccctgtcctacctggtcctacctggatgctggcctcagtaagctcctgggctcattgaagatgaacctagcagtagtatttacaccacttgttgtgtgcccactgtgggcccggcgccatgccgagtgctctatggatgtgagagaaacggaggcccagaaagcagaaatgatgtgttaagatcactcatcaagctgatggtacagaggttagagcctctgctccctgctctacctctttcccttactccacatccatgcctgtctcttccaatgggtcggcatccaccctgacacattaaagccaaaaggaaccttaagctagggaaggggctccagaactttagtgaaagattcaaacatgtccactcaactcaatggagaaaatacaatattcaatcaaaa

SEQ ID NO: 248253 - DNA, 633 bp, Homo sapiens
actttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctga

SEQ ID NO: 248254 - DNA, 718 bp, Homo sapiens
tataagatgagtaagttctagggacctaactcacagcatggtgaagacagttaataataatgtattgcttacttgaaatttgctaagagaatagatcttacatgttctcacagcacatacacacaaacgcaaagggtaactgtgtggtgatggatatattgattaatatgattgtagtaatcattacacaatgtatatgtatatgaaagcatcatatagtacaccttgaatctacacaatttttatttgttaattgtacctcaataaagctggaaaaaagattcacattctctgagaaattttatttaatcccttcaaactgagagactgtcctctatgctgtgggtaactctattttagttcccatgtaaatgtgtttatttgtctcccctcctgatctttatctttgcatttccaacatttagcacactgccttgatgcaaagtcgaggctcagcataggagaggctcaacatagtacaggttgaaggaatggttgaattaattaactgatagcttaaagccctccacttgtattttttaaaataatattcctaaatatattttgttctcttgccagggttaaaactcatatgttacttctctacccacttgcacagactttaaggtctttttaaatcccatctgtgtgtttcttcgtcagctggaaacatttaatgtcttcttaacttggaaatctcctgtgagctttcttctgg

SEQ ID NO: 248255 - DNA, 695 bp, Homo sapiens
ggagaaagaggtgggtgaatattgaggtccacaaatcagtcaagttgaataaagaggaaattctaaggaaaatattaaaaattacagaaagaggaagctggggacactgagcataaactttgatgacatcaattttaccgtgtgcctatccactattcctccacttagtttctcagatcttgccagcaaccttagggcttgcatcctccatttctttgctcagggcatgctgaatacatgtctatgtgttttctgttttatttcctgtgtaggttttatgtgtgcacactgggaatgccctttcatctttcccatgaaccaatgtccccctccataaatactgtgggttccctttctgggcatatttcaaagatcagtgtaacaaaattattttatatgagtattaccattcccagcagagtctttaaaactagataggaaactggtgtaagtctaaaatactgtaagggccagagcttagggaaaagagcaacatatctattctatcaatctcatcttctctatactttcattgattaagagcccatgactacagcaaaaatgaaattagaggcactctacagaactcacatttcttaaagtaaatcatgccttttctgagataatttcccctctggattcttttccagtcctgtggctaccacccgtatggccaaatgtactctaatcccact

SEQ ID NO: 248256 - DNA, 639 bp, Homo sapiens
aagaggaagacaagtctcttaatagtcaacagacagcttccaaagtttgtctctctcctctaagtatcactggatcttcttttgttcacaaggatgcagaacaatgttccaagtactgttacgtttctaaactttaagattgttcatttttaagaaacaaataactataaccacataattatgtataaccaataactataaccttgataatctttcaacatactccaaaaggaaactttgagtccattttacattcagcaagttaatattaaactatgtggcacatcaaaagctttaaattaataatgtgtgttttaaatgttacaaaccgtgtcaagtgtacatctaatatatgaactaacaacttaaaatactactgttgagtcggctatgagttccttgtagttaaataagttattacaaagagtattgttataaaaggtatgtgctatgccaagcaataacaagatgtagatgtggtcacaagctagctatagtaaaatgaaaagaaaaaaactctgcttgagacctcttttgtgtcatgatttaccataattttgaagcaaagtgtttacagctgctattaaaattaaaattgaaggggagaaacaaagcaccctgaaatttgaatgaaaatta

SEQ ID NO: 248257 - DNA, 558 bp, Homo sapiens
ctcagaagcctcaggtatatattttcctcaacctttttaagtagagtttgaagttttatttgtagctttctccttttattttatcttttttttatgttttcacttaccttcaggctggatatgaggaatgcctgaagcaagtagttctccaagatacctggcaaaaatcacactatgaaaaatctctcaatttacttaagtatatacgacagcagttatattctaaaacttgatgcatgtccataggccatctcaagttcacattactgcagttccaggcttctctgggggaatcccaagagagttcattatgagtattgttttgttgttttcttgctaaaaaggccctccttggctgggcatggtggctgagacctgtaataccagcactttgggaggcctaggtgggcggatcactggaggtcaggagttgaccagcttggccaacatggtgaaaccccgtctctactaaaaaatacaaaaattagctggacggtagtgcacacctctagtcccagctacttgggagggtgaggcatgagaattgcttgaacctgg

SEQ ID NO: 248258 - DNA, 437 bp, Homo sapiens
caaacaaggaagttacagaatagatgggaagtgggacaaatcaatcattcaactcatgaggaggaggagttgccatgggaactgttctttcaattctcttaagagtaaggacaaggtccctgacatagaatgggactagggatatcagacagctttttgattgatttccttcccagactttatttcatgaaatctttacccctgccatccttcattcatatagttcagtcagtaggatgctgggggcttttattaaaagagaattccagtcctacatcctcagtcaatttaactagagttagaaacttagtacaagctggcctagtcatattggctatttggtaattggacctgagtgggattattttctcttttcaggaacctgcatatccaacgtgtaaaatagggactatgtgtgggcatacactatgcagtat

SEQ ID NO: 248259 - DNA, 428 bp, Homo sapiens
tctggagatgttaatttaatccaggcattctgatcccagaactcaggctcttaaacataacactataaaaagcccaaaatagaaagagatgtgtgtaaaaaaccttttgaacttagaaagcagggtcaatatacctgatcataaagaaagtttatcttgcagaaaacagaaataatgaacagaagcaatgccatttagaatgccttatataacaatgctaggttaaagttagcaatttttctgtatgaataatcaattgatccagcataatttatgaaaaagaccatcctactccattgcactgtgctggagcctttgtcactatttaagcgactgtgtaggtgtggataagtttctggactctttttctgttccattgttttatttaaccatcattaaaccaaatcatattgtcttgattactgaaa

SEQ ID NO: 248260 - DNA, 500 bp, Homo sapiens
aacattatagatatgtggaaatggctgtttgattataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagcctggccaacatagggaaaccccatctctactaaaaatacaaaaaattagctgggtgtggtggcgggtgcctgtaatcctagatacccaggaggctgaggcccgagaatcgcttgaagccaggaggcagtagttgcagtgagcagagatcacaccactgcactccagcccgggtgacaatgcgagactccatctg

SEQ ID NO: 248261 - DNA, 563 bp, Homo sapiens
gagctttccagcaaaaaccggaaagcctgctagacaaattctaaaagagctgtaacactgtaggttttcctagcactgaatttattgaaattgcaatcccttccccatttatttgtgattccaattttgatatataaatataaatagatatattttgaggtgaatttgttcagaaaattctataatctgatttgctggttgtaattatgtatgtgtgtgtgtgtgtttgcacaccatttttgaaaaacttgtttattcctgccaggaccaaagaagacatttggccttaaagatttaacacagggtcatcaggacttactcaccacttcccacataaaagtgaattgttgtagaaacagtaatagtaaaatatcgttttcattacattcctatagtacatagcagctcacaagcacttttatattcagcatattccagcctgggcacaatggctcacgcctataatcccagcactttgggaggctgaggccagaggatcagcctggccttgctatgtcgaccaacctgggcaacatagcaagacctctgtctctacaaaaaaa

SEQ ID NO: 248262 - DNA, 428 bp, Homo sapiens
ctgccagaatgagagaccccttgattttcttcctgtggagaatgttccatagtggaagagtagttcctcatgcaaatccaggctgtgctgtttaccaggagaagggacagtgggcctgggcagacaaaagcaggacatgtcccctgccccgtaagaagctcttattcatgtgaagagaaagaacattcagaacagctcgtgaggcatctgttcaagcctcccagggactcactgggtaggatgtacaggagagctgtgtcaactttgtgactccaaggagtggggccagtactggtgagaacttgggagtggaggattcagagggacagttgttgccccagcagacaagggctttaaaacaaagggctttctggcactggctcccctgtctcaagagagtgggtgttctccatagctgagaagggagc

SEQ ID NO: 248263 - DNA, 257 bp, Homo sapiens
tgaaagcaaataaagctattttgacaataagtagctgatagattttatcaacaacatactgggactgaaagaaatggtagacaaaaagaaagtaacaggatgataatgtactttttttattattatactttaagttttagggtacatgtgcacaacgtgcaagtttgttacatatgtatatatgtgccatgttggtgtgctgcacccattaactcgtcatttaacattaggtatatctcctaatgctatccctcccc

SEQ ID NO: 248264 - DNA, 378 bp, Homo sapiens
agcatggccttttaaagcctataaactctccttacaattctcccattttacctgtcctaaaaccagacaagccttacaagttagttccggatctgtgccttatcaaccaaattgttttgcctatccaccctatggtgccaaacccatatcctctcctatcctcaatacctgcctctataacccattattctgttctggataacaaacatgctttctttactattcctttgcacccttcatcccagcctctctccactttcacttggactgaccgtgacacccatcaagctcagcaaattacctaggctgtactgctgcaaagcttcacagacagcccccattacttccatcaagcccaaatttcttcctcatctgtta

SEQ ID NO: 248265 - DNA, 520 bp, Homo sapiens
cagaaatcacccgtcttctgcgtcgctcacgctgggagctgtagaccggagctgttcctattcggccatcttggctcctccccccgaattcaaagttttaacactgggatgtttgggagcattgagctaagtaggggagtggaatatgatatgcttgtgacattgtaatatgctatagattaaatgagtttttatttcacttagaggtaaatagtactagtttaactatgtaaattaagctttagtactgttgctcttgcatgatttattttcattaaaataactgtaagagatgaaaaagtattttcttttaaaataagatttcaagtataagagataatttctcaactttcatattattggaacaattaatttgatgtaggttttattcatactttgtttcttcagagatgtctgtagtgggagtattttcccaacgctttactatataaaagtccagcatgttgatgttgctcctgaccattcaactaaagtaatggaattcaaacagagaatctta

SEQ ID NO: 248266 - DNA, 216 bp, Homo sapiens
ggtggacaggcaaatgcttatctgtgtttatgggtgtgagtgtatgtgtagtgttttaatgagagaaaagaaataatgaaattttgaaagcttgaaatttgattttcatggcaatgtgaatgtatatacgacagttttctaaatctgtaagggcaccagtgtgattgcagattggttgttacctgagagattaaaaccgtcataagaacaaattta

SEQ ID NO: 248267 - DNA, 178 bp, Homo sapiens
agggtgaacaaggattgtcaggatgtgactatggaagccaggaacttgaatgacatgtgatttatatgatgtatttatttctcccccactaccattccttgagtatactgttttttccaccttcaatctgaagaattatagaaataaaaaaagtcaagataatcattaatgaaaaggg

SEQ ID NO: 248268 - DNA, 455 bp, Homo sapiens
tatttacattttgcccaggagagaattgaaagggaacagttcagagtttcccaaaatcaaattaccaaagatttgagccccaatactcatacctgaaactacagcatgttgttaccaggaactggcttatatcttgaagttgccaatttcactacaacagaagatttgaggaagccccttgcctgcctccatcctactcatacccagagcataaaaaacaatagaaacatattgtgcatggagttgtgctatcacccaatagctttgcgtaccacagggcttggacacataagtaagtgtacgttgaatgaaaccatccccccctatcttttgacaagactaacatttgatccccattttacagaacaggtaagtaagactccagcagagaagataacatatccgagatcacaaaccctgtaagagacagagctagaatgagggggagctcagga

SEQ ID NO: 248269 - DNA, 305 bp, Homo sapiens
gttaacaatactgaactgtatacttaaacttgattaagatggtaaattttatatgtgcattgtacaacatttaaaaagagagagagagaaagagatgtgcatggggctttttctgataacagcattattagcttggcctagatgtgagaaggcagtctgatagaacaggctggtttcctcattcaaggaaatattgtttctcacgcctgtaatcccagcactttgggaggccgaggcgggtggatcacgaggtcagaagatcgagaccatcctggctaacgcagtgaaaccctgtctctactaaa

SEQ ID NO: 248270 - DNA, 674 bp, Homo sapiens
  misc_feature (393)..(393): n is a, c, g, or t
  misc_feature (395)..(395): n is a, c, g, or t
  misc_feature (416)..(416): n is a, c, g, or t
  misc_feature (431)..(432): n is a, c, g, or t
  misc_feature (441)..(441): n is a, c, g, or t
  misc_feature (474)..(474): n is a, c, g, or t
  misc_feature (482)..(482): n is a, c, g, or t
  misc_feature (494)..(494): n is a, c, g, or t
  misc_feature (524)..(525): n is a, c, g, or t
  misc_feature (539)..(539): n is a, c, g, or t
  misc_feature (560)..(560): n is a, c, g, or t
  misc_feature (584)..(584): n is a, c, g, or t
  misc_feature (586)..(586): n is a, c, g, or t
  misc_feature (611)..(611): n is a, c, g, or t
agaacttgttcttgaccttcaatttatttagtgaactttctaaccgcagagactaggacacaaattacgtctcaaggtaacagtgcaagttagagtacggtattcagagaaaagagaaaggctgaatcccaaatgtttaactatgcaaaacccaggggtgtctggggcctcggacctctgcagaccccagcacggcacagaaaggaaaccagtatttgcaccgtggcaaccgcgaaccaggtctttcaaacgcccgactgcatgtgagcctcacattcttgctcgtgccgaattcggcacgagggacatatgctatcacatagagttgggatacgtttaactttattaggaagagccagttttcccaattggttttaccattttaacactctnantagcaacatgtgagggtctanatgttccatgtgctnnccagcactncaaattgtcagtccactactgggtagtggtctntcacttgngcccccctttgnttttaaagaagctgtgccaatctttgcatnngtgttgtaaaggcntggtaggccttctaaattcanatcttgtgattaacatttcccagncntttctaatgaccccgtgcctttganaaaactgtagctttttctaatgtaaagggttttaagctgtatttcaaggggacattacttgtg

SEQ ID NO: 248271 - DNA, 326 bp, Homo sapiens
actctttctcttatcaaaggccagactaaccttcaaagccaagtggcttggctgaggttcctaatggagatgaagggggtctcaacttttagaacatatttgactcattcatgtgtgactatacttgataaatgcatgtcagctatctggcttcaaactggagcttctacaaactctactgcccaacaaaagcttacatctcacatctttcagcctatacccacacatctatttcctgcggtgtgccctgaagttggaacagtagagtaggcattcctcatgcatactagatctagctctattattttacttagttctatgtagtc

SEQ ID NO: 248272 - DNA, 598 bp, Homo sapiens
atttgagatacaaggtaagccatataaatgctggttaactctcccattcatttggggagctccctcaagagaaatatggtactacagttgatggctatgtagatccaagaattaggtccctgtaacccctgtataagtgagaagctacattatccattaatttattatttttttgaaaaaacagaactgaagttaaatagcagcatatctattcccttatgatttctactaacacatgattcaccaacatgagatatgtaaataaaaaccattataaaaaagaagcatcttactcactaaacttaacttcttcaaagaaggcttaattaagaaaaaagttaacttacctttaggctgtcccagtatatttcctaaatgacaactacctgagttggcaacttatgaagtaaaattattacttttctctttgacatcattcatttttcctttgaacttattctactgaagtcgcttcatatgcatggaccatacttagttaataaaattgagagtctttccccatggtgttctctattttctaatgaatgaaatctctaaaacagatgcacaatgccagactcacttattgaattcctct

SEQ ID NO: 248273 - DNA, 412 bp, Homo sapiens
aaaaaaaaaaaggtatttgagttctttcctcaatccatatacatctaaaataaagttatagcatataggcaactttacattctagtcttccttgaaacagtgtcataagtatttttcactgttagcatgtgtttgctcattggtttagcaaacatttgttgctgctgtgagctaatcctgctgggtctgaggataaaagggtgaaagaccattctggtcctcctggagctcactagtaggagagacataagttgacagtgacagctcagtatgatagggcaagaagagaaggggatgaggctgggtgtggtggctcatccctgtaatcctagcactttgggaggccgaggcagattacttgaggccagcagttcaagaaagcctgtgcaacacagagaccccgtgtctatta

SEQ ID NO: 248274 - DNA, 450 bp, Homo sapiens
actacgttggaattacaagtaggacaacaaagatgactattaaagaaagcctcctgagtgctggaacacagcaggcatgggtctgtccactcactgtaatgtgatttgcacaggaaaacatcacatagggcacatcaactcaggaaagatagtcgttgaaaagctacctcagctgggcgtagtggtcacgcctgtaatcccagaactttgtaaggctgtgaggcttgtggatcccttgagaccaagagtacgagaccaacctgagcaaaacagggagaccccgcctatgcaaaaaatacaaaaattagccaggcgtggtggtgcactcctgttgactcagctattcaggaagctgaggcagaaggaccacaagaagtcaaggccgcagtggggtataatcacatcactgcactccaccatgggtgacagaggtgagaccctgttgcaaaa

SEQ ID NO: 248275 - DNA, 593 bp, Homo sapiens
tctttaaagacaagcaaatcatgattggaggtaaaatatgcccagaaaaaaagaaaaatggaagaaaaataaagacaggtaaatgaaaatgactcggtccagagatgcatatatccttactgtgtggcaaatataaaaatgcttgatctcctcttaccaaaaacacagacttaaatctatacctgtgaataaaagcatagaacccatgtaatagctacagtgtcatgttttgtattcagaaaaggtttataacagtgtttctcgggacccaggaaagaagagaaagctatgttattagaagtcactatgtacactattatctccagctgaatgtaaactgtgctcttgatgggaatagctaaagaaacatcaaatttaaagaaggagtcattagataatttttccatttcaaacagtgctttctgtgcttgctggttttgaccttcttctattccttcagaggccatctccccctctctctggaagagactgtaaataactaattattttagaacaagaaagaggcttgattcccttagctaatgtaatatgcatactagtctgtatgaacgctagaaatcatttctttcaaa

SEQ ID NO: 248276 - DNA, 355 bp, Homo sapiens
  misc_feature (212)..(213): n is a, c, g, or t
atttaagtaaatgtctggaaaccttgactgatacctttttcttaaagatatactgcctactcagattctggaagttgtttgtttgtttgttttgagacggagtctcactctgtcgcccaggctggagtgcagtggtgtgatctcagctcactgtaacctccacctcccaggttcaagccattctcctgtctctactaaaaatacaaaattannggccgtgttgcacatgcctgtaattccagctactagggaggctgaggcaggagaatcgcaggcggaggttgcagtgagccgaggatttgccattgcactccagcctgggcaacaagagcaaagatccgtctcaaaaaaaaaa

SEQ ID NO: 248277 - DNA, 426 bp, Homo sapiens
gggacacaactttattgttgtccttatcactctactctaacatttaatgacagtttaatactgctttctatgtgccaggcacagtggtagattctaaaaatctaactgcaaataaaacttgaagacagtggtatctcgtagaacattctgtgaggatggaaatgtcctatatctgcattacccagtatgatagctgctacccatagatggctattgagcacttgaaatgtggctagtgcaacagaggaaccaaatgtgtaattttattacttcatatgtacatgtaaatagctacatgtggctactgattactgtattgaacagcacagctctaaaacgtaagtctgatgaggacagagatccgtgtcttttgtttatcactctactcccagggccaagaacagtgcctgccatatggcatgaatg

SEQ ID NO: 248278 - DNA, 182 bp, Homo sapiens
ctttgcttaattcaggcaattaagataaaaatatcaaggtaatgttttgcaataaaacctgggtgttagcatacatagttcctttttaaatctaagccttatgatgataggtatgcaataacttaccatcttaattaaggtgctagaattagatcttacatagacttagatttaagtcgagc

SEQ ID NO: 248279 - DNA, 457 bp, Homo sapiens
caagcgtgagccaccatgcccagtactgtctggtttcttaataacattgttgagccattgcaatagccttgggatattgctctttgtactttttcttatgcaagaaaaacagattcacaagttatttgatgactctcttcccatcaaaaggaaaagtctaattctttttcccttgattatggatcagcttgagcttgttgcttctaacaaatggaagagagcaacatgctggagtgatcacatggaggaagcacaaagggatacatgcccaaggggccccagctgttccagcccctagacatttgaatctactcaggcaccaagtaagcaggtgaatagccttcaggtgattgcggcccactcccagctgaagccaagtggagcgcagatgagcttcccctgctgagccctgcccaaattgcagatttggaagcaaaatgaatattgttttaagcca

SEQ ID NO: 248280 - DNA, 1076 bp, Homo sapiens
cgcccggtatggggaaagtttaaggcggaagagccctcgtttgtcggctgcttgggaagtctgaggattactgggactaacaggacttcagctggggcttcaacgtgtggtgtgggcttcctgacaccacggccactggtttccaagagtttcaacaatattttcatcatatttattgaaggcctcactgacagacttctcaaggcccctctaccttctattcgctgcctggccccaaagccagtgccacacattttaggtttttaactgcagcagcacctatgatgtttccaaaatctgtatcattaaagtttgatcagagaagcaaaaccaccttgagcaaaacaaggaatttattaaagagattaggatacacattgttatgaaagctgcaacctgctgcccctgtgtccagaagtgggcctgaagtcagcagggctggcaaatggatgtgcagtgggagagagtaggcgtgagctgcacctgcagggaggagatggaactcctgtggatggactgaaactgatgtcttccacgtcagcctctcaggcctccaacactccagcgctgatgatgaagatgacctgcagaggagctggtgcccttcaccatggaattgctcataaacccaagattcagtgaagctgaagaagcagttctggtgggagctggaggaactgcaggcacagctgctgccctgtaccaatacattgagccagtggctgcctggcattgtgtgtgagccaccacagcgcctggccctacacagactttgactgtaaatatgactgctgtttcacttctgccttccaaattttgctcagattttctgagaaacatagttcagcttaggtacattgacacagtacaaagccaccgcagtggctggttagggagggattatgaatgcaggctgagaatgcacgggaagcgtttgtctatttatagagtaggtaccattcaaggatttatgtgaatcaggtgcaaagaactcacacaaagatggggaaagttagtacttagaaatcagtgatactagataaccaataaataaaaataaacttatttttagaaaa

SEQ ID NO: 248281 - DNA, 390 bp, Homo sapiens
tggaaactattttaaaaatttaaacctgaaatacagtacctagaatctgtaactcattggatagacagtataaaacagaattagttaacttaaattcaggtcaacaggccaggcgcagtggctcctgcatgtaatcccagcactttgggagtcagaggcgggtggatcacctgaggtcaggagtttgagaacagcctgaccaacatggtgaaaccctgtctctactaaaaatacaaaaaaaactagccgagtgtggtggcacatgcctgtaatcccagctacttgggaggctgcagtagcagaatggattaaacacaggaggcagagttgcagtgagccaagatcacgtcattgcactccagcctgggcaacaagagcaaactccgtctc

SEQ ID NO: 248282 - DNA, 1028 bp, Homo sapiens
aacaaaggggtagtcaagactgaggaggaccagcttttgaggacaatcactgcgtgttgctccagctcacataaaggcacggctcctaaggaacaggcttgagacatgcacaagtgctgtgccaagtagttcaggagcctggtacagctgttcccaatatgcctttacctcctgttgcctcttctaaccacaatagggtgtggatgacatagtgcccttgctcccagaagaaactgggaaagttacaactcattaaccagttaggttagtgttggaacagtgcttgccacattattctgagaagcctcagatccgtgagggtgatgtggagctcagaacacatggcctgaccccatgtggggttttactggagcagttgttttgatctgtcttacatctgggggatctgcaagagatttcgagggatgagggccagttcccttgctaaaacttagaatgtttaaaaaaaaaaaaaactcccttgtactattgagcttggtacatctttccttgaaaggagctaaagtgaaataacttatagatcctgacatgcaatgagctgggtttttttccaattttctttgcttcttgtctctgaacatatgcctccttataattcttcctatatgtgtttgatagcattgttctctgagtaatagtaaccatgagaagaatatctaacatttattccatgcctattgtgtgccatgccacatgctgggcactttatgtgcccttatcctaccggaccccgctgcagccctgtgagtggatggtccctctcttcagctctcaggtgacacaaaaacaacaacaacaacatccgcaacagcaacttcttcagttcatttagttggtaaattctggactcagaactgcaagctaggcagtaactcagaggttgagttgacttgatgtataatgtcacctttaatgtctactgaacaagagatgtgtgtgtataagtaagacgtaaattattttttcatcttgaaaaggaatgtgctcaatagagaaaatctgaagtt

SEQ ID NO: 248283 - DNA, 400 bp, Homo sapiens
aacattttctttatgctgtatgatcataattagtttataatcttactcattggggtggctctgaaataggaagcaagtaagtaagtatccatcttctaggggaacaggtgagtgatgaaaatagaatcacatcagagttggctggcgcgttggctcacgcccagtcaaatggtgatttttctagctacatcatttcttctgcgtttatcagttggcattctactttaagaaaagctgtcacttctcccccttatgtctatgtcagcatggactcatggatttttatattttatgcagtagaatcacttgaacccgggaggcagaggttgcagtgagctgagatcaaaccactgcactccagcctggacaactgagtgagactccgtctccaaaaaaagca

SEQ ID NO: 248284 - DNA, 782 bp, Homo sapiens
gatatacctctagctagactaataaaaaaagagagaagttccaaataaatacaatcagaaatgacaaagggaatattaccaccaactccacagaaatacaaactctcagaaactgctgtgaacacctctatgcactcaagctagaaaacctaaaagaaatgatacattcctggaaatatacaacctcccaagattgaaccaggaagaaactgaatccctgaacagagaatatctcttgtaaagatgtcttcaaaatctcaaactccagtgctccttcttttaagaactccaggcgtgtcttaccagtaatgtccccctggagatgatactgacattttgaaaaacattcctcaaacagaaatcaccatcttcctctttcaaatcctgttcctctctagcctgtgctctccatatgctcatccattactgaagctagaaactgaataattgtcattgattcatatttagtacctgttggctttgcttcttaagataaattccaaatggggttgctgaattatttttttaactttttattttcaaataacttcaaacttacagaaaattggcaaaaatgtactaatgtttttgtataggtccttcacccaaattggttaccaaattttaacattttctcatatttgctttgctttagcattctctctatatacacatgtgtataaatatatagtgtatatatgtacatatacacacaaacacacacacatagacaccaaccaagaccgaccaattatataaatatatgcattttatatataata

SEQ ID NO: 248285 - DNA, 361 bp, Homo sapiens
cagtgaggggcttagcacctgggccagcagctgctgtgctcaatttctcgctgggccttagctgccttcttgcggggcagggctcgtgacctgcagcgcgccatgcctgagcctcctccccactccgtgggctcctgtgtcgcccgagcttccccgacgagcgcggcccctgctccatggtgcccagtcccattgaccacccaagggctgaggagtgcgggcgcaccgcgcgggactggcaggcagctccacctgcagccccggtctcaactgcagtgctacatcatcatgaggccttccatgaccactgacccttgctctcttcaaaactattattaaagtttgcaactgcttatttatc

SEQ ID NO: 248286 - DNA, 446 bp, Homo sapiens
agcccttgtccagctgtagcccggggacgctgcagcctgagcaggactgcacctgttccctcccaggagcctcatctctgtccggcctggctttggcttcagatgccctcagctttggcttcgaaatctgttgggtcagattcacgagagctctggccttctttgggttgggaattttaaatagttttttcaagcaggcagtagatcaactctacttgcttacttctgggtgcatctcctgttccccggccccagatcttctttttccttggtttatcctctcattgtgttgcagcacatcttccagtggcttccagagaaacagtgaatggaagccaagctttctgaccctcacatattttagaatgtcattgttctaccccaattcctgattactagtttggctggatgtaatgctctaatttaaacataacttctcttcacat

SEQ ID NO: 248287 - DNA, 523 bp, Homo sapiens
tagtctcaacatgcaggctccacccttagaactcatctacacctaatcgcctaccaaaggcctcctctccaaaaaccatcacattggaggttaggacttcaacatataaatttaggggagaggaatacaatttagtccctagcagtcaccatataacatttctaaattcttaacatacacggagggaaatgttgccacaagaaacaatgtaaaataatgtaagagcactggaaccacactgtctgggtttgaattgcagttccgtctctcactaactccaagactccattccttatgtgctgctatggcctgaatgtttgtgttccccaaaattcatctgttgaaacctagcccccaaggtcctgatattaggaggtggagcctttgacaggccattaggttatgagggtgtgctgagccctcatgaatggtattagtacccttataaaagaggcaccagcccagacatggtggctcatgcctataattccaacacttcgggaggccaaggcaggtggatcac

SEQ ID NO: 248288 - DNA, 583 bp, Homo sapiens
tcattattacaaattaattccaaatgaatatgtttgaacagggcattggttttgaatctttaatttatctcctccttagccttgctgctgacaaatcataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagtttcttcctctgtcatttgtaggatctactgttattctctggagagctattgtgtcagaacggatttggattattttttaaaactactgctacctagagggtaattttattaaattcctttatcatttggattaaatacagcaaaatgaaaccagctcctcctgctcagaggagctgtcaccacaatctttaatattttcttagcattatttcctttaaagtatgctttgggacaattaataatgactaatacttaaattttcactatgagtaaaagctttttggtaaacatttattatatattccatgtcttcctttt

SEQ ID NO: 248289 - DNA, 494 bp, Homo sapiens
tcaatatgtctagacaatgtggttcatctgtgaggttttcaaattgtcacaaatcttcccccaaatttctaacatatttattgaaaaaaatccacctacaataaactaatgttattcaagagttaactgtatatactctttggaatgtcatatgaattttgaatggcagaagaactggagccagggagccattttaggaaacgactaacagtctgagtggggatatgggctgccctttaaagtgacaaccatataatttacctctgggaatgttctaaactgttcaatattcctaccttggatatcaagactgataattcttacatttctctgactgcttagatatggcaataaacaccaacctcaaagtttattttgccttttaagttcccaagtcatatcatcagttaattcttcactgtatccttgtactgaaaacatattaagatttattataatagacaaaataaataatgttacatcaccttctttta

SEQ ID NO: 248290 - DNA, 403 bp, Homo sapiens
gcttgctcaattctgtttggcaacataatttcacaaagcctctgactctgacgtctctggaaagatcctttgaagacaaaacaggatagggcacacagtcctctatgtctcttgcctgagtcgctatattccttaaaagataaatgggctgggcgcagtggctcataaacctaatcccaactgctgggattacaggcgtgagccactgcgccgggcccacaacttttctttagtaaacgtgcctaaaacttggaaacaatcttttctgaagtgactcttctgttctttggtctttgaaaaagtctcttcttgcctacttaggttaatgtaataccgtatatatacttgcctacttaggtaatgtaataccgtatatataatataaaacattttcagactttgt

SEQ ID NO: 248291 - DNA, 253 bp, Homo sapiens
ttccttttctagtttgttccagatgaattggtaaaaacacagtaagaagcgtaaggcacagctgcaaaagggttgattgcaaatggaggtacagtttctgcctaaaaccagactgtgactatggaaagctcagaaaccagcaggcaaagagcctgagggcccaaagcaggccagcaatacccaagtcccaagggtcagtatattggaggaaagtaaaggagtgaatcagactgcagaccaagtggaagaggca

SEQ ID NO: 248292 - DNA, 480 bp, Homo sapiens
aggggcctgcctcattacgagctgcacaggagggctgagcttgcattagcagcttctccctccagtgcaggagaacgcattaagatttacggttcatctgaaagtagcttagaaagaaaccatatgctcttatcatctcttgcagaagttgcagacaagttatttaaaaatctcgttttcttaaactgtctttattgcaaagaaaagagcctctgggatccacttcaagtagtcattgtggagggtacagcaagccagccctgggctaagcatttaccccactaattcaccaccacagcaaggtggagatccttgagtttttgcctgtgtttcacaaatgaggaatccgaggagcagagacctgaagtgacctgtccaggacacaagagtgaacccggggacaaagccaacccgctctgctggggctagtgcctttccacactcctctgtttctatatttaaaccgagtgaaaggagaca

SEQ ID NO: 248293 - DNA, 723 bp, Homo sapiens
gactcacacatagatattctgagattgaaattgtttgctctttgtgttacttcatgttcctttggtttaagccagggtgtattatgtgaagtcaatcatggttatacttatctttcatcattagtatccctcatcatccgtgaagtggctttcatcttgtaggtcaaatattgggaggtatttccagttaaaaattaaaaagtcaagaagtctaaaagtacaatctctgagctttggccgtttggatgtgacacacagcccagtctcatcaaaattaaatgagaacaaagtgagcaatgtatcaagtaggaatgcatttggctgtaagtaatagaaaaatagaacaatctggtcagagtagcttaaccaaataagaatatattatttttttcataacaagaagtttagaggtgggcagtccatggtagggaataaccccacatgcatcagagtccgtgctactcaaatccttccactccgccatccttagcatgggacttctgccttcaggtttgctgcctaatgattgtaaattgggttttccatctttagctccatatccacattccatactggtagaatatgggcccaatctgtttgcctttgagtctttcttcttgtttggaaagggatgttctctctgaagacttccttgtgtcaattggccagggctggctctcaggaccaccctaactacaaggttactgctagggggtgatattt

SEQ ID NO: 248294 - DNA, 156 bp, Homo sapiens
cctctgaagcatcacttttatctgacctgggtatgtttgtctatttatttgttacacgtgctacatggggaaagcgtcttagtttaatagttttaattgtatcaaggatgtgcttagatacaggctttcaagcctgcagttaaaataacacttgta

SEQ ID NO: 248295 - DNA, 695 bp, Homo sapiens
gttaagatgagacagactgttttgagctcagttatttcttgttcagatccttcagatagaatataatagatgatgtccttacggtaagagaacattggcagggcaccttgcaactaaaggatcattttgaacccggcttgaagagaagcagatcaattccatcagacctcatcctagaaagcaagccagaatatgactcaagtaatttagttatagttctatctgatattcttctaagatttctcatacaaggttcaaaatcatttagcttttctaggttctgacctagagaattgaattagaaagttcttaaataaatcttcctacttccatgttctttcatagtatgggtcacttaggagaactctcagccatatatgtcagaagccatgattttcatctcccttaggccctgagcaacttcatgaggagtcagaattattctagaaatgagatagctctgtatcaatttcccccagttgtttttgaagataatactcatctttctactgtgaagaaggaaggaccaggcataggatttactttcattcacttttttactcattcattcatttactcatttcttaagtgtactttggcaggggctgacaaaatatagagctgtgctattcagtatagtaaccatagttgctagccacatggggctactgagcactggaaatgtggctagtctg

SEQ ID NO: 248296 - DNA, 688 bp, Homo sapiens
gcttctttgagttcaccaaacagcacatttaggaaactttggttcatttttcaaatgcaaacattctgaagcctgaacttctggttcaagtgttctaacttggcttcaaggtcagaacacaaattgaaggatagatcccagaccattttagaatcatgatggcaacgcatatgccatttgtattgaactaactgaccaatgtgctgagcagagacgatgcaaaggagaataatgagaaacaggccactttagcacatgaaaatcatccatttaaaaaacttctgagccaggtgcggtggctcacgcctgtaatcccagcactttgggaggctgaggtgggcagatcacttgaggtcaggagttcgaagcctggtcaacatggtgaaaccccatctctactaaagatacaaaaaattagccaggcatagtggcaggcacctgtaatcccagctacttgggaggcaaaggcaggagaattgcttgaacccaggacgcggaggctgtagtgaccaagaccgcgctattgcactccagcctgagaaacaggagtgaaactcagtctcaattcaagacccacagcatggaagattagattaccaactcccagatcaaaggaatgtagagacaaggaatgactcttctccaaagcacctgaatttatgatatcctggacatagtctcatagtat

SEQ ID NO: 248297 - DNA, 536 bp, Homo sapiens
atgcatttcccaggagttaaagaagaactcataatggaaattccaaatttgtaataaatgtatatcaaaattgtaattataggaagaattacatgtcagaagtgtgggttgcaaataaagggagatgcaaagggacagttaaagcttcatatgcattaatggaaaaaatgtcaagaaagagtgacaaattgagcgttcaactcaagaagttagaaaaagtacaaaataaagctcaagaaaatggaagtaataatagcacaacttagtgaaataaaacaaactaaaacatatcagcaaaactgaaagtgtttctttgaaaagaaaatgttataaaaagaaatccagagcttgtgcaaggaaaatgaaaagataccagcaaacaatattaacagtaaaaattgacatagagatatttcaaatgattaagaggatattatgaacaactacgaataaattttgaagcctaataaaatgggaattgtttagaaaattttaatgaccgaaatagactctcaaaaaaaaaaaaaaaatagaaa

SEQ ID NO: 248298 - DNA, 444 bp, Homo sapiens
gagaaataaatcggagaatatgctgaaatttatttaattaaggtagtgcaggggctggttccatattaaacatggtgatggggatttaagataataatgctaccatcagtacatctaaaattgtttaatgttttactgcaaatattttttagctagaagaaattaaacaagtggggaagattctcagaaaccaacacagcccaaaatgtgcagataaagaaccaaaaaataacgtagaaaggagcaagattataataaatatttttaatgagttaatttatttcctctttttaagtcttaacttgtaacattatttgaaatcacagtaaatgtacattttatttcttgtttcagccctgaggtgagtttatttggaatgtttgttttaaatggatttagccatcatggaattaggtcatcttggaaaaatgtgttttttctaaa

SEQ ID NO: 248299 - DNA, 190 bp, Homo sapiens
gtaattttcatcccccatcttctgtcccaacactgaaaatagtaatgagtcatctccaaaactgacccagccttctgaaatccaggaccacaggaagatgttcttttgtatctcttctaaagtaatttcgattttgttctttttgtcttactgctgttagttaagtaaatacgcaatgactcaaatagaa

SEQ ID NO: 248300 - DNA, 871 bp, Homo sapiens
ccacgctcggccgacacaattattttaaaagggcaaatgaaaagaacacagaaaaggacataaaaatagcctttaaatatacaaaagatgttcaactgattagaaaaacgcaaactaaaatgacagagaaaccgtttacctatctggttgtgaaaatgtcaactgctggaccagcctctactgagaggtggggtgggaaacaaaccaccctgaacgtggccctctgagatgcagggaggaagggctcctacagcgttaacctggcaacatcctccaagaggccaaaggcacacgacgtgtgaccaagcaatcccaatgggaacggaccctgcagaagacggatctcccatgcccaaagggactcatgcacgtgaaattcacagctgaagcagcccggaggagtcggcaggggaccccgcaaagtgggtacatctgtgcagtggaacaccgtgcagccaaaaaaaagggcatgagaacacctccagggtttactattcaagagaacaagatacagcaaggtatgtattgcatgctattatctcctctgttataataagaattgaaattcctatttgcttatattgtaaaaaggagcacaagaaactagcggtccatctgagggcatgggagatgggagagatggggcaagagtttactctgtatgttgttttaattttcgaacacgtgaatgtactgtccgaaaatgaaatgccatgtctatctctgtgtgtgtgtatttatcttaagagcagagcacacactaagttagaaaaggccaaaatcctattcacgtgatcgcttgtgttttccaaggtcgaattcccaccccatctccatattaaaatctctcgatgtttctctaccaaagttc

SEQ ID NO: 248301 - DNA, 767 bp, Homo sapiens
gggctctggaataggatgtaagagtggaaaactagatatgaatagagggatctgaaacgtagggtttgggtacaattatgtcacgtttaatttgccaaagagatctggtttttcctactaagtaaatttcaccaaatgaacagtttggacagccatcttatccaaactattcaaatgcacatgtaaatctaggatagtctatcgtggaacctaaggtatgttcaggctcaggatgtcagatttccaagttgctaaagcttccagaatggcaaaataatatatctcgctttcagcagctgtggcagccactgccctctcatattaggtttgtctctctgttaaattaagttgcctgtcttgcttcccttcattaaagggttttcagttacttggaatgctgctgacccagctgatatggccccgcttctaagccataagtctggctgcgcctcatgccaagcatgcggatgcatttagagagcacctagaggatcccagccctgcaaatgcccagacacctgcaggaaatagaaatgtagttctgggggtgagggcagctacagccataaaaagggcatttaggttgagaaaagagggatgtgggcagtaaattagactctaatagtaaagagtctagtaaatagtaaatagactctaatataaatgtggctctaaatcagaaagtttctcctctcttctctggctcaaagtagatgttctatagctttagctcatggaatagcgtaagcatggagatccagtgagtg

SEQ ID NO: 248302 - DNA, 500 bp, Homo sapiens
gaggccgagatgggtagatcacttgaggctaggagtttgagaccagcctgggcaacatggcaaaaccctgtctctacaaaaaatacaagccaggcatgatgctatgcccctgtagtgtctgctactcaggaggctgaggcagaggttacagtgcgcaatgaccattccactgtactacagcctgggaaacagagtgagacaaagaaagaaaagaaaaagaaagaaagaaaagaaaaagaaagaaagaaagaaaaagaaagaaagaaacagaaggaaaagaaaaaggggaaggggaagcaaaaagaaaagagagaaaagaaaagaaacaaggaaaggaggggagggcagggcaggactgcttaggagatgggtgcaccaaaatctcactaattaccactaaataaattattcatgtaaccagataccacctgttccccaaaaatctattgaaatgaaaaatgtttaaaaaatagaaaaagaaaactcattcataatccaaa

SEQ ID NO: 248303 - DNA, 706 bp, Homo sapiens
gtgtcatgacataaaaaaggttaggaatcactgcttgtaaagaactaaggaaatgtttttgccttttggctataattcattcttattctctccctctcttactctctcgtctttctttcccctcattcttctctactcttttctactcttcaaccctcagaacttgactcccaacaattccaaaacatacacattctgaatttcagccaccaaaacagagagaaagatgatttcatttcaaatataaagtcctggggaagaactgtggttggtccagcttgagtcagatgcccatccttggacaaatcaacagtgaccaaaaggcaggaatgtcttgtgcagatgatccctaacttatgatggtttgatttttttgacttcataatggtgcaaaagtgatacacattcagtaaagaccatacttcaagtacccataaaaccattctgtttttcattttcagaatggtattcgataaattacaggagatatttaacacttcagtataaaataggctttatgttagatgattttgaccaactgtaggctaatgcaaatgttctaaacatgttcaaggtaggctaggctgagctacgatgtttggtaggttaagtgtattaaatacctttttgacttacaatagtttcaacttatgatgggtttatcaggctgtaaccccattgtaggccaggcacagtggttcacacc

SEQ ID NO: 248304 - DNA, 365 bp, Homo sapiens
gaccttttgcagttttccacagttgtgtcatatccagtcactcacgggcaagcacaattagtggtactgccaagtgcgggtggagaaatgccaaggcggtgaggaagtgaatcaaaatgaattgaaattacctgcagagaactgatgaggaggactcagtctgccgcaaaaatcaatgagttacaaaacaaaacaaaaaaaggtctgcctgagaaaatcaatgaaacccaaacggggtgaccatcgagaaaaattctcacatacacacaagtcatacctgacctcagatgtgcccagcaaatccagctcttgcccagcttgctaaagggagcataacccatctaccctctgcagcaggatttctc

SEQ ID NO: 248305 - DNA, 379 bp, Homo sapiens
cccaccagcttgtatctttttttgtaatttccttgaggctccctcgtagcttctagacagggaggggctcatgtggatgagggggcctagctccctgctctccctgctttctgcgcatccaagatgtgggtgtcttgagtgatctcaggagatacctgagctggggaaatccagcagccctttctcgtgccttgcagagcctcctgtcctgcagtctagccagtccccggttagcccctgggctgctcccatagccacattacaggccccaagaccatggcccatagctgtggctggtggtttgacacatcttcgtggagctgtgagttgctgctcactcaggcctcgcaaccgagagagacagagagataacaaattt

SEQ ID NO: 248306 - DNA, 442 bp, Homo sapiens
cagaaaatttaaggggcagagtggggtcggcctaccagtctggaagtcagcagaggggactggtggctgagggtttaacttctgtgggaaatgacatctaaacatgctccttgagagacaagccacataaaccagactcataaattaaaacttagggcttgcacctgtaattccagcacctcaggaggccaaggcaggaggattgcttgagcccagaagttccagaccagcttggaaacatacacccatctctatgcaaaatttaaaaagtagccgagcttggtagtgcatgcctgtagttccagctactcaggaggctgagataagaggatcgcttgatcccgggagtttaaggctgcagtgagctatgatcacaccactgcactccagcctgggtgagagagcaagaccttgtctcaaataccacccccttgcaaaaaaa

SEQ ID NO: 248307 - DNA, 450 bp, Homo sapiens
ctccagaacaggcgaaaatgctatgtgtgtcctagcctataatttgtgtgataacatcagggttgttttgatcttatactagggacagtaaataaagtagaaaccagaagttattcatgggactgggtctaatcagaagtcaacatggtggattagcatccaagatggggtggtttttgtctccacaaccttaacaaggctgttgaaaaagtgatccgtaaatatacatataatcacttttcaaagtcaagaaacaatagatgctggcgaggctgtggagaaaaaggaatgcttttacactgttggtgggaatgtaaattagtacaagcattgtggaagacagtgtggtgattcctcaaggatctagaaccagaaataccatttgacccagcaatcccattactgtgtatataccaaaaggaatataaatcattctattataaagataca

SEQ ID NO: 248308 - DNA, 309 bp, Homo sapiens
agggggcggagtttgggcagggggaatatatttaagtaagttctctgtgaaagcccatccatgttggcatatttcttatttatttttttaaagtcctccctgcagtccaaatatgttagcgtatctctgatttcagtgtttttattcgtaaacatggcatcaaagcccaggtaggggagtgtgaaaacactgtccaatttgtcttttacctcaaggagtgtaatttcagaaaagtaataaggtgaaaacccgctttcaggagttagagactagaactaaggaaactgaagtctgtcattctgtttgata

SEQ ID NO: 248309 - DNA, 709 bp, Homo sapiens
ctgagtttatttccaaacaggtcaggcccagatacaagcgaccgcgtagttgggagaagagcaatgctggaacagtgggtccctgtcttccacatttcctaaagtgggagggaggcggaggagtgggatagcttttgattgagggcattgacatttgtctaaggaattaaacaactgggcagctagatgacctcagtaaccagtctcgtctcagccccagccttttgatgctcatcatcttgtctggttttataaacagggagatgaatccaccttcatcggacttggcaggacagaggcatgttcatctgtgtaatcaggtttaatagcagtggcgcttgtgaaatagtttgcagtcctggtgcccagggtggaagccttctttgctcctttgtgttcctggggtgtgatggcatgcctggccctgcgccttccgtcctccaggctcccaagctgagggtcaggggccctgtcctgggcaggggccgtggaaggagcccttggtcaggagcttggagtagcaatgtcgggttttctgaatgagaagcaaaacaacactcgggaaatgagcctcgtttggctggaaatagtgtgccagtgttttcttgcttcgggttagataccagttaatttacccattggttttcattaactaatacatctttctgagcacctactgtgtgtcagggctaagggatagccagcgacc

SEQ ID NO: 248310 - DNA, 655 bp, Homo sapiens
ctgagtttatttccaaacaggtcaggcccagatacaagcgaccgcgtagttgggagaagagcaatgctggaacagtgggtccctgtcttccacatttcctaaagtgggagggaggcggaggagtgggatagcttttgattgagggcattgacatttgtctaaggaattaaacaactgggcagctagatgacctcagtaaccagtctcgtctcagccccagccttttgatgctcatcatcttgtctggttttataaacagggagatgaatccaccttcatcggacttggcaggacagaggcatgttcatctgtgtaatcaggtttaatagcagtggcgcttgtgaaatagtttgcagtcctggtgcccagggtggaagccttctttgctcctttgtgttcctggggtgtgatggcatgcctggccctgcgccttccgtcctccaggctcccaagctgagggtcaggggccctgtcctgggcaggggccgtggaaggagcccttggtcaggagcttggagtagcaatgtcgggttttctgaatgagaagcttcttgcttcgggttagataccagttaatttacccattggttttcattaactaatacatctttctgagcacctactgtgtgtcagggctaagggatagccagcgacc

SEQ ID NO: 248311 - DNA, 455 bp, Homo sapiens
agtgtttggataggagtctcttctcctgaggatccaggagaggattggattcatttttcaccaaaatgaaaataaaatttagatattcttgattgaaaattcagaactttatgaaatttttttgcagatgttgggtcagtacaatatctgagaaatggggccaggtgcggtggctcacgcttgtatcccagcattctgggaggacaaggcaggcagatcacttgaggtcaggagttcaacaccagcctggccaacatggtgaaaccccatctctactaaaaagacagaaattagctgggcatggtggtgcctgcctataattccagctacttgggaggctgaggcaggagaattgcttgaacccaggaggtggaggttgcagtgagccaagatggtgccactgcatttcagcctggggccgcagagcaagactccgtctccatctcaagagaaaa

SEQ ID NO: 248312 - DNA, 340 bp, Homo sapiens
gttatgtgtggatcaacttacaatggatttatccagacaaccccattataagctgaggagcatctgtatttacatagcttagcatatagtaagcccctgtccataatgccctaatgaaggtcaattatggagcacacaatattttgagattaagctgatgactgataaagaatattcctttcctttattttagagcttgcacctcttggatagaaaactggactgaattgaggtacatggcctcagcctctaaattatgcagaggaaactgtagacactcctaatggtggattttgaagtgccattatacatagtacaaacattatttcttttcctactt

SEQ ID NO: 248313 - DNA, 469 bp, Homo sapiens
gcttctccaaatctttgggggtcattcttgggatgacctctcttctctacttcccaaagggtttttcactcctgcctgtgggtgcctcaagcccctcattgtccctgcagggagaggggtcccttagggtcctctcacagctaggagactgccttgctgctggttccctctgctgtacccagtttctttctatcactctccacacttgctccagtggctcttggaaagttcagatacatcttggagactagggagggagacttggtaggaggagtcagggtgtgtgtgtgtgttggggggcgggggaaggggttggacagaggaaagatttctccaaatcatcagttgctttaaaagaaagcctatatttagctgggcttagagggcctgtaaatatgtattttgcaaggcagacagcccgtagctgtgggagctccagagatatgcagggaggtcaaagaaaaaaaaa

SEQ ID NO: 248314 - DNA, 560 bp, Homo sapiens
agagaccagaatcgttcagaggcagggctggtccctgttgatttatgactcaggcaaacagtccattcatccgtcagcggctccacttctatcctcagcttactggaggcagaagaatgtcccctggaagtggtctgagctgcttcctgtggtggccccattcctccgggtgggggatcctatttttagagggccaccattgccatgaaagtccagccggctcatcggcaccgtgcggcatggtgggacgcagtactgaaattcgagggggagctaggcattcatagctgtttcttacaaacaagaaaggcactgattctgaggctccatttcctcctctgtaggtggaagatagaggaggctatacagggaggctcagctgtgcctgacacacaacagagattctccaggaacaggacatgaatgaatacaaaatcaaataggtgatttccctcttcctccagcagacaaacccagaatagcaaagatcacttccatgcgcgtccgtgtgaggagaccacacaacaggctttgtgtgagcaataaagctgtttatttca

SEQ ID NO: 248315 - DNA, 459 bp, Homo sapiens
agaaaataacacataattaagttaatggatatattaattaccctgatttaatcatcacataattacatatattaaaacatcacatttttaacctatacatgtagaaaattatgtgccaatttaaacaaaataaaactttactttcattatcatatgttgtctatatttacccaatgttgctgcaaattacaggattttatttttcctctgactaatattccattctaataatgaaaatatttattctagtatttatatacaaccttatatataagagagagacactcaaagtacctggttttaactttgtatcacagagccactgaagaggtctcaaattactggtgtcattcctccatcactctatggcagtatggtatgctgaaggaatatctctgtgtgctggggaagagaaaacaggaattttgaagcaataaactgagtgctgtcctgttagag

SEQ ID NO: 248316 - DNA, 650 bp, Homo sapiens
cccagagtttctgattcagtatctggggtggagccagagaatttacatctctaataagttctcaagtgatgctgatgctgctagtccagggaccaccttctgagaaccattgcttaaaagaaccttctttgcttagtctagacctcccatccccagaacaaaccctctatttctcaccagactttccctcaacgtccaggtggatcctcccctattcctccaaacagacctcctcccattccctgagacggattctcccctttctctaggattctcccaactcccaccccagatctcctcacccccaccatcaggacagagcctccatccagggcatgtttccctaggcccagacatgtaagggttgatgataactggcttaagaggagcaaggcagaagcagaaaattcccatctcagcttagtgccaggagctaatctaacagacacaggctgctgtgggcagggatttgtgggagaagcagttgttaagcagctttgtgggcctatggaaaaaaaggagggttaacagggtcctgtgggagctggaaaggaattcgactggggggatattggaactgaccagttctgcttccaccatcccaggtctctcttccactgtgcctcccttgcccaccatgacggtctgtc

SEQ ID NO: 248317 - DNA, 339 bp, Homo sapiens
tctcaaataagtaaataaataaataaaaattaaatttttttaaaagaagacttcttatctcccaaggtaatgaagaagaaaatgggatgttgcttgtcagatgcctccttggcagtgactagcaaataatggtggctgccactcttattgctgtcattcagtgttaggataatgctgatgggcaggagctagcaagagtactagctcctctcttgcctggggcttgttattcatttggctttcctgagggccagctctgaattggtttaggtttgatctggtttattataaggtaggcctacctgttcagaacttgaaacttggccctggtgttactca

SEQ ID NO: 248318 - DNA, 467 bp, Homo sapiens
gtatgcgctggctgtatacctgggtcacccgtgcccacaccgaacccagcacgaggcccacttcatttccgtattcgtccgctcgcccagtaaacagtgagaacgcgcaaatccctgcggggcccgggcttccgggacgggctggacggacaggcctgaggggcgcggcccggggacgcgggagggggcgtgggaggcggaagtcccaggagagcctctggggactccagggccgcgggagcggttgtgggtgcggggtcgggatttgcatttcccgcgctgggccggcggacgcccgaggcctgcaggagacccggggcccagggctcggagtccaggaggtgattcgggagggcctgggacggccccggggccaggggtcgagccgagaggcggccccgcgccgctcccaggaaggaaggagagccacgcccggccccgccacgttccagagacttggaaccgcg

SEQ ID NO: 248319 - DNA, 482 bp, Homo sapiens
gtcagattcattctgacatagatcaggagtggaaaagtgtgtggtatagaatagagtcattagtaaatccatctcgttttttgtttcatttgacagcaacacattaaattaatccctgtccaaaagaatcacattaagggagctgtcaatgctaatccctagctcattgttgctgcctagctcagggttgactttaataggtcgcgctgacatttgtttcttctgagaaacatcggtgacttcatccagacccaaatctactcccattaaaaagtgaaggcacccacaagtttttacataccgtgaattctctggacttctagtttaggatttgagctcttgttggaaatgttgattcacatttatgcctttaacggaataaaggtgattatgacaataaaaagtaaggtagactcctccccgaggaaaaaacctgattaaaaaattaaaaataaaatgatgttgctatttttatacctatt

SEQ ID NO: 248320 - DNA, 474 bp, Homo sapiens
gttcttctgttaaaaatatccaaagccacattttttctctatggccttatctcaccattccatgctagttaaatagctttctctgtttttatatcacatctaatgggtttaatgtgttctaagtgtatggctccatttggtgcattggatgctatggctgagaggtgccatataaaaatattgttattgttatgatgatgagttcaagcactggaagggaaattgtgcaataacttagtactggagctatcattattttcagcaaaatgaagtttggcttcttactacactactaagccttgaagattaaatggtatctacagcatgtatcttagcaatgagccaaagaagtccaaagaaaaaatgtttgttataacaaacatttcatatattataaaacagatgttcacttttatgtattcttgatactttaagaagttgatgatacccatgtcagaaattaagaaaaaaaaa

SEQ ID NO: 248321 - DNA, 840 bp, Homo sapiens
agtatgggagaagacactctcccggaccagggtcctccttatgaacgctggtcccccacctcgccaaggccatacatgcggaatcttcctggtagatgtaataagtcagagacagatccactcatccttagccaggtagcatttaccccggaggccatggatgggcttggtggccgtgggaagtgggggcaagccagcgcagctgctcccgagggtagaagcctggctaatggcacaccccccatgggtgcagcctctaaggtccctgctgtgcagtcggtgtgtgccagaggcatggcggggcagctggcacccctgcaagtgaccgagggctccaccagcagtgggactgagtccagtgagtcagactctgagatgctgatccccgggagtcagcccctcatatttggtaaccccgcagtgctgcgttccccgtccctgctgagaagccgggggtccttgggtggcctgcgtttgatgaggaacaggaggaggatgagtgaggaggccaggagccaagtcttcagcccgagcaacctggggtcacgagaccagggtttccctaaagatcatctgttctagtgactcattcatttgtagtctacatttgttagaggagattttggacaggcacatgtttgaaagagtctgcctgacttctaaaatcgttaagaaaaacaaaacttcacataagtggcttgctttccagaaaaggtgggcaagataaacagcaagtcctaatgacaagttctcaggagcttgtttattttgctggttgaaggctaggaagaaacactttattatgaatccgatcatgtgtatagtgtgttatatttatat

SEQ ID NO: 248322 - DNA, 277 bp, Homo sapiens
gtaagtggggccaaaagagggacccatcaacactgcagatgttcctgtgcatacctcagggcctttgcacaggctgctccctggcctacaatgctcttagctcacataatctgtattgcctttcactgtctcatgtcatctttcagctctcagctcaaatttcaccctgataggcctatcttgatggtctcatctaagaatagaatcccgccctctcttggtcattctcacgcccctggctgatttgtttcttaagagcctttatgtccacctgaca

SEQ ID NO: 248323 - DNA, 214 bp, Homo sapiens
tgccatactctccacagcacatagcactgaccaccttctaacacactatgttagttcctcacttatcatgtttattgtttatcacatcaccttccacaggaaggtaagaccctccttccatgagggcaggaatgtttgttttgttcattagtctatctccagccccagcacatatgatgcactcaataaatgtcgtgtgaacaaatgaatgaac

SEQ ID NO: 248324 - DNA, 546 bp, Homo sapiens
ttcacagatttcacaggacgccttgtcaaatgccttactcttatccagtacatattttcttgttcaacaaaattagtattcctatcaaagaaagaaactgtattagttcaacatgacttgtacatactgcccctatgttggggagtagtaatcactgcttggtgagttgttaagaggctgggatttgatgtccgaaagacctggatttgaagcccaacaccaacagctgttaactgcatgaagtgggcaaaccatctgaaaataaggatgctcaaagcaccggtcccctagggttgttgtgtggagtcagcagatgtcaacaatcaccatcagatcagtgaccttatccctgacaacccattctagatctgtacaacactgacaagatcaatagcttgagatgaacagtgaaagggatctagcttctgttaccttataaaaattacaatgttttaaatctcatttgcaagttctcccattaagcaagggagtagtttactaggataaaaagacatttaatattaaaagtaactgagttgactaccg

SEQ ID NO: 248325 - DNA, 667 bp, Homo sapiens
tcattctctacctacttgaggctgacttccacccccatcagtccacccagatgattcttactaatgactttcctgccattaaacgcagcaggcagctttcctgatctttgctctgttgactacccgctcctcagtcacacactctttcccaccagccctctccccgctgcagtcctggtttttacatgtttcagcttgtttttccattggtatttggccattaaggttgatgtagctcaggaatatgcattgtcctgcttttgttctcagtatgcttctgaggtctttggaatgagtggatcccaggaggactctagacaaaggctgggctgattctctgatttctgcagtacagggaggttaatacagttaagcttgatttagagactgtaccattgaatagagatataaacattattgtaatttcattctctcactctggttatttcaacctattctagttttataggttagtattttaaatgttaatgtaagttgttttataattattactgttggtgttttttggcagcatttttagtgacttttttttgagatagggtctcactgtcacccaggctggagtgcagtggcacgatcaaaactcactgtaacctcaaactcctgagctcaagtgaacctcccacgtcagctaccaaagtagcta

SEQ ID NO: 248326 - DNA, 451 bp, Homo sapiens
taaactgctacttgaaaggcatgtgagagaatgtgtgtggtggggagagttgaggaatgcaattcacagtatttgctttcaaaacatgtggcatacagagggagcaggactgaaaaaaaataaaaagcatatggcaggcagaggtacagtaaatagtttcaagagataattcatcatagaagctttcctaatgacacttgctcagtggaaagcaaatcctttgtcatccttcatagttaagagtacaatattgtttatgtagagtcagaaataaatagtaacagcctctggattacttgactaaaaccctaggcatcagcccatacaaatagtttgtttaaactgtcattcaaatttagtttaatggaaataaaaaacagctaaattctgtcattttttttccagggtgataacagaataaatacttagtcttcaaaatttctcaactgaa

SEQ ID NO: 248327 - DNA, 428 bp, Homo sapiens
tgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgtgctgtagtgggtagggtgaggaaaataagggtcatcaccagcaaagtcagagtgatgaaaaaactggattacaacactctgcttgactttgcatagataagtaagccaagcagagtgtttcctggatgtagttaaaatacaagcttggagcacaggtaaaaggccaagaggcttggagatgtacatctgagatgtaccaaagggccaagtgcaaagtaagtttgggaagtttagtgtcatat

SEQ ID NO: 248328 - DNA, 379 bp, Homo sapiens
aaaaactatacatatatctacacaaacacatttataatcagaatattgacctcttactcgatgaacttattctctccctctaatggctttatcaactgtctatggaaactctctacttggaaaccccactccacctcatatctgacacattcaaaaacaaactcacaatgtcccatactaactggctattttctccaacgtgtgatgtctaataatctaataataacattatagcattggtgtggtccctgctttacaacgtgctctactgtatgtcactgtgtacacagtatttcagtgattcttctactgtgtgagataaaatatcatcatcatattcatttagagatgagaaaatcgagaagagaggttatgcggc

SEQ ID NO: 248329 - DNA, 1067 bp, Homo sapiens
gggggccggaggacaaaccaggagaggggcttctggaagccagagagggcgtgcacacacaggcgggggagggagcctgggtgcagcagggtgggccactgcgactcaccgagggccagcggcgctggggccaggggctggagtttggagagtgagcagagagcacgcaggggctgtgaacaccaacttctctttcaggtcaatttgctgcaaaggggaaggtaaaggtggaggtaactaaggagcagggcaagagaggggtgtggttttctgtagggtccagccctacgggggcttagcaggtgtcctccccgtgtgcagagaccagagattgtaataaagacacgagataaagagcagctgggccccgggggaccactaccatcaagacgtggagaccggtagtggccctgagcgcctaggtgcgctgatatttattgcatacaagacaagggggcagggtaaggagggtgaatcttctaagtgataaagtgaagcaagtcacgtgatcataggacagggggcccttccctcttaggcagccgaagcaaagagagaaggcagcatatgtcagcattttcttctctgcacttagaagaacgatcaaagactttaagactttcactatttcttctaccgctatctactacgaacttcaaagaggagccaggagtacgggaggagcatgaaagtggataaggagtgtgatcattcaagcaccacagggagggggttaggcctccggatgactgcaggccaggcctggagaatatccagcctcccacaagaagctggtggagcagagtgttccctgactcctccaaggaaaggagactccctttcacggtcggctaagtaacgggtgccttcccaggcactggcgttaccgcttgaccaaggagccctcaagcggcccttatgttggcgtgacagagggctcacctcttgccttctaggtcacttctcacaacgtcccttcagcacctgaccctatacccgccggttattcctaggttgtattagtaatgccacaaagagtaatattaaaagctaatgactaatattta

SEQ ID NO: 248330 - DNA, 652 bp, Homo sapiens
gggactacagacacataccaccatgcctgactaatttgctttgtattttatggagaggcagggttttgccatgttgcccaggctggtcttgaactcctgggttcaagagatctgcctgccttggcctcccaaagtgctgggattataggcgtgagctaccatgcctggctgggagtgccaaatccaaattcttaacattcaaatcgtgtgcaccattttgggtgcctctattttatccttaaattcacaaatcatagtttgaccctaaattaataagaataaagtattcaagaaattcaatatattgctaagatatgacacaagcaagccagctgaaataataaaaatggtttttacttgcatttgaatgaaaggaagaaatgtttttatagttcatccctcatttcaaaaattctgtgcatgcggagtcctgcaatatgcaaaagcagacatttgtcctacaaaggcagatacattgttcccacagcaaacagtatagatttgattgtgtgtacaactgtcactatttccttcaacaataaatcaagatcaggaggtatatcaatgacaaccaactgttcctctacgaagaaaggaggttgacattcaagcacaatttattttattctgtaacatcttttcttgttgattc

SEQ ID NO: 248331 - DNA, 481 bp, Homo sapiens
atacatttattaagtatgcaagaaaaaaactatttaagaataaatgcaatgtgtttagaacaaatctgatgctctgtattttaacttttaaaaagtaaccatttcacaattaaatttggatccttcattttaccccaacaaaaactaaccttttatagagaagaactttaacaagtaatgtcaacaaagcattctaaagtactcataatttaaacaacttgcaaggagacaactgttttttttgagacagggtctggcttgcagtggtgcagtctcggctcactgcaacctctacctcccaggttcaagtgattctcctgcctcagcctcctgagtagctgggactacaggcatgtactaccacgcccagctagttttttgtatctttagtagagacagggttttgccatgttggccaggctggtctcgaactcctgacctcaggtgatctgcctgcctcagcctcccaaagtcctgggat

SEQ ID NO: 248332 - DNA, 704 bp, Homo sapiens
aatttgattaaaattatctagcattctttatatttttttagagacagcgtctcactctgtcatctaggctacagtgcagtggtgcaatcatggctcactgcagccttaacctcgtaggctcaagtgatcctcctgagtagcacaagtgtgtgctaccatgcttggctagttctttaatacttttgtagagacaaggtctcactagaccaggctggtctcaaactcctggcctcaagccatcctcctcggcctcccaaaatgctggaattataggcctgagccagtgcacctagccaaagttgtctagcattcaaccagctgctcttgaacctgcccccgcttccccatttcccctacttttcaaatatccaaccccacgttaattgctttatgctatttcagccttatgaccctgggtggcaggtgcaatcccattttacccatgagggagctgaagctcaaaactagagcagtttgctgaagttcacccagctaataagactggattaggacttaggcctgcctgattcaggttcagttctcagtacatgctcatgccaggcatggatgtcttcatgtccagcactctgaacatgagctagactgcaggtgacttagaaaggcctcagagtctagaacagagtgtctcaagggcagagccacattatggagattaatctggctggaccaaagtagtagtagaa

SEQ ID NO: 248333 - DNA, 357 bp, Homo sapiens
aggtgagaaaactgttatccaaataagaaagctgtttgcctagatgagaaaattggttgcttggttaaactggtttatacaaatattctaaagcaaacagtgaagcaagagtaacagccgtggtggcagcatctggatccttgattgacagcattatggaaagttactggccagatactccttacttaagttggcaccaatcaacttgcctggggatcagtcaaatggggtgaggtgagggggacttcaggagatccttcccagatggatgccaaattcctttgatagccctgtcattgtcaagaatttcttcaagtttatgtgtataagaataaaatcttgttcaagtttatgatg

SEQ ID NO: 248334 - DNA, 263 bp, Homo sapiens
caaaaagtaaacaaaaatacaagggaaaaaaattattgacaatgaactgctttggtagtgatttgtgattttgttttttcttgattagtaaccaacagcacagccaccaagaaattatgcacatgtgggaccacgtcaagctgaagcgtttgtgcccaacaaaggaaacaataaagaaaataaaaaggcacactaaaaattacaagtttgggataagggattatttttgaaaaggtacaagcgagtcatactaccagctggca

SEQ ID NO: 248335 - DNA, 388 bp, Homo sapiens
tctgagacggagtttcgctcttgttgcccagtctagagtgcaatggtgcgatctcggctcaccacaacctctgcctcctggtttcaagagattctcctgcctcagcctcccgagtagctgggattacaggcgtctgccaccacacttgactaattttttgtatttttagtagagacagggtttcaccatgttggctaggctggtcttgaactcctggcctcgagtgatccacccgctccggcctcgcagagtgctgggattacaaacatgagccaacgtgtctggccattttcatcatttttaagtgtacaactgagcggcatgaattacattcacactgttgtgcagccatcaccatcatctgttcccagatcatcccgactggagg

SEQ ID NO: 248336 - DNA, 501 bp, Homo sapiens
tgaacaacaggcagagttcccttactccacgtgtcattatctttaatgtaaaagggctttgtatggggatgtgctttgaatcttgaaaaatgcttttcacacttggagcaacacttatggcagagaaagggagaaaagcagaatacaaatccacatgttatgaagcgtgtggattatccatgtaattataatagagaagtgctgccctgcacaccctcgtgtgtcctcacagcagtgctgagcagaaggcaggaggggtgttgtcccatttacagagggggaccaggcctcagagtgataggtggacctggggtgaggtggccttggactaggcttctcccttctggttctttctgaaaccttgcttcataggcacctttccagcaacaacagccattcaagacccttgtgcctgttaattttgtttgtttgttttgagagggagtctcgctctgtcacccaggctgtagtgcagtggcgcgatctcggctcactgcaagc

SEQ ID NO: 248337 - DNA, 512 bp, Homo sapiens
tgaacaacaggcagagttcccttactccacgtgtcattatctttaatgtaaaagggctttgtatggggatgtgctttgaatcttgaaaaatgcttttcacacttggagcaacacttatggcagagaaagggagaaaagcagaatacaaatccacatgttatgaagcgtgtggattatccatgtaattataatagagaagtgctgccctgcacaccctcgtgtgtcctcacagcagtgctgagcagaaggcaggaggggtgttgtcccatttacagagggggaccaggcctcagagtgataggtggacctggggtgaggtggccttggactaggcttctcccttctggttctttctgaaaccttgcttcataggcacctttccagcaacaacagccattcaagacccttgtgcctgttaattttgtttgtttgttttgagagggagtctcgctctgtcacccagtgtactctagcttgggtgacagagcaagacatcgtctcaaaaaaaaaaa

SEQ ID NO: 248338 - DNA, 228 bp, Homo sapiens
gtgtttaaagatttgtattattctctcccaatgactagatagtagtattttacaatggagacttaaaagttttttgtgttttattctttcgcttttctatgccctcaatccaaagaacaccagaaatacacttgtagtcggaaaacttgggtttatcacttgcatcaaggaatgacacacaccatgggccactctggagcctctcaataaaaggatgtttcaaagaac

SEQ ID NO: 248339 - DNA, 442 bp, Homo sapiens
taattattggtgatggaagaatttagaaaactttaaatttctctttaattatattagtattccatagtgttcattttaaagtagataccgatttttgagcgtgggatggaaaatggcagaggagttaggatcctgccccagtgggccccaatagttccttatttgcatagtaatttacagtactctgtatcagaagagcagtgaatagagttccctaggaagaggaaggctttgggggtagagattaagtggtgaggcctttgaggaagggattaaatcctgatggttctgcctaagcactgtgttatacagtcaatttctagaacttattcatcttgcatggttcaaaccctgtatctattgagcaacaacttcccattcccccaacccccaatccatggcaaccatcgtattctctgcttttatgagtttgaaaaaagtg

SEQ ID NO: 248340 - DNA, 331 bp, Homo sapiens
catctggtgagaaccacgtgctgggttaaaaaacatggcagagaaggtcgcaggggaagcgaacatttgtgaagagaggcaaaacctaaggggctcctggttttataccaacccattcttgtggaaactaatccattctcacaagaactagtctagcctccccagagcaggaactcagtcacttggtgagacccatgacaagccattcacgaaggatctgcccccatgacccaaacacctcccattaggacccacctcccaacaccaccacactggggatccaatttcaacatgtgtttggtgggaacaaataaaccatatccaaaccata

SEQ ID NO: 248341 - DNA, 173 bp, Homo sapiens
ttggacaagcggagagaagttcaatgtgggaacagcagggagggccaaacagttttgtttcattttggtttacttttaacccttattacaatccttataactagtaagtagaaaaagaataagaaaatggttaacagcagtggtttgacataataggaaaagcactgtgcttt

SEQ ID NO: 248342 - DNA, 256 bp, Homo sapiens
ctcccggctggccctcactccactgaccgagtttcctctctcaatactctggggtgccgcctcacaggaggccctgcccaggcctggctgctccttcttcccgagaaagccgccaggcgacgcaccaggtgggcctgcaacgccctggagacgccgcgtcatcgtcctgtctggaatcctgcaggatcatcatgaaaccctaaactggatcacacttcctcgccctgctctgctgacagaacagcttgagcccatt

SEQ ID NO: 248343 - DNA, 328 bp, Homo sapiens
tagtagagacagggtttcatcatgttggccaggatggtcttgatctcttgacctcatgatccacctgcctcggcctcccaaagtgctgggattacaggcgtgagccaccacacctggcctagaaatcatatttaaggcacatactatttctccttttttccacagtatgatttagattaaatgtttcttactgaattaattacactagagaaccctaaccaaattgaggatttttttatattgtaaaaggatttttgaaagtctaagatcttgattaataaattagattctgagactcagaactcattattgaactttaattgaggaa

SEQ ID NO: 248344 - DNA, 459 bp, Homo sapiens
aattctatttggaagggctatggttatgcatatatgtaatggaaatactaaaatccagcaatgcaaactataagacgaaaactattaaatcataatgagacttggtttttgattgtgtggaatataaatcactgttaattagaaacatctttcaagaaataaaatgtttaattacaaagttactataatatttcattgacatcaaaagatgtttctatcaactgcagttggattttaacttcttaaaaatcaaaaaactgatgtcacagaaaccagagtgcttattctaagtgcaacacacttccaacctcacccacttcctcccacaaaacagttgttttatacggtaatgtgaaaaaattatactgctttatacagtataatgtgaaaaaatgtgattttttcaatattacccaattaaaagactgtctgaggcaataaaaacaattttatgtaaaa

SEQ ID NO: 248345 - DNA, 578 bp, Homo sapiens
ccctttgcaggtaccttttttcttgtacaagtcacatgataatgtaaggggtttttttccccatctagagcctgcctggtgggctcatggtccatttgtggaaacatgcatttccctctcctccgcccccctccttcatgatccatgctttaagagcttccccaaggcatgcagagcaagctgagaagaggtagacaagcctgcagacctttcaaagaagtggggtggcttgggaagtaaaagaagatctggagataggagttcctaaaaagcagacaagagattaccgaggggttccccacagctccagcacacagcagctgcaaaaaaaatgcagtggaattactgagggacattatgggcttgatggaggacagggaatgcttgtgccaagccaccaaggatcatgctgtggcagttgtgaccagatagactatacttttgccaaggtgaaaggatttccctactaaatcctttactttccactttgtttaaaatgagtttaacaccaagaaaatagttgtctctatgtccttatttctaatcttcctgctcaaccatgaactgcactaaacaca

SEQ ID NO: 248346 - DNA, 378 bp, Homo sapiens
tatacatacaaatgaaaataaaggcacaagagatgtgctgatcattacaggaaaagtctagaaaatgcctgttccttaatgactttaacagatgttagcatttagttctatagtcttataaatagcagacttcatttttggtggataaatgtcataaaaacttagggctaagtatttatttcgtttgtttccttcaccttgaatccatttttgaaaacctttcagttttcagaaagttattcactgaccaaatgatcacatcaatatgtcagaataaaaggaggggtgccctgtcactcctccttaaggagggaaaaaaaatgcatatggagtttctcattattttaattttttaaatctaatcttaacttttgttac

SEQ ID NO: 248347 - DNA, 706 bp, Homo sapiens
cggcaccagacctcttcatagaccaatttatcttatagtagagggatatgcctggcacaattccacactgaaatttggaatggaaactctgaggaattctacaaagacagataacatgccaatggaccactgactcatcagttctttaatgtctggtttagtttataaccatgtcacatatagtggcaacactgtcattagttgtattataaactccagaaatttgaatcagtatggttgaaacttttctcccataaaatatattactttaccctttctttgcacttgcaaagggaaatgcttagagctttcgtaatagattaataaactccctttctcaaattgacctataataaatggatgttattgccgatttcaagctatttccttctccttgagactatatcacaaataaaggaatgtgtccaccaccttttaaatcagaaatcaacaaaggaatcaaaatacaacatggcatatctctataaaaggagtaccatgcatccatcaaaatgatggcatgatgaaagattttcatgatacattattaagagaaaagcttggaatgtaaaataaagtatggttagtatagacatgcatttggaaggtaaaatgaatattttaaatatgtatacatagaaaatatctggaatactatctaccaaacggttaacacgacactaagtgttaagtagtgggattacag

SEQ ID NO: 248348 - DNA, 418 bp, Homo sapiens
ttggtttagtgaaattaactaacaaattaacagattgtactgtaatgatgtaagatgtaaccactggggaaatatggaccatctttgcaacttcctgtgaatctgcagttatttcaaaatacaaagttgaggccaggcacaatagctcacatctgtaatcctagcactttgggaggctgaggtgggtggatcacctgaggtcaggagttcgagaccaacctggtcaacgtggcgaaaccctgtctctaataaaaatacaaaaattagctgggcatggtggtgcatgcctatagtcccagttactctggaggctgaggcacgagattcttgcttgaacctgggggatggaggttgcagtgagctgagatcgtgcaactccactccagcctaggagacagagcaagactctgtctcaaaa

SEQ ID NO: 248349 - DNA, 1327 bp, Homo sapiens
tgccgggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggaagggacgctgtggtaaggggtatgcctggatctccccatgtaagatgagcttgcacttctgtctctgctggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaaccctgtgtatgtgattattctgagctttttggcctggagaagggagggcgggctagaaggccaaaagaaggatgaggaggacaataatatttatttttgcatccaac

SEQ ID NO: 248350 - DNA, 263 bp, Homo sapiens
gtgagtccatcagagttctgaatttctgtagggtgtttatgttcagtaattaatctggtgtgtggacagtctgccatccaagatgaagcatgattttgaaaaactttgttactaagtttttcttgcctcactctatacccagtaatttttttattgggtgccatatattgtgagttttaccatgttgggtgctgagtatttttgtattcctttaaatcttcttgagctttattctgagatgcagtaaagttaatttaaaatga

SEQ ID NO: 248351 - DNA, 473 bp, Homo sapiens
gaataactggtattaatcatccttcctctgtcaaactaacacctaaattactataaaattactatactatatcatgccacactatactatactgtatttactgtaaaaactgcagaggaaaatgaacttggtggttaaattaatcacagcatttgtctagattctgcaagaatgaattcatgaggatggatttaaaagctttttcaaggccgggcgcagtgtcacgcctgtaatctctgcctcccaaagtgtcgagattatagctgtgcaccgctgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccaccttttaaaaaaaaa

SEQ ID NO: 248352 - DNA, 339 bp, Homo sapiens
atactagttattgaaaattcaaaacaggtgtataaaaaagtacatatatggccaggtgtgggggctcacgtctgtaatcccagtactttgggaggccgaggcgggcagatcatgaggtcaggagatcaagaccatcctggctaacatggtgaaactgtctcttctaaaaaatacaaagaattagccaggcttagtggctgggtgcctatagtcccagctacttgggaggccgaggcaggagaatggcatgaacccgggaggtggagcttgcagtgagctgagatgtgccactgcactccaggctgggcgacagagcgagactccgtctcaaaaaaaaaa

SEQ ID NO: 248353 - DNA, 373 bp, Homo sapiens
aaaaaaggcaaacaactagaatggaattaaagacagatttgcaaacctttcaaccattatataaatattaaaaagttaaaaaatgaattgccaattgaaaaataaaagcttacatgtaaaaacagcaaagtgaagacagtgacaaaggagacaatggtattccattccacttgggtacatttgctggggaagactcttagccagaggcaagggctctgtaagttaaaaaggattaggaagcgttccagttcttaaagacaaactcatccagggagactttctctttgcattaattgggagggttgaaaaccaatagacagagagtgaccgtttgactgtgtgatgagatgttttgcaatgctgtgttcaactc

SEQ ID NO: 248354 - DNA, 424 bp, Homo sapiens
tggtatttttagtagagaccaggtttcactgtgttagccaggatggtcttgatctcctgacctcgtgaagtatttttatgatggttgctctaaaatccttgtcagttaattctcacatctgtgttctgttagtgctggcactgatgactgtcttttctcattgagtttgagatctctagtgatttttcaattgaaacatggacatttttagtggtttccctggagtttgtgatataaattaataactaatcgaagtccaccttcaaattacactctatccctttgtgtgtagtgcataaaccttgtgtcagagtactcccatgtcctccctcctgtgtcttattacattgctgccactcactcatctacatgctgtaatcacctatacagttactattattagagagttatcttttagattagc

SEQ ID NO: 248355 - DNA, 524 bp, Homo sapiens
caggactctggtaagcatatttctccattgccagcttgctcgctgtcaggttctgctgacagggatgttggagagagactggaaggcaagagaaggaagaactgtccttcctatcagctggctactcctggcaataggcccaggaatggtccttcatcctagcagcaggttgtcccagtcaccagcttcttttagcgccctcaaaacaagcctcatgacacctcctcagaaggaccgtgtgagtgaggcagcacccactctacagagatctgagctctgcagggcccctccgtgataaacagaatcagtcagagggggacttaactcagtggctaaggacttttctccaagtatggaggtcctgataaccctgacttcattaaccctttattgccctagccagtggggtgggagggagagattgtttcctgcccttttttcgttgttatatcactattgtcttgttttgcttttttttagtccaccaataactatttaatttcctatattaaacatttcctgtt

SEQ ID NO: 248356 - DNA, 180 bp, Homo sapiens
atagagctgacacgtgcatgctcaagttgctaattactttaaaggcaataaatagtaatggtatttttttctaaaatacaaggggaatgcaatacctaatgggaacacacatcccccacttcatcccctaaatcctcactaaatgaggattcttttttacactgtctccactgtgcttag

SEQ ID NO: 248357 - DNA, 434 bp, Homo sapiens
aagaagaatatctattgatgtgaaaatggtgtgaaatttacatttcagtgtctgtaaataaagttttatttgaaaacagccaatgcttactcatttatatattgtctctggctacttttgagctgtgacattagagctaatttttttttttaacagaaactttttggccaacaaaacttaaagcatttactgtttgtgtctttacagaaaaagtttgccagttcctaatccaggacacatgtatttacatggttgttaaacttttctgaacagccagtgggatgtggtaaatatttaacagcagcttctctggaagagaatgtattcgttagtatgtatttatgtgtgtgtatatagtttattgtaaattttacttatttttctatcactttcttaagaccacaagacaattaataaaacaaattgaaccctgt

SEQ ID NO: 248358 - DNA, 434 bp, Homo sapiens
taactggtgcacagtaaactgcacatctttaaaacctacacggtgaggagttctgacttatctccacaccagcgagacttagaccacagtcagaaaaacgaggctcctatcaccccagagttctccgtcactcgctctccgcgagccccttgccaggaagagctgcttcctggcattatagatgtgtctgcatcttcttgaattgtgcaacatggaatcatacagtgcctgctgttctgctgccagctgttcttgctcagtgtgatgtgttcgagattcagcaacacaggacgcatcagcagctgctgccctttcattgccgagccctcctccattgcaccaatacatcctgattggtctagccattgacttgctggtggatatctaggtcgtttctaggtgttagttgtcacaaataaagctacaataaataa

SEQ ID NO: 248359 - DNA, 212 bp, Homo sapiens
aagtttttcacaagaagctcaatcttaatagtgagaagatgcaagactgtagccctggttaaacctctctgcccgtaaggaacttggtacccttccttatagaagtctgctaaagttagccctttgagaaaattacctatttgcagtactcttttgccattttttgaaaaaatggccggtagtcagagttttgaaatttgaggataactttt

SEQ ID NO: 248360 - DNA, 509 bp, Homo sapiens
ccactcaatattaaccatcacagtgctggaacatgctaagtggattatttcccaaatggtccatccagggtgtctaaccatgctaatctggtggatttcacaaaatgactggagaatggtaaaggtgctcatggtttcagcttgtttgtgaaggataaggggaattattttctcggttgatgttttcccccccatacgtgtaccccacccacttaagatgcttcctgatctcagcaaaaccaacatgtctttaaacgcaggttttatgaccaaatttgcattctgtccttcgaatgacaaggttagctccagttattaaaaaacactgttaaattcctaaacttatcttggcaccacagttgcagttatttttcagactttaggcagaaaaaaaaaaagacactattagtaattttaaaaaagacactattagtaattttctaaagaagagctctgatggacagcagcaaatgactctggggtctgttaattacaggggaatgataaaa

SEQ ID NO: 248361 - DNA, 507 bp, Homo sapiens
cagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcc

SEQ ID NO: 248362 - DNA, 463 bp, Homo sapiens
cctgttttgtctttaaattggatactttgttactgtcttctctgactttgaaagtttgtctctgtagataagcatagttactgatactacccaaagcctttcagactttggcattttagatttaaggtcccatgtcttttcccaggttcctaagattatttgttgttaatagtttatactcccagcctccttgatgtccaaatcctgaaagggcccctgataactcttatggccgcccaccatacattaggagcaagggctttgtcaagaatgcagtgagcaagcagctaagctgtagcacttggccttctctgcccgaaaatcttagtagctttgatgagagcttgagacatgatctcagggaagggtgaatttgctacagctacatttatctgtgccagggttaggagatagccctaggtgaatataagaaaagctcaacctttcccttctgtccaaaagc

SEQ ID NO: 248363 - DNA, 1080 bp, Homo sapiens
agccagagtggtctcagagagactccgagaacctaattttttacaagtaaaatctttgaagaattggtaattgctaaatttttccaacatactattctacaagactaacctaaaactgattataagaactaggtgaggagggctggcaaaacgaaaatctagacattttccgtatgaagagaaatctggtaattctaatttctatgggaaattatatccaacagtttagaatagaaaatcatttatgtggaataacttggaccagatccatccagctttaattatatatttagattctaggcattctaccttcagaacatcataatgatagtaaaagagatacgattctggcccagtatcatctcaattcatgcttattgtcttttttttttttttttttttagctttctatgtattaagaatggaatgaattttatgtatgtaaaagtgtaacccaacaccttaaaattaccttctcaaaattaataaagacagagttcttataaatgattgcatcagttggacttcggtgatttcaccgtggtcatccattatgaactgtatttgctgttataattgggaagccatgatgttcagtgtattacatcattatattccatttctcaaatggaatatgaaacttgatagcatttgaaaccatttcccaggaaacactagtgcttgatggtatttttagaaagcattctgtggttaaatgagcatattaaaattaataattaagaaaataaaactatagcttctccaaataatgaagtaatgagagtttaattgattttatttaacttaatgtatctgaagcaccttttaccctgtaactttcactcttaatgcttgtgagtatgggatatgaacccattttaacagataagtgctgtaaccaaaacaggtgacagcaaaggtggaaagttcggacctcatgtcaggtggttagttgtgttggaaggtggatgtgaggtatgtttccctggatgtggcatcatgttctaaagtcacctgttctttctgaatattgaactgttgcttttctgcagaaataaaatttctgaatcaacactatac

SEQ ID NO: 248364 - DNA, 788 bp, Homo sapiens
ctgggctgaatctaagcttatcaaccttccttctagttacagagatggaaagggaatatgaccatcactcatgtggaagttgagccattagaagaaagtccacacatcttatctgccagtaaaaacctagtctcaccagatgtctcttcattcaagcaagaaagcccttttttcaattctatgaagggtgagagaggtgagtaagctgcagaaaagctggaagccagcagacgttggttcatgaggttcaagaaaagaagctgtctccataacaaaaaaggacaaagtgaagctgtggcaagctatccagaagataagctaagctgacagatgaaggtggctacactaaacaacggatcgtcgatgtaggtgaaacagtcttcagttggaagaaggtgtcatctagaactttcatagctagtgaggaaaagtcaaaggctagcttcaaagaaccattggacaagtagactctcttgttagggactaacaccattggtgaattgaagttaaaatcaatgctcatttacctttctgaaaatactagatcctttaagaattatgttaaatctctgcttgtgttctagaaatagaacaacaaagcctgggtgacagtatatctatttttacagcatggtttactgaagattttaaacccactactcagaaagaaaaaaagattcctttcaaaatattactgctcattgataacgcacctggtcacccaaaagttctgatgcagatgtacaaggatattaatgctgttttcatgcctgctaacacaacaacca

SEQ ID NO: 248365 - DNA, 458 bp, Homo sapiens
ctgggctgaatctaagcttatcaaccttccttctagttacagagatggaaagggaatatgaccatcactcatgtggaagttgagccattagaagaaagtccacacatcttatctgccagtaaaaacctagtctcaccagatgtctcttcattcaagcaaggctagtgactgttctaaacagaatcataagatctgactgtgaccaataatggagaacttgcacttgcaaagaaatggttgtggagaagcttcccatttctatatctggacacaactatgtgaggaggtgatgctggaacaggcctactgtctgaagttcacaggctgaggatgacaggaaaaaataaaagatttaactaacctggtgatgatgccactgagcccttgaattaaccctgaaactgtgctaactatagacatcttattatatgagacaataaacaatatttaagctatga

SEQ ID NO: 248366 - DNA, 420 bp, Homo sapiens
ctgggctgaatctaagcttatcaaccttccttctagttacagagatggaaagggaatatgaccatcactcatgtggaagttgagccattagaagaaagtccacacatcttatctgccagtaaaaacctagtctcaccagatgtctcttcattcaagcaagctgttccatatcatcaataaaatgctgaggaatcaattactctgagatggaagagaagttaatagagtacacaaagaaaggagattctacctaagaatgacagctgctcccgaggaagaaaacatgagttggaacagaaaaagaatcaaaagcaaatactttcttgtattgaaaaaccacaaacaaaacaaaacaatgacctgagtgtgcatataaagtttccctatgtcctttataaacttaatggaaaagtatctgtt

SEQ ID NO: 248367 - DNA, 263 bp, Homo sapiens
ttgttggccaggttcatgagagggtctggtggggaggctcatgaaacatcccagacaaggtctggaggatctcagatagccctgggcccagttccacttggcattggtgcattggccgtgtttgtctgagaaagctagttctgttttggaatgatccttagtgatgatcaaccagcagccatcactggatgtctgctgagtaacagactccatgttttctgctatgagattcaaaagaaacatgatgtattagcagagagcat

SEQ ID NO: 248368 - DNA, 399 bp, Homo sapiens
tacctacccttccgtctggccatccatccatccatccatccatccattaaagttctttttgggggtgtgagtatccgtttaattgcactgcatatctacctacaagtcatacctcttagcaatcagcaggcaatgaatcgggccattccctggttgaaattcaacttgagatttctagagggagctactcaggttaaggatgcattatctaacaagaaaaatgaatctacagtaggtcgtattacagatgcagcacatgaaggcgcccacacattacttcttagcagctgagtgtgaggtgcatgcatgtgaggctcagaccccacggtcttagggcatccttcaacttttttttttgaagaggagtctcactctgtctcccagactggtcttgaacgc

SEQ ID NO: 248369 - DNA, 457 bp, Homo sapiens
aagttggaaaataagtcaaatttaccctcaaaacttaggaaaacatcaatttctgactaatggaaaaattagaagaaacacttgaaaggcattagtacataaaatggaaacttcaaagaaacacttgactttgtacttttaatttttagaagattttaaattttaacactaagtggggagtgtctgcattggcagcacatacactaaaattggaataacacagagaagaccagcatgttccctgcacgagatgcacacaaactcctggagcgttccgtattttttttacttaacgttttctaaaaaggatgttacgttgttttagtataacaggtgaaaaacacgagcttaaataataagtccttataaaacaaaagccaattttgtttaaacatcattgaagatgcttttatttccttaaagatatattgcttataagtattatttgttaaaaaaa

SEQ ID NO: 248370 - DNA, 256 bp, Homo sapiens
tcagagggtaatttccccaaactcacacagctagtaagtggcagagctagaatgtgaacagaagtcttacttcttcagacacttgtttttcactctatacattgcttcttgtgttagccaagtggtgctggttttaaaattggcttgcaagctcttgaccattcttttcaaaagatgggatctaattcctttccccctgaatgtgggatgtacttggtgactggtgtctaatgaataaagtgtgatgaaagtgaag

SEQ ID NO: 248371 - DNA, 445 bp, Homo sapiens
gatgtctatttcatgctctgaagatgatccttgctacatcattcattttattgttcatgtcaccaccgctttattaggtgctaggagctcatttagtttggatcctgcatccttacagcacacctcatccttttgtttttgaacacttccctgtttcctgatattacaattaattctaagttcattttctacattatctttctcatacataggattagccgtttttcctaaagattgattatttccgatgttaaagaatagtgttaaaattaaaaattgtgatactggatatgtgtgttgttaaggtgttataagtacttctaggacctctcaacctatatgtctagtaaatgtacatgtttatatgaacccatgtttatggactcattgaaactacttatgtatctaattgtatgtaactttattacattaaaaatgagaacac

SEQ ID NO: 248372 - DNA, 384 bp, Homo sapiens
attatagttggcaggttagagatgtgtaagactgcttccctggggttggaatttttcaggttgccagcttttctaaagggaaaagttagtttttctgttgtaggaattagtatgtcatcagcagcagtaaccctcttttgtgatactcttgtgctttcagagttatataatgcagaaagtttctttaagatatagtaaggaaatttattggaaatatttttagtattttaaatctttttcattgctatgtaagactttaacatattaatttttattaaatgttagcactaataaattagcatttgcagttgtgttttgaggttatgcatcttttgctaatactgtgtaagaatttctaactaaaactgtattttaaaaaaagaa

SEQ ID NO: 248373 - DNA, 485 bp, Homo sapiens
gacataatcctcattttatagatggggaaagcagagcccagagaagttgaatgatgccatctcttagctaatggatgagtccaggcccagcctggaggacctaacgtgaccccagctggcttttgaggaaaccaaagcgtgttggagcctggaagcctttggtcagtcccatcattccacctctagggatcccctgtgacctcctgaaccagagcagactccctggagccgtcccaggccacagcccaggtgtgatgctgggctgcaagtgacagccaggcctatggtgcactgcccacatttggggctgcagccccttcctctccaacatttcccacctctatttttaacagaagccagtgcccctgccatctccttatcactcacagtcccactctgctgtcattgtcccgccctagagatgcttttgctcccattcaaaataatttaaataaaatgttgctacaaagcggaaaaaaatcttt

SEQ ID NO: 248374 - DNA, 549 bp, Homo sapiens
aataggaagaaatggccatagagtgtgtggtttctctcaagccaaggaatagatgttttaagaaaggaaaattcttgtggtgggaagcagtagagatgacagatacacattaatttcttgagatttctagatgactaaatgggcagatgttgaatgatagctaaaggagaacccagaaacaagggagggattttgtttttgttttttaaaaaagatagaccatagcagcttcatagactgaaacaataaaaaagttgaaggcacaaagaaagacacaggtcctctaactccctgcccagtgccctttattcatattctcagcacttgtatttctaagttttatgtttgagtcttcggggatacatcagagtagtcccccttgtctaataaatgtgtttacatttcctgccataccagaaacccttctcaaactttaatgaatttctacaaggtgagattactttaatgagaaaccaaccaaggaaaggagtatcatctgcaatatactttcaaatgttttttgcttgtttgtttcttgtccagctaaaa

SEQ ID NO: 248375 - DNA, 626 bp, Homo sapiens
ttagaaaaaatctcagaacacgaaacagaatgttaaattgtcacaggagagagcttatgcccttgaatcaagggaaaatagagttcacaaggagccagcggccggcagcatcacacttttatgacagacctggaaggtaaggtcaagggtgactttggtgggagtattatcagtgaaactattgaggaaatcatttctgctttatctctgtagtgcatgcctcattaaatacattattaaagctttaagatgaattttattaattggcatgtcacatccaatgaaaaggatgctagttttttgtgttgtttgatctttcataaggatttgaacagtcatatgtatcaagggtaaaaaacaaaaacaacaattataggctaaaggaaaattcacagagggaggtcaattgggggagggaatgccgtccagcaagtggctggaaaggttaataaacactttcaaagaagaccacagatatttttctttctctttaaagaataaagtttagccttgttcctcgaactcaaagaaagaaagtttgggtaagtctcattttgtgtgtgctcggttttacacttctgttggagaaagaattgtggtgaaattagtctggaggttttgtgcag

SEQ ID NO: 248376 - DNA, 360 bp, Homo sapiens
gaaaaaaaaaaaaaaaaaaatcatccaagaaccctgggacaatttcaaaaggtataatgtgcatgtactgggaatacctgaagaagaaagagaaggaaacggaagaagtacttgaagtagtcatggccaagaattttccaaaattcatgacaaagacacaaaaccacagacccaggaagcttagagaacaccaagcaggataaatcccaaaatatctatgtgtaggcctatcctattcaaacttcagaagatcaaagacaaagagaaaatctcttaaaatgccaaaaggggaaataaaacaccttacctatagaggaacaaggatgaaaattccaggggacttcttatcagaaaccatac

SEQ ID NO: 248377 - DNA, 222 bp, Homo sapiens
ataaagaaagtttgctttaaaaaaacaatggttatcttcaaaaataaaggggagaggcagaatttatataaaaagagttatatgataaattcttgtcctgaaataaattaactggttgtttaaagaaaagaatgtttgtaataagtcaaaaagttaaaacatgtttaaaaaattgtctgcaaaagtcataaaagaaaaaattttattaaaaaaattttaagc

SEQ ID NO: 248378 - DNA, 709 bp, Homo sapiens
tatttttctgcacatctctatttcccctggaaaattctataagtagtacccctgggtcacagggtcacagttagcaggtacagccagaaagccttcttgagggatgtgccccctaccagcagagcatgaggggggcacatggattgaagtttgtcatgtagcaatatcaacctggtcccattgaatggctaaaactctctgcagccagtcccagttggcccccagggatggggctgcccagccccagtaactgtgagcaggactctgtgtgcccatgcaagctgggagtacagcaggcaccctttgcctgctggcgtggcacccccaccagcccccctgctcagcaaccaccctggcttgtgacccttcatactactggagtttccaagaatggcatttgtcccagagggtggttgtcaccaagcactgtgaatgaacaacagaaattgcttgggtcgtgagtatgggccattggacacagcctttgagtgggcaggcaggcatccccagtccagtgccagcagggcagccaggagccccagttcagtggctggtgccaggcctgtgggccagctctgggctgacacagctggtctactgtcatatctctaatttgatcccatccctcatcccacgctatctgtggcctggtgtcatcctatgagcgaatggaggaccagcatccctgaccctgggatactggcagtga

SEQ ID NO: 248379 - DNA, 332 bp, Homo sapiens
ggacatgatgtaggctccaacttcataggcagtgaaaggggagggcaggccaaggagagaccaaagaagtaggtgctatttcctcctacctcaattccggaatctaccccagtctgtgcccaggcttctagcatttgtatgcacgtgcccttacccacactgtgcttttctatgtccaagtagctgtaagttgtgaaattgggtgtacacaaatcatagctagaatcaaaagtgttcgtcaaatgtccaatttgtgcctttgcatactttcgacaaagctttgcagggtaacccctctctggagtaaagagcaccctctttattccccacat

SEQ ID NO: 248380 - DNA, 484 bp, Homo sapiens
ggccacaaattcttcaatactcttctatggagagatttgagggctatttcccttcatcttgaatttaggcaggcttgttcagggtctggcttttaagaggagctttcaccttggtctgtggaagtcctgagtcactgtgtacaaagtccatctaccttattacaccatctggagagagctgagactacagggagagggggagtggcccggctgatcccagtcttcctagtgaccctgcccaggaacttggcatgtgagtaaagccatcttggaacctccataccagaccagccacgagatgaataatactaactgatcccagtcaatgccacatagagcagaagaactgcctaactgaattctttccaaactgctgactcaaaaatttgtatggtataataaaatgtttgttttaagtcactgttttgttaggagtaataagcaaccagaataaaattctaatctttatcatgtaccgtgctga

SEQ ID NO: 248381 - DNA, 476 bp, Homo sapiens
gagcttaactacatctgcaaaattctgttcaccagaggcaagtcatattcagggaaagagaagtgtacaaagtgagaacaccaaggtgcaaaaatcactggagctaccattataattgtagtaataaaattctcttctaatactaggtctcaaagtttcattgtgaatcaaagttcaattttacaaagtaaaaattacttattttgcatctattgagatgatcatttaagaaaccatttgttacttgtgttgaattgcattacattatttactcttgttaatctaaccttgcatttgtccgataaactgaacttgattgtgataatactttgtttttattcattgctacttttggtatgttgatattctgcttaggactcttttaatctgtcttttcatgtgatgataataaagagaattttcaatactttaactccatgtacactctgccattatccttagcaaactatttcttt

SEQ ID NO: 248382 - DNA, 1065 bp, Homo sapiens
cggggtgctcgtgggcgccctggtggggcccctctcggtagttgagagtcacgtcctttagttccccatgatttacaattttggaagggacacaaagaaacatagacttcccccatcccagatgattccgagtacatagtctgcagataatacttagcaaaacgcagtctacagactcctaaagcagcttgtctaggaagaccacccatgtgggcttatcactccaggttctgtgacccgggaccttctgagaaaacagcactgctgtgaaatatcttccttgaagcctgtgataagtctccttgttagaatgactccaacttcctgccaataatctttgtcctctccataggagatgttctaggggatgccttccttccctccatttcacaaagaggccagacttgaggactaagtcattagatcttatcccttagaattttgcatatcagcatctgctaacctccacaacacaccctggcacagggtggggctgagggccccaggaaacaaagattcccaaaagtgagagggatgagtcattatttcctagagatgactgttgttttagagaaccttggtccaactctgttctgacaaggttttaggaagatggcaacaacagtggcagcagtgtactttttggatctttctcataaaaaaacaaaagagcaagtaagagagggaaaccaaatatccacatgcaacatccgcaacaaatctagtatgtcaaggtttgacatactcccatggaccccaaagtatgagccagtgagaatgagtcatcaatacctcaagacccatataccagcatctgtgcagaaggatgcagaaggaagcaaagggatgttggatggacctaagaagaggagatccccaagctgtctacagatccttactggaaggtatggtgcaccaatttgagaacagcagctgaaactgggagggacctaacggagtatttcccagtcctctcgcccattctgtatggtgagcacataataggtacttatttagtgtttgtcgaattaataaagttcaaatgacatttccctggagattctt

SEQ ID NO: 248383 - DNA, 372 bp, Homo sapiens
taaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcggcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaa

SEQ ID NO: 248384 - DNA, 1136 bp, Homo sapiens
ttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctcccatttcttgagacactaagcaagaaacgttagcaaatgtatccgctgtcaactacgaatttgaggatgaatacttcagtaataccagtgccctagccaaagatttcataagaagacttctggtcaaggatccaaagtgagtgtc

SEQ ID NO: 248385 - DNA, 1092 bp, Homo sapiens
ttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactgtgagtgccgcctgggccaggctggggagagggtgtggtgggcgtcagctggcatcttcgttccagctggaccacgccacagcgagcccgagagagggatcaggaattggttctgctgtatgaggtgtgtgagaacaatgccgtgctgcctgacctgaaacccagctgcagggatctagaacaaactctaaagagcaactcccatcactgtggttccacccagtttgcaagagggtctcccagtcttgcggttcaccactttctggggttcatctttgccgtgagcacatctgttttctgagtttcctgttaagcttcaagcatatgtccttctcccctctcactctattcctttcctctctctgtttgtttttctgcctttcttcctctgttctctttatctcttcccccatctcttccccctccatcttaaatgcacgaaccccatttttaactgttaa

SEQ ID NO: 248386 - DNA, 1131 bp, Homo sapiens
gctggtacggcccgggattatgggaatgtgactgcatgaggctgtacgtatctgcagcctgccccttttcattggtgtttatccactcacacagtgatgagcagtggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaactcctatttgtttatggcaagagacaaggtctagctctgtgatgcaggccggaggacagtggtgtgatcacagctcactgcagccttgaactcctgggttccagcaatcctcccacctcagcctccttagtaggcgtggctacagtaatggaagacagcaaaagaagtttggagattcctggtttaaagcatttaaagcctctgtgaaaatttgcccaggccaacaacttcactttccacactcagtgccacgaagtgcagctctaagctggggatttctgtgcagagatgatccactgagtgcaacccaccaccgtgcggacaccacccctgcagaatcatctgtgaaaacaaccccaggcccagacataggggccagctaagcttcgtagccctcgaaatacagggagtgccccctctggaccctcgagcccacagtccatccaccacagaggtgtctgctgctcatcagatagttcctaccaagaaaatgctgtgtgaacccatctgtgtggcaaaccggcacggggagaaagctgacttccaaggacgtctaccaactgtcacttgcaaaccagaacttgcctctttgtagatgaagactggcagggctgaagaaatgatctcatgttgaaattaatgatgagcttcagggtgaggtgactcagttcgaatgctgttgaatgttggtgtcatgggacttttacaagaagtaaaactgggctataaaaatgatccccttcccctcactagagaagggaggttctattcctctctctgtctttccctctctctatatataccaaaggtcaaatctttggtattttgcattgagtctttaattattcattcactttgacctagtaattgcacttca

SEQ ID NO: 248387 - DNA, 590 bp, Homo sapiens
  misc_feature (92)..(92): n is a, c, g, or t
tcatgctggcatcattcattctccacgcatcagatgatcctgtggcccctcagtgccaggccccactggccctctgcgcacatcagtgactntgatgttctcccccaccgcatgctgccaatctgatggtggagacagaacagcagtcccggatggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaactcctatttgtttatggcaagagacaaggtctagctctgtgatgcaggccggaggacagtggtgtgatcacagctcactgcagccttgaactcctgggttccagcaatcctcccacctcagcctccttagtaggcgtggctacaggtgtgtaccaccatgtccagccctaaatttcattctttttaatttcaatattgttatgtgttttctaatgttttataacttattggtatggtagatgtacatgtatacaaattaaaagaaaatttatatatattttactggg

SEQ ID NO: 248388 - DNA, 427 bp, Homo sapiens
ccaataccacatgttcagctgatttccagtgtccaaaattgcatttcacgttctcattctttgcccttgccaatttctttctttttaatcccctgtagttttaaagaagtaaattggaagtgtgttcagtttaccatttcaattcagaatctttactcataggtgctttaaaaaaaaaaaaattggtgaaacgttgcctatgaatagattgatttggaagttaccattttgtaatctaatatatcttttttgaatctgttcattttaaaatagttgtgaagaaaatgctgattattaaaatacatgtctgtcattcttggaaatttaagactttcagttgatagctgagaaaccctctttcccagaatctctagaaagcagcagccataatgattcctacaaataaataaaaagccatctttaaaaa

SEQ ID NO: 248389 - DNA, 413 bp, Homo sapiens
gaaactagaaaaacaagaacaaactaaccttaaagctagaagaagaaaaaaaactaaaattagagcagacctaaatgaaattaagaaccaaaaaaagcatacaaaaaatcaatgcaacaaaaagttcgctctttgaaaagaaaaacaaggtcaataggccactaactagattaacaagggaaaagacagatccaaataagcacaatcagaaacaacaaaggtgacattacaaccgatctcccagaaatataaaagatgtccaaagactattatggacacctctgtgcacacaaactagaaaatctagaggtaaaagataaatttctggaaacatgcaatctccaaagattgaatcagaaagaaatggaaaccctgaacagatcaatatcaagttctgaaattgaatcagtaat

SEQ ID NO: 248390 - DNA, 386 bp, Homo sapiens
atgatcagttcggcacatccagaacatggaatagtgtgccctggcctgggacaggttgaatgacgctatggtagaatgaaatcttgggcaaatcccaaaagttttataatagagagagctgtgggatttatcaaaatggatgaacacgattggctagtgctgctgattaagtagtaggacctgcatgggagtgcttttatcaaaactcaagtgatatgggtgtgcccctgttagaattagcctaatctaatcaaaatcaatctaatgtaacctctactctgattcaccatagaaatgtgatataaaatatcagcattttaaaatagtgctatttacattctattgtatactattcattaattaggaaagacaattattttctgtaa

SEQ ID NO: 248391 - DNA, 620 bp, Homo sapiens
ctagcaggccggtccaggggtccgcggtagattttagtcatggactgcatctggggctccatttgaagaatgagttgtggctttacagcttcgattctggaaaagacaaacttaacaaggaggttaaagatacagagattgaaatgtatggcctgcagtgcaggggattatttctttggcacacttcacaggccctgactatctgcttgatagttttgaaaaggcctggtccatctcctcattcttaaaaaatgagattgaattttgattagcccaggaaaattgtctatgtgtttagatttctttctttatagtgtcatttagtgttgttctctttgttgcatattctgtacaagggaatttgagtccagaggctctgttaggtcagattaaacattttggggaagaatactttgtaggctatttgtatggcatatttcactgtcagaaaacatttaagtacaggtccttgcattagtgaaactaagtttgatcatttgggtaagctggtaaccgccataagtccattgtaaagatctaatttgtagtgcataaataatctatggagagactttgacctctgaatatttataatcatgtgtattttagctgtggattga

SEQ ID NO: 248392 - DNA, 425 bp, Homo sapiens
gcgctctttttcttcttggcaatgattcataagtttgagaggctatagggttaaagagggaaagcgttctctttgccctctaaaagttcactaaaaattaactgacagaaggtagattaataggataaaaaagcatataaaatttatttcatgtgcatagtaagcacaggggaattgcaggagaatgataacccaataaagtccagatgcttatatacctacccttctttaacagggaaggggagatgaaggttataagagtaaattattttcaggggaaaagaatgagcccaaatgctgggtgcagttgctcatgcctgtaatcccagcagctgggagtctgagggaggaggattgcttgaggccaggagtttgagaccagcctaggcaatgtagctagaattcatctctaaaaataaaaaatg

SEQ ID NO: 248393 - DNA, 585 bp, Homo sapiens
gtccctctgtgaaacacagaagctataattccactttggcactaggtcatttttgttaatattttggttactcaaccagagtcaattgttttagtttccctatctgtaaaggaatatccaaaaagatgaatactgaaactcagataaaaaaaaattcatcattgaacaaaaggattagaattacgcccaacaagaaaactttgtactgtattagaatgatttaaaacaattatcatatttgtaatttattggccataaaattacttcctcattttggaaatattactttgctgtttgcctggtatttaatgtggtatcttttggtttggtatataccatacaataataaaatattagacaacatggatgattaattatcattcaaaaaaattgtaattctatgatggttaaattctcacttgcatttatttcatgtaaaatatgatataaaaacaaaattagcttacccctgctctggtttaaggaagattatactttaaaagtatagtttgctaaatagtttttaactagttaacatccacgatcatttatttgtaattacatacaagttgtttttcattattg

SEQ ID NO: 248394 - DNA, 470 bp, Homo sapiens
gtgtcagtgggtagtgttccttctagtggctctggggaagagttcactttcttccctctttcgttctgtatgctgcctacattccttggctcatggccccttcctccatcttcaaggccagcagtgcagcatcttcagatctctctctctctctcgctgaccctcctagttccctcctacaattacatcagacccaactggatatttcaggatagctttcccatctcaagtacctaaacttaatcacaactgcaaagttctttttacctctaaagcaacgtattacaggttttggggattaggacttggacattgttggtgaggccattgttctgcccaccacaggaggcaacatatagtgttcatcttatgctgattgagtgtctgccatgtgctatgcacttttgctttctttcacacagttaagaagtggtgaactaggatttgaacccaggcagtctggctctccc

SEQ ID NO: 248395 - DNA, 352 bp, Homo sapiens
tagaaaaactcacctgaggtgatagaactcaggaaagaattataaaggggagaaggtcattttagtaatggagactaaactgtaatgagcttgagcaaatacaggttgagtattctttattcaaagtgcttgggaccagaagtgttttggacttaggatttttttagattttggaatatttgcattatgcttgttgagcattcctaatctgaaaatccaaaattctccaataagcatttcctttgagcgctatgtaggcactcagaaagttttggaatttggagcagtttgaatttcagattttcaaattagggatacccactctgtatgtacagcagataatgctttaaga

SEQ ID NO: 248396 - DNA, 719 bp, Homo sapiens
  misc_feature (509)..(509): n is a, c, g, or t
  misc_feature (719)..(719): n is a, c, g, or t
aaaaaaaaaaaaaaggtgctgctttcctatctggaatcccagagatccatcctaccaccgcctatttttgttgttgttgttctccctggcacagttttgcagcccctgctgttcttctagattatgctgcaacttcacaaattctcctacgtgactctgaaaaattatagacagtgcaggtctgcaggtgaactgagacggggagtagagggactccttgaaacttcagggtggaggaatatggggagcctagagacagccggtgtttggtgagtaatttgatcttagataagcaagagttaaggaatatcttccaagtggttttcccttgggcggtgttcaaagaaagacactcagcagagtcaaagcttagataggttcctgggtagcctttaccctgaggatctgaagggtctgaggaggcagcaaccacttggaacaggtccagaagcatctcatcaacaaccgactaatcaccacccaacaatgactaatcaaactaacctcanaacatatgataaccatacacaacactaaaggacgaacctgatctcttatactaggatccttaatcatttttattgccacaactaacctcctcggactcctgcctaactcatttacacccacccaccaactatttatcctccatgcccatcccttatgaccgggcgcactgattataggctttccttttagattatgccctaccccttctn

SEQ ID NO: 248397 - DNA, 880 bp, Homo sapiens
atgcagctaatcctgaatcaatgggagcacactttggctaatgcctctgtaggcatgcattgacagatgatggagacctagaagggcagcactgatttgggatctgcgggagtggtggcaccatttggcagggataagaagatggtagggatcctgaaagaaaagacagacatctgccttgaaggagagtataagataacttgtcttctatcacaatcttgctgaagttattcctggtcattctactgagaatcttcgtatttgcctcacaatactagaatctcagccagtcagaaagcaaagaattatgtgagcctgtatggaagagggaataccaagaaataaggcagatgaagttattttatttaatagtaacagcaacaacaacaataaggccaactgtctttgctcaagctgttaactcttctccgcttgtagctatagcaccacctggagggagagtgggaacgtgagtctggaattgaattattttattttctccgagaaaccactattagctaccattaagcagcaaaaactgtttaattcaaaagctatttctagtctgatatactgatggatgtggagaataattgtacactggatgagatttttgtggaaattgataccttaccttacttattggccagggaagccaatggaatattaatttggatcccaccagtaagaaatttgttgtaatttactaaaaaacaggttatctacctttacctgtatgctgcctgtaaaaaaaaaaaaaaaaaaaaaaaaccaaaaactttcccaacaaattatgtaattaaaattctgtttacaataacttgacaaaaggaaatgtcaggtattttaaaagagtcaaatcagttacaaatatgttctt

SEQ ID NO: 248398 - DNA, 655 bp, Homo sapiens
gcctaagcaatcattcaatgaatatgaaaaactgagaaggaaaagctaagaaagtagattcaataaaaaattaccaacaaacatgattagcctgtttaatttttcctcacctcttaagtatggacctaaataattaacatcaaatacacgaggtataattttttgaaaattattaacttcctccaaaatgcagcaggaggaattgtagaaaatccttcgtggagggtggaggtcggtgctaacttcaatcatgtttgaacaagattccaaaagaagtatgacgtctctttgcctagaaaactttcaagagaacagccacttcctaccccattctgattccttattcttcaaagtctgctgggattccctatttgagaacgcccagaaacgagagtgttttgcataagtagaaagaagaaccccatcagcgcagtcttctcaaaggatttttccttcatcatatgcctgtccccaaataacttcagtacttcctggaaatgagaactttctcacaaaaaaagctgaaaaatctcattgcatcttaccgttttcctgaaacttaaggaatcaattattaaaaagaagtcttagggtccttttcaagtataggattccagcattatgattaaacaagggaatttttcttgaagttgga

SEQ ID NO: 248399 - DNA, 420 bp, Homo sapiens
ggttgctcaggaggctgaggtgggaggatggcttgagtgtgagaggtcaagcagtgagctgtgttcatgatgctgcccttcagcctgtctgagattgagactctgtctcaaaaaaaaaaaaaaagaaagaaagaagagaaaagaaaagaaagcaaaaagaaagaaaaaaaaggaaactatgccaggcagtagacaataaaatatctttgaagtaggaaggaaaaataaccatcaatctagaattttatatagagtaaaatatctacaacaaatcaaggtaaaactgatacttttcccaacaacaaaagttagaggaatttatcactaactaaattgaactagatgaactattacagtttttaagcaaggaagctgttatttgatggaagctaaggtatacataatcaaacaatgattacc

SEQ ID NO: 248400 - DNA, 440 bp, Homo sapiens
ttctaaatggtttatcatctgtttgatgcactaactcttttgggctcttggatgttggacgctggctcttacaaaaagctacacacatctacattatattcattttattttaacacacacacacaaatgaatccctgtgcccgggattgcactaggtaccaggaatacaaatacaaacatagggagctcaaaacaaaactagtgagaaagatgggaaatactacagtcatagctataaagtaatgggctaagtaacacattagcagaaataaatcatagaatacagagaaaaaaggttaaggtttgattgcctgccatggtcagataaagttccacagagacgatgaactgggccctcagggatgaataggagtttcccaagccaaaagaaaggaaaatgagtaaggggaagctagacctgaggctgagtcagtctggac

SEQ ID NO: 248401 - DNA, 428 bp, Homo sapiens
caggcacagtagctcaagtctgtaatcccaacactttgtgaggccaaggcaggagaactgcttgaggccaggagttcaagagcagcccgggcaacataatgagacctcatctctaaaaaatataaaataattagccaggcatggtggcacacacctggaatcccagctatttaatacttggggggctgaggcaggaggaaggatcctttgagcccaggagttcaagtctgcagtgagctatgatcgtgccactatactccagtctaggagacagagcaaaccttgtctctgaaacaaaattaaaaaaaaaaaaaagagagagagagagagggagaaatgtattagtgagggaccacctaacaaggttttcaaaattcttgtcactcccctttgtaggacaggtatgactacaggaggaagtcaatatt

SEQ ID NO: 248402 - DNA, 811 bp, Homo sapiens
tggacttgagtgtacttggccgcactcgggtaaaccaggcttcaccaggtagacgttctcataccgtaagggtccatcatcaaattacctggcagattgaaatcttccagggaaaatgaatttggaaatgtaaacaccttttctttctttttacttaaaagcctcgatggtagaaaaagaaataatacttataaatgatcggcacgttttaactttaaaagcttttgaactcaagtgaaagacacacgttggaaacagaattgatagttttaattctacccattttcacctggcacatcagatcagtggcaatcatttattttatggggtgtggaggggaaagggatagaaagcggatagaaagctagaatccactgaagtccctgtcctaaaaatctcagagctgtgtttacttagcttgttttaaaaaaaatctcgccgccatgtatgacaagtgttactgcaagaaattcatcagccttctacagatacttccagttttgctgtaatgatctgcagaagagaactgccatcactttctcacatcccaaggtgttgcaggaactcagagagaggggagagtggctgaaacgcttaattaccggaggcgaaggaggggcgcgcgggggaccgaaggagaggggagtgaagaaggaaggtcctttaccaggcttgtacctggagaaagctttgaatcgcttctctgctatatttggaaaaggtatgcttgctttttaaaaaaatgcctttagggcaaagtgatacccttgtgtaataattaactcagacaataaaaataattggaaaatca

SEQ ID NO: 248403 - DNA, 617 bp, Homo sapiens
tggacttgagtgtacttggccgcactcgggtaaaccaggcttcaccaggtagacgttctcataccgtaagggtccatcatcaaattacctggcagattgaaatcttccagggaaaatgaatttggaaatgtaaacaccttttctttctttttacttaaaagcctcgatggtagaaaaagaaataatacttataaatgatcggcacgttttaactttaaaagcttttgaactcaagtgaaagacacacgttggaaacagaattgatagttttaattctacccattttcacctggcacatcagatcagtggcaatcatttattttatggggtgtggaggggaaagggatagaaagcggatagaaagctagaatccactgaagtccctgtcctaaaaatctcagagaaattaaagacttattgaaacacaaacattccatcgctccatactctccgtccagatgaattgaaacttataaatccacgctctccccaattttatgttttttatttattttttttcagggtttgataggaaagatacccaagtctgatagggaagacagggccacttctggactagctgtgaggatgtgttttcatttccataacactgaagc

SEQ ID NO: 248404 - DNA, 343 bp, Homo sapiens
aaaaatacagtcagcatcttcccctgtttctgaactggactaactggacagccataaaatttatgtgaaagagactaataacaaactaattgttaaaaggattaattcttaaaaagtatttttaattttgaaaagtaatacatgcttattataacaaaatcaaagtgtgctgattgaggacgtaaaacatttttaaatttcatgctcatctttctccctcccccagcccatctcctgtgatattcattgttaacagttctatgtctttttctagatggttctgtgtttaccaccctattgcatgaaatgcctaaaaatccagtcaagtgaattttgccattta

SEQ ID NO: 248405 - DNA, 462 bp, Homo sapiens
ctttctcggggaagatgacacatctgaactgaggtaccctccaaagcctgttccgtaaaatcagcaaacaactgacaggataacttcaggaagtgggtattaattctcacggtataagtgaagacattaagcaccagagtttaagtagcttgatccactgaaagagattcaactgtgtggaacctatgccgtggagaattgctttctgccattgttatcgtccagcagttgccgaatagctctgacctgagcaaagcagtgaaacgcggtgctgttgagtgggttgccactgcacctttttcaactactctagtcttgtggagaaaataccccttctaaattttttcttcattgaatactctccctcagctccagagtaccatatagagttttcttgtattttagagttactgttttatcaaagtttaccagtcttttgtattacatttctcctgtctaaaa

SEQ ID NO: 248406 - DNA, 430 bp, Homo sapiens
tgcatactcactcactcggggctcatgtattccccacagacaagccaaaccgcagtagagatcaatagccatgtgcaccccaaagtatcaagacacaatgggggctcgggggacgcggaccacgctgtcccgggacaggctgtgagggcgcagacatgctcgtaggagacaatcccagcgtgtgcaatccaagagagctccaggaattcgtaggtggaagggacggagagataatgcagcccagtcccaccccccttcaatgactcacaaccagagacatacacacatcgactttcctggtttaaacacacacacctcccctgagatctagcttcaaaacaataagggaaataccaagtgcggaatgcatttcaggggctttccaccacccgggccagttcctaaaggggatggggggcggggtgggggg

SEQ ID NO: 248407 - DNA, 392 bp, Homo sapiens
atttggtttttattctgcaggctggagtttatgattttttgcctgcatccccaagaaaggcacatgctctgataattcctgctgtattctgttagaagaaggcaggactaggcgagagccaccgcacccagcggaaaactgtctatttttatgctgaggttcaacaaagtgtagatagcaacgcagagaaatgattggggaaaagggcatgatctaaggctaacaggctgagtggggaaagccagcagggcatctgcttagattcttcctggctttcctgtgcagcatgtcttctggctatggggcagcccctctacggaatggtggggggggttcttatgacctaccatcaaaaaaggtaggtcagattatttatttatggtcagttttta

SEQ ID NO: 248408 - DNA, 394 bp, Homo sapiens
gctcgacctaaccaacaagcccctttctaggtccagggaaaatccatggcactctttcccaccaagcccagcttctcaagtcttctttactagctcataagataaaccaatggagggccgggcacgtggctgatgcctgtaattccagcacttttggaggctgaggcgggtggatcacgaggtcaggagctcgagcccagcctggcaacatggtgaaaccccgtctctactaagaatacaaaaattagccagacatggtggtgggcacctgtaatcccagctactcaggaggctgaggcaggagaatcgcctcaacccgggaggcggaagttgcagtgagccgagattgtgccattgcactccagccggggtgacaagagcaagactccatctc

SEQ ID NO: 248409 - DNA, 441 bp, Homo sapiens
atacttttaaatttgacatataatgacaatacttaaggcagccatatattttatgaaattgagaaaagttaaattgattgaaaattactaatgtttctgttgttatctggttgatttgagatacccatgatttgtaaattaaaattcctggttgtttaatgaaagaacttttttgggtgcgaatgtatggattatatacatttgtatatctaacttattttaagcaaaaagtttagcaacatataaagtaataaaaattgtattgcacatgtaagaatagggctatagaaggaataatagcctagattttatgatcatgtaaatataacatgttttactgaagtttttaattagtttctgtgtgaaagactgtgtttaaattgtacattgtcaaaaatgtgaatgagttaaataatttattataaagaagattaatactta

SEQ ID NO: 248410 - DNA, 347 bp, Homo sapiens
tggagttaaaggttttatttaagttacgctggacacagttgagaattgtcccactcctctttccttgcttcatgtggagcattaacatgaaacacacatggttataacagcacttcaagtggaatcaagacctccacagaaagaacatttttgtgtgctttggttcagaaagaacattgttctttttttctcctgtttgctgttagagttgctgtagataaaaaggttctaaggttagaagagagatggacttcaaactgggagatggccccagcaggtctcgatggcttttattttccagctattattgggacaggaaagtagcgatgtattattaaggtaaaaaa

SEQ ID NO: 248411 - DNA, 205 bp, Homo sapiens
tggagttaaaggttttatttaagttacgctggacacagttgagaattgtcccactcctctttccttgcttcatgtggagcattaacatgaaacacacatggttataacagcacttcaagtggaatcaagacctccacagaaagaacatttttctgaaccaaagcacacaaaaatgttctttctgtggaggtcttgattccgtcga

SEQ ID NO: 248412 - DNA, 464 bp, Homo sapiens
tgctaattttaaaaatgtaatatcgtttgttacttataagagtgggactgcttaaaaatgaattttattttctgctgagatgatgtagaatgtgaatgtattaatagaaattgattcacgtttccaggatatcatattgagaatgtgtatcgagactcttcaaagtgtagatttcctttgattcaagaattctaggaatcctcacttaggagttaaacacaaaaatatgtattcatctcagtgttgttcgttcgataggaaaatatcggacacattattaatgacaacaacaggaatatattttaataagttatgatttgtccacttgatgaatgttatggatttatcaaaatcattaaaagagtagttgataacattgtaatatttgcatgaataaaatagtaaatgaaaactcacctgtatgcaaacctacaggtactttacttgctcaatgttgtgaaaag

SEQ ID NO: 248413 - DNA, 752 bp, Homo sapiens
tcaaaatctctgccagtagagctgagcatcagtgtttattttatttgtaaagctcccccatgtgattctaatgtgcagccaaggttgggaacctctgccttaaataatagataagattcaggtagtcagaaaggggaggtgctggggtagagtgagctgcagctgaagaacaaacaggaggataggctgcatcgtcagagggcacaggctgggttttgccttgtaacaagagcagagggtttgggcactcattcatttgacaaacctttatttaatcacctcttctctgctagtcactgtgtaactagttgcgctggagattcaagaaaacaaaaacaggtaagagatggttgataccctctggttgttcacagtctacttgaggaaacagataagcatgtaaaccggacttgcagtaagagcacagtgaatgaagtaagtctagaggagatggggggtcctggcactaaggaaggttctctagcgatgaatgaggcagagcatgaggcagagaggagtggccgaggccttcacttgggaaactcttgctattacaaagtgccttctagcgagggctggaaaagctagagtaaggctggttatacttggaagaaggaagaaaaactcgataaaaatattcacatttatacaatttctcctcaaatcctcatgaagtctggtcttacaaactacaaatgggattatataaattttcaagtgccctagaaagagtaatgaagtaaatgaatcct

SEQ ID NO: 248414 - DNA, 365 bp, Homo sapiens
aagaaagatttgggaagacagggaaaaggaatcaccattccttgcagagtaagatatgataagctcagttttagatatctcaatttgttagtagtatctgtagtgctcccagatagaaatattcactgggagccagaaatgcaggattggaatttgagagaatgtagagcttcaaaatcaaatgagaattagtgtgttagttctattatatcagtaagtggaagcttgtaatgaaggcagagcccagaaagtatgtcatagagctataagaggagaaggccaaggacagaacctaattaaacactagtattaagggacagtcaaaggaagagaaaattaagaaagaataaaggaaaaggaaaaaa

SEQ ID NO: 248415 - DNA, 454 bp, Homo sapiens
cagtttcagcttgttggtaccgagaattgaaatttgcattgactgtggcagtgtaagaaatttttctgagaaggtagttgtagataagtaattacataagagtgaaataataaggtgaaccagtctgaagtaatagttctgaacaagtctgccaacatttgagacatgtataccattatctcagcagaaaaaaataaaaaagtgcggtaataatgttgaaatgggactggagatgtcaaatgggttggtttaaaaatatccctaaactgctttagaaactaaacgttggagttgaataaaagtgaatctggatttcctgaatagcaccgtggcttgagtgtgctgtcagtatgtaagccagtccaccaacttaagacagaagtgttgctattccataaatacagtagaactccatatgctgagtttttcaatttcttctgttagaaagtttgga

SEQ ID NO: 248416 - DNA, 409 bp, Homo sapiens
gaaacaaaaaccagtccagtttctactttagccctaaattggaaacaaatcaaatgtccttctatacttaaaaaggcaaattgtcagtttttcttcaaatacaaggaatacaaagaaaatacattttttttctacaaagaaaaaaaagttagctaggagtggtggtgcatgcttctattcctagctactctggaggctgaggcagaaggatggcttgtgcccaagagttcaggttacagtaagctatgatggtgccactgcactccagtctgtgtgatagagtaagaccctgattctaaaatttttttaaatttcttaaaagagatttgatatttctttggtatctaactttattcaaagctggagttgcaaatgatttcagcaaaaaaaaataaagatgtgcttgata

SEQ ID NO: 248417 - DNA, 478 bp, Homo sapiens
ttattatttatttatttatttatttatttttgagacggagtctcactctgtcacccaagttggagtgcagtggcatggtctcggctcactgcaacctccgcctcctgggttcaagagattcttcggcctcagcctccctagtagctgggactacaggcacgtgccaccacacccagctaatttttgtattttagtagagacagggtttcaccatattggccaggctgttctcgaactcctgacctcatgatccgcccaccttggcctcccaaagtgctgggattacaggcatgagccaccacagctggccgtaaatattttttgaatttgaatctgttttggaagccaaatatgttttggaagccaaacaattaagagaagtaaaattttaaccctagtaggtttcgcagattcatccccagatatgtttttgtttggcttgtgttattaacaaataaatgagtgtctttcaaatgga

SEQ ID NO: 248418 - DNA, 449 bp, Homo sapiens
gtcatcatgcaagtgtctgtctgagcatggccagtaagagaactggtggtttcggtccatgaaagagctggggttcctggaagtttttggaatgcctggccacgacattggttggagtctgactgggccccatgcagaaaatgccacactctgctgagctgacatctttgtgttctgctaggaggcccaggaattcataaaagaaaagaactaaggcacttgaaaatttcgaaggtaaaactgtcacccgtgcaaatcaaatcaaaattaataatgtttttctgactcaatgcaaaaggcgaaaacaccaatttagttgttgctgcggctgcttttcatgcagtgctttagagttacagatcccacatgtggttgaaaaccggttactttcctgttggcttaaactcaaaggcatttgtatgtgtgctaaaaacatttcttactatgca

SEQ ID NO: 248419 - DNA, 426 bp, Homo sapiens
agatgagagtgggctttaaggctggaatttggaaatgcaaagagctgagaacttcataaaggaggctgagcccacaaacacaggggaggatacctggaggcttgtgagataggggctggcacagtgagagactaggctgggtggctatagtacaggagtgatcagaaatgagaggacaggctgggcgctgtggctcacgcctgtaatcccagcactttgggaggccgaggcaagcggatcacctgaggtcaggagttcaagaccagcctggccaacatggtgaaaccccgtctctactaaaaatacaaaattagctgggcatggtggcgcatgcctctagccccagctactcgggaggctaaggtaggagaatcgcttgaacccaggaggcggaggttgcagtgagccaagatcacaccactgcac

SEQ ID NO: 248420 - DNA, 271 bp, Homo sapiens
gtgagctatgattgtgtcactgtactccatcctaggtgacagagtgagctctgtctctaaaaaaataaataaaaacaaaacatgcatacaccatctgacttcaatggttctcagccttacagtgagtaaagaaaaacgatcattcacttcccagcaggcccaggaaccttaagactataagtaaaatctaaagtttgcctctgtttggcttcctaatttcaagaggtttttaaatctgagattcctataagatcaatgtggggggaaaaag

SEQ ID NO: 248421 - DNA, 237 bp, Homo sapiens
cattaccaatctgttaaccaaaaagagactaaaaggctgaccaccctcatgttgataaggtgtttacatgttgtgggtaggaaagtaaatttaacacgcacaaactctttcacacagctgttcagtttctagaaacatcttacaatgactctgtacaaggatttgcattgcagcaatgctttaatcagtaaaagcttggtaacatgtagaatgtccacctacaagaaacaaaaataa

SEQ ID NO: 248422 - DNA, 426 bp, Homo sapiens
tatgtgagataaatgacttcttatttaaaatataaagaagttccctggtagggcccctcaacatctggctgactcaaatgcctgtgttctccagggaacccaggaaacaggtccacactcagagagaaacttcatctatgacatgattccagtcagctggcatttacacctctgtagggaaagaaaatgaaacattcaaatacaaaggggtccctggagaaactcccaccggcctgagcactgggagaacaggttgagccatggaagtttctgccggttttagggggtaggagtctgtcctttctttttccggggtggtaactgggaattctatctgtgagatggggatctgttaacaggaagctctcttgctttgctgagtttttttccttttcacccaataaattccatttttctcacccttca

SEQ ID NO: 248423 - DNA, 414 bp, Homo sapiens
ggttgcagcgagctgcaccatctcggctcactgcaacctagcccgggtgacagagcgagactccgtctcaaaaaaaataaaaaataaaaaagctcagagattttaaaaaggatacccaaatgattaaaatggtacattgtaaaaactaagtaaataaataaaataaaaaataaaaccaacataactttagtattctctaacagagagggggaaaaaataccctcatcttgaaaactttaacctagaagtgcaaaaaaggcctaaatcctattgacacatacacacacaaaaacagatagtgtatgtggctttattttttcgtaatatttcacacatacagaaaagtataaattcctatgtacctaacacatagctttaccaaattttatcattttgtcatatctatttaaaaaa

SEQ ID NO: 248424 - DNA, 524 bp, Homo sapiens
tggttaagccatctttcactttgcctctctctatctccgcctatcatctggtgccagttgcatgccacagacctaggcagaagatgaaagcagagagctacgagggattctatggtagttaaagtttgagcaaccaacaaacaaaatgaagaaatagaaaaaatagaaaatatcagaagtatatcagtgaggctccttgcgggaaacaaatgcacgttaggcacattgaggggagtttaataacaggaccatttataatgggaaaccccagggccagaggagagaattgctgtcacaatttggaagcttagtgcaaatggcagcctaagtaagagaagtcaacagtgactcccagaagctggagaagacacagtggcgattcctcagagattttgaaccagaaatgccactgagtcagcaatcgcattactgggtatatattcaaaggagtataaatcattctattataaagatacatgcacacatatgttcattgcagcactattcacaatagcaaagacatg

SEQ ID NO: 248425 - DNA, 328 bp, Homo sapiens
tccccagctttgttcagaggctgttggttacatagtacaggcctggcactgagtcctgtttgtagagaaagggtgagaagtgtttggggcctgcgagcctctttgagtatctggatgctgccctgtgggaacaggttattctgtttgactccaaggctagagtgagaaccagaggttaggagttgcagggaggcggagtagctcccggtgagcacgaccctatcccaaggagctttcacttgtggagcaggccgagggtggccgtcatcgtggtggaagcaagcagtacggggcctgatctctctctctcggtcttctgacccgagga

SEQ ID NO: 248426 - DNA, 366 bp, Homo sapiens
ttttttttttagacagtctcgctctgtcacccaggccggagttcagtggtgcgatctccgctcactgcaatctctgcctcccaggtttaggagattctcctgcctcaaactcctgagtagctagaattacaggcatgtgtcacgaacctggctaatttttgtaattttagtagagacggtgtttcactatgttggccaggttggtctcaaactcctggcttcaactgatctgaccaccttggccttccaaagtgctaggattacaggtgtgagccactgcacccagctagccttctttataaaaaggtggtactagatttggctccttggtcacagtgtgctgatccttgctctaggtggtactgg

SEQ ID NO: 248427 - DNA, 598 bp, Homo sapiens
taagctgatgtattacttaagcaaatgttttttctcattgtattgctggagttattccttctggaaggggttcctaattgacttttttaaaactctgaaagttttgttgattggttaacacacaaaaaaatgtagagacgagtgtcagctgaaatgtttatccaggactctgttagtattgctgggggatagttttcacctggaggtgaaaacgcattcagttaataatggaaggtccaactcttcatgtacagtgcctagtaatctgtcctcacattacactgaagaagtatttctgcctccagagaaagttgaaggacaatgaacacttgagcaatatgctttcaaaaagcaaaaatattttcttggaaaagctagcctatctgtaaatagtttgtgttcactaagaagaccatttctttggtagcacaagggagcaggccatttgctgaaacactggactgtggaatcacttttacccggacattgggttttctgatatccttttaaaaacattttaacaaataatatactcctttgtgtttacatgcaaaactcaaagaaggttacctatcctccatgactttttaacctacct

SEQ ID NO: 248428 - DNA, 344 bp, Homo sapiens
tagtgggaatggctgttggctgcctaactggctactgcaagctttttagggcagggtcttacctaactcacctctgtatccaggtggaaactagcaccatgctttgtcgggtaatatgttatacaaagaatttagattttatcctgtaggcagtggtgggactgagggatttggggcaagggagtgacatcttcagatttgcattttagaaaggtggctctggggtgaaggagggcagtgtggagggtgctggactagactccagctactacaataggctaggcgggaaggcagaagggtggggattagggtggcatttaaggaagacaattaggggtagatct

SEQ ID NO: 248429 - DNA, 441 bp, Homo sapiens
ggctcaagtgatcgtcctcctcagcctcctgagtagttgggaccacaagctcatgccactacacctggctaatttaaaatattttttttgtgaggaggtgtggtcttactgtgttgctcatgtttgtctagaactcctgggctcaagcgatcctcctagctcagcctcccaaaatgttgcttttgcctggcacaattgttagtaggtaaatttcacatcactgtttgttttgagggtttgggggttttttgtttgtttttggtggagttacacaagtccatcatataaaggtatgaaaagagttattgctattaggaaaaattcaagtcattataggtttgggcatacagggttaaccttgtgatgtacatccccagccctgaatttatttgattaatcctctttaaaataaaggattacattcaatcaatttgttaaaaa

SEQ ID NO: 248430 - DNA, 874 bp, Homo sapiens
ttcggccgaggagagacactctagagaacacacacttgcaaatatgcatttcagatgatttcttcaggattgatttcccagggtgaaattacctggtcaaatggggtagacgtttttaagacttgatgacaaagtgcttttgagagaagccaatcatttaaccccctctattttccattcctgaaacataagaaggtgctcatatgttgtcagtattttttacattttataaccgaggaaacaacatttggagaatgtaaatacttgcacaagctggtaaatactctatttgttcaattccaaatgacatgttttcccttacacagcaccatggttcagtgttgagatccacagaaaacgtgacaaggttggcctttgactcaggcctagcagccctgagaatagggatggggactgagagagagagacagcacgagctagagagagctgtggatccaggcttcagggatgcaatgaagcctgcaaacacctttctctcacaaggctcgagaacatccagtcacctccctgaccacacttctcagatctgctttcatctgactttcacgttctcaaggttaaccttgtcaggcttgatgatcaacaaggttgcaatgagtattcatagaaattggtacagaagttaatgtccagatccacatgaaacgcaggcagaaatgaagacagtgacacttaccaatcttgacagaagggacaaaagcttaaactctacaaggaaacatttgtaaccctcatcagcatggtgctgcatattgtagacaatacatgcactttaaaaaccacaggatctaagcattatggaaatgacaatgacaacttaaggagagctgttgtcactggggaaggatgctta

SEQ ID NO: 248431 - DNA, 327 bp, Homo sapiens
ttttttttacctatatccacataaaaacctataaaaatatacagatggtgggggggtctacaaagttactaccagatgacttttcttgagaatctctaaattcaacagccaactgtactattgaaaaaaaggtgttaatactttggacaattttatgtgactataatccaggcaaatacgtcagtaggcatcagtaaatttcattctactaaaaggccacaatttttgggaacttttaaggactagtcctccacatacaaaattactttccaaggtttgctaacaatgcaattctgcatttttagtttgcacagtctcctaaaaatg

SEQ ID NO: 248432 - DNA, 690 bp, Homo sapiens
  misc_feature (687)..(687): n is a, c, g, or t
ttgcccctttttttctgtgtttggggcctttcatagtctggcaaaaagttggaggttattgccattcttcagaatttagcaggaccctgtaggaacaagaacaatatctagactcccattattaattaggacttgaaaccaaaaatgcatgacccttctaaaaagtgagtgaggatgaggatgaagcaaaggggaggcaggtgctcatagagtatgtagtattctaagcgttactaggctgggacttccccccaaaggtgatgacttcctttagtatgtgaatcttgaaatgaaagaggcacttacccaggttcagataaatgaggtgtccagcttagggcaggtgaactctgtggtaagagttatgatgacatcaggggacaggtttgcgcaaggcacactggacggaacatagagtaagatgatccagtggtgtctagaatgtggataatacccaatgtatttttgtttgatgattggaaaggagaaagaggcaaagccctttctcccttcccaggcttgggaagggctgatctgatgcatgctgtgaatatgagtcgcagtatcctagaatctttgtgctctcgctgcagttccctttgggttccatgttttccttgttccctcccatgcctagctggattgcagagttaagtttatgattatgaaataaaaactaaataacantta

SEQ ID NO: 248433 - DNA, 591 bp, Homo sapiens
gggaaagagaacagtattgaaaatgaaagtcttcaatttttttacttctggttacttatgaaatacaaacactattttctatttgatggctgttgaccatttgatgaacagttactttgtagggtcctatcttaagttcaatagatcagaatgaaaatgaggagcattcatattgtgatagatagtgatcggcaggggtaggggatgtggttgccaggtggcactaaggtgggtctgaatctaggaatggacaaccctcagaaagataagatgggaattccaagtgtttctgtcagtgatattaatgtgattattcttaactttgagatatggttagtgctgttagttcatgtatggcttgttaggcttataatgaaatttgtgggaaaaaaaaaaaaaggacaactgcattcctcaataggatttccattcattcacaagtaagaataactcacttgatggaattattgctattaacatttttttcccaacttggtacttgtttacagctgagtcttaaggtttgtttttttcttttgcttaaaaaacttctacagctgaaccaatagtagaagttttttaagaaaaaaa

SEQ ID NO: 248434 - DNA, 471 bp, Homo sapiens
ctgccattccgctatatacttactaattattattttattcaagatcatgcatgctctacttgaaggtctatcttttcagtgctacccttacccactagcctaatcacattatatctattttcaacatctaggaatcaattacgtagtgaacatgcctaagaaataataatctgggcagatgcagtggctcaggcctgtaatcccagcactttgagaggctgagcgggtggatcacttgaggtcaggagttggtcaagtgctcctagagaaccaggctgaccaacatggagaaaccttgtctctactgataatacaaaaattagccaggtgaggtggcaggcacctataatcccagctattcgggaggctgaggaaggagaattgcttgaacccctgaggtggaggttgcagtgagccaatattgcgccactgcattccagacttggcaacagagcgacactccacctcaac

SEQ ID NO: 248435 - DNA, 547 bp, Homo sapiens
agaggatgggaccatgatgtcagaagttgaaattgggagcaattgaaagattctaagccaggaaggaatcattttctattttaggatggatttgagaaagttaagaccaagaggcacttaacatacccctgaaatagaaaagaaatgatgcatgagggcgttggtcataaggatagagaagagacaagatcagaagtatgtaggacagtaaatctgcaagatgaagttggggtgaaataaaaaccacaaaaatctcgtttggggctttccaaggttgtgccaacaaataaggtagggcatacaggctggtagctagattgttaagatgagtaactgcttgcaacaacttgattatttgaagttacagtgcatagatgactgtgggacagtgatctgatgctgcaagattaccaatgttaccaaatgacaaagacatcaagaggggagaatttaaactttcaatgattgaccaaggagttgtgcatttcattttgtaacaagggcgtaagattaaaaaccccctaaagatattacaagaatttatatc

SEQ ID NO: 248436 - DNA, 610 bp, Homo sapiens
agaggatgggaccatgatgtcagaagttgaaattgggagcaattgaaagattctaagccaggaaggaatcattttctattttaggatggatttgagaaagttaagaccaagaggcacttaacatacccctgaaatagaaaagaaatgatgcatgagggcgttggtcataaggatagagaagagacaagatcagaagtatgtaggacagtaaatctgcaagatgaagttggggtgaaataaaaaccacaaaaatctcgtttggggctttccaaggttgtgccaacaaataaggtagggcatacaggctggtagctagattgttaagatgagtaactgcttgcaacaacttgattatttgaagttacagtgcatagatgactgtgggaacaatcacatcatggctgttcgtgatatgagacagacagttgcggggggtgtcatcaaagcagtggacaagaaggctgctggagctggcaaggtcaccaagtctgcccagaaagctcagaaggctaaatgaatattatccctaatacctgtcgacccactcttaatcaggggtggagaacggctcagaactgtgtgttcacttggcattaagttagtagtaaag

SEQ ID NO: 248437 - DNA, 382 bp, Homo sapiens
tcttgcctcatgcccccaggactgagaagggaactcagaacactatgggctccacagatcagcccattgcctaaggcaacagagagcatctccccataaataaggatcaagtatatatccagacacattggctgcagtaggttcttactgataagtgccatctactggctgtaggtcaaaccaaacagccgtatgtaaaagctgctgatagaaatgcatagggctatagaagcaaagccaaaagatcctacccagcattctctgcagttgcaacacagagggagtggggagaagggaaggggaaagaaaacacacacacacacacacacacacacacacacacacacacacacacaccaataatattacagagaaagaaaaa

SEQ ID NO: 248438 - DNA, 321 bp, Homo sapiens
atttagttgatgaccaccgtctaaaaatttgcagcttcttctatgagtggccctgtcatggattgttcccacaggcctttttaaatatacaatgtccacagatggacctgtgtcttttgttcctttgtggcaaagtgggctctgtaggggttcaacttaatcccacactgaccaggagctggcatcagctctgttgccccaccccttcattcttattgaaaatagcccaattgtgcagtgtgaaatctgccactaggtaacttttttttttaattcactgattacagctcgtttcaaattgtgtctgagctcctttttaaa

SEQ ID NO: 248439 - DNA, 408 bp, Homo sapiens
ccaacagcagcagcttcaggagtatttgcatggcatgaggacacctccactctttgccctctagtgttaaactcaggcatcttttctgtaatgtgaaaggaaagcgtgttttcagcacaggtgacattctaaaattgggtcttccctgtgaagaagctgaggagataaacagcaagaataaattcacaaagccttgtaagagaagagcagagcgttttcatagacgggatgtggaggtcctggaagcacagcccagcagatgactcacctctggatggaatcaacacacaaagcagataaaaagctgaacattaaagaccacattgttaaagcagagagccaaattgttcctccaccattccctatcccagacttcacatctaacaaggttaatttgtccctataaaa

SEQ ID NO: 248440 - DNA, 432 bp, Homo sapiens
ccaacagcagcagcttcaggagtatttgcatggcatgaggacacctccactctttgccctctagtgttaaactcaggcatcttttctgtaatgtgaaaggaaagcgtgttttcagcacaggtgacattctaaaattgggtcttccctgtgaagaaggttcgtatgaaaccagataactctttcatggccacaggtttgtgttgcttctaccaaagcagcatttcagggaagtgccttcccagggccggccactcacagtggacttttcacctgcactcaccttcttccaatttgcaaagccctgcctcatcacatttgagaaggccttgtacttgagtaagttaaacagtcacgggctctgctgtctctgatctgacaataacaagcattatctactttggattcccagaataaaatcaggcactgagtagt

SEQ ID NO: 248441 - DNA, 460 bp, Homo sapiens
cactccagcctgggcaacagagcaagactctgtctcaaaacaaaacaaaacaaaaagcacttaaaaaggcattttttttccatgtggaatgtcggttgcctactttatgtattcaatagtaatagatattcactcactcattccacagcctggtgcagtggaaggataaactgttttcttttatagtgctttgttagagttatttatagggttattgttttatggaagtataaacttcgaaaccagacaagcttgagagactggtcctgtcccttactagctgtttaaccttgagcaagtgacttacccactctgagcagtttccgcatctgtaaaatgaagataagaatggtatcctctacaatggctgctatgaggattagatgagcacattgtagaagctccacaaatttatggcaaagtgctttctaatctataaagagctacaagaatgtgcatg

SEQ ID NO: 248442 - DNA, 484 bp, Homo sapiens
aatgaggaagggataaaataagttttagcaatgctaagtttgagatatctgttagatatttaggtggggctatcaggtagacagtgagtatacaaatttagagatcagagaaaaaatcaaactggagatgtaaatttgagacacatataaacctaattagaagaaaatacaggataatgccttttttttttacatagagatggagtcttgctatgttgcccaggctggtctcgaactcctggcttcaagcaatccttccaccttggcctcccaaagtgctgggattacagtcatgagccaccacgcctggcccagaaaagatttcttaagtaagacatcaaaaagcacaaatctttataaatggaaaaaccaaaggaaatgtctaaattaaaacaaaagatttctgctgaataaaggacaccacaaacaaagttagcaggtagatgagggacagaagaagacatctgaaacatttataactgcc

SEQ ID NO: 248443 - DNA, 324 bp, Homo sapiens
agccccgccccaccctggaagtgttccagtgtggtggggggaccctaatactgacaactggtcagagaagggcacagcgatgaggtaggggaggggctttcagagaaggcttcctggaaagggggtttatatgaggagataggatgctgctgtgcacagaaggaatggcacaagcaaaatgttggaggaggaaggccgggcgcggtggctagcaccttggcatctcagcaccttgggaggccgaggtgggtggatcacttgagatcaggagttcgaaaccagcctggccaacatggtgaaacctcatctttactaaaaaataaa

SEQ ID NO: 248444 - DNA, 607 bp, Homo sapiens
gggctcagaaacagcgctcttcggcggtcgcagcgagtgccgacaccaggatcgctttggagtaattagccggctagctaattcacaattcggggggaaatcgtcaagttttttgtttgtttgatttttgcttccaaaatactgggcacttcagtctcggttttcttccttacaatgtggcgctcccctcctgcacgcgccctgacatgacaaattccagggtttatgtggacggtcgttggccacctactgtgtgcgagagacgaatacaagcatagactgctgtctgccggagtcaactccgtggcagggatggatcaggctggaccccttcccagtctccattgcaagggaaaagccactttcagaaatattatataaagtgtacaccccacgctcgcgcacacacgtacaaatgagcgcatataaaactggtgaaatctgagtaaggtgggtggattttatcaatgtcaatgtcctggttgccatcgtgtcaacatcgggggaaactgggtgaagggtacatggcatgtctatgtattatttcttagaactgcatttggatctacaatctcaaaatagaaattaaaaatatacatatttgaag

SEQ ID NO: 248445 - DNA, 430 bp, Homo sapiens
gtagacagggtgtcgccatgtttgccaggctggcctcgaactcctgacctcaagtgatttgcctgccttggcttcccaaagtgctgggattacaggcatgagccaccacgtctggacataaacccagtaattttgtacgatttataaaacaatgtagtctgcaggaactaaggctatgttttgcctcaaatgttctttgttttcagaataaaatacttggtcagtggaatctcttcaacaaaatagaagagaagcagtcatggagtgaagaaataaatcatctttgtttctactcatctgtcacttatgcaatacatacaatatgtaaaaaggaaaaactcccctgtgtaataggcctaagggcaaccagcagctttccacgtcgcgttgggatattaataaattttttttctttacctgtaaaataata

SEQ ID NO: 248446 - DNA, 268 bp, Homo sapiens
tatggcagctgcctttggtggaagaatttagcatgactcagaattgtgtcgagcccagaatcttaccaaacccagaatcaacattgtttcagataaataaatagtaaattcttttgttattcctagactattcatgtaatgtgggttaagtcatacacaatgtggtctgaccagttattatgtgtaatgagtgttaaatggagtgtggaacttacccagattttctgaattaattctgatagaaataaattccactttctatgtcttt

SEQ ID NO: 248447 - DNA, 922 bp, Homo sapiens
gtaggagacatgggaaagcattttggtctcatgtattcataatattggggacgatatggtagaaagccaggaaaagtatttctgttgtcacccaggtaccagaggctgacaagcacagtgaggacctctaatctttctaggggttttctagtttgttttccaagatgtggggcaggtataggggagggtcttacattgaaatctctgctgaaagctatggactgtgctggcattgtgtatgtgtcatattgccctggtttcttcaaatttctgcccttttgctcatcatcgaatgcactaccttagtggctggtttctaatgcagcttctctcccaaagggtacatttttaaatttttattttttaaaatcttgagagtcctttgatttgggaagaggaactctttcatctgagttcattgtgagccctagagagctgtgtgactttatcatcgtcataggagtcattggactttaaaggcattacaactccatttaaagtacctcattactcccaggaatattgggtgttagatcttgcaacacagcataaaacaatttatgttaaagaaggagcattatatcctaggcacttgaaacaactcaaaggtgatgttaccctatgaacagataggtggtacagtcaccgtagaaattcaagacagggatatagcaggtgatgggattcatggatttccagagtggcgctaggactccactttatgttcgtgtattcctgagctgctaaaccagcaaaactcaaccataaggcttaggtcaggatcatctgtccctccggatgcatagaggcctggtttcagaagcagaacaaccatgctattaaaatgttggttcggggctaaagagaaacagctggttctgattacaatctttcagaaaactttttggcttaaaaagaactt

SEQ ID NO: 248448 - DNA, 951 bp, Homo sapiens
gtattatttgcttcttttctatgtgttttctaggcttttgagtcagatgttaggaaagagtctgtccatctttaattttctcacttcgagaagcactgaaatatttctatacatatgtccattggtatagcgacctaacacaactttaaaatcattttgaaattgacgcacagagagcttggttttccagaactggtgaggtgtaagatggttgaggactgacttggcctggtcggacctgtttctttgtagcattattactatttgtttattttccacctgggccttacatcttccctctcaagacagcgtctaggtcccaactcagttggtaggaatttgtgcagtagcaaacctgcagatgggcagagatacaaactcactcaactcacattacagtctttccctgtctaaaacaaacaagaaaacaaaacaaaaaagggagagatcatataggcgtgtatatatacaatattttgttatagataaggaacaaagtaccatatgaattcaaaaggtgagggtgggatgggtttagagctgggagagaaaccatctaaagccttcatgaaagggggtaccatttgctgtggatactgatggcaatgttggggctggaggaaaatgttccaggtagagggcacagaattaatagggggtagctataaaaagcatgctgaataccatgctaggtaggcatttagccctgtagcatatagatgtatctgaatttaaaggcagtgggtgatgttcggaggtttggagcataagatattttgtgatcagaagaaggtgaatctgtcagaggtgtttaggaagcaaatacaagggtagatagtatgggaggttattgtagtaccttgagagaatgctattgaggacctggatgttgaggttggtagcctgggaatatctgggctctgttgatgaattaaattgagttatggcaaa

SEQ ID NO: 248449 - DNA, 289 bp, Homo sapiens
gtagtatggaggccaaggaaggcttttatggtgacgtttaagctgaaatccaaaagaattaactagtcgaaatggtgaggcaaagagtgttttgatccaaggaaataacatgtgcaccctatctactagaagggatgaattatttgcttgctgtcctgaaggtaggccattgtggcttgaaagagtgtgagagagagcatgtagggcaagatgaggctggaagagtaagtaaagatcagaaatttcaggcattgtaggccatgttaaggttttgaacgttatttttaga

SEQ ID NO: 248450 - DNA, 386 bp, Homo sapiens
ggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagcc

SEQ ID NO: 248451 - DNA, 577 bp, Homo sapiens
ttggcctagattgccgatttccatcttttctgcccaacacagttctaatatccttaaaggtttacttcaaatgtgaaggcaactgaaataaactcttcctccactgggctccctcagcactttatttcactgtcttctgttaccacgttctactttcataatgggtatttgtaccaattgtgagtgtgaccctgggccatgagtatgtaaaaatgtaacaaacgtgaaccttggtttttaaaggacttatattttaggttgggagataatgtgaacctaaataacactttttcaagataggagaaaataacaagtatttcaggagtccagagagagtttgctctgctagagggatcagagccttgtgggggaaggtggcatcttcagcaccccatatggatgtacatagagaaggcattccacacacacaacaccaggaaaaaagtcaaagaggctgaaagagcagggtgtgttggggaaggggaagaagtttagtctgttattaacgagcatcatgaacgaccaagctggtatcaagtttgttaaggccagatagggaatggctacacattccagg

SEQ ID NO: 248452 - DNA, 432 bp, Homo sapiens
gtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaa

SEQ ID NO: 248453 - DNA, 303 bp, Homo sapiens
aataatctatggtgtcattcacgagggtcctgagtctaatggggaagacgtatgtatctacagatattacctagagtatcccatatttacaagtggatggctgatctcattcattttgttttttttaaaaaagcttgtaagtaaaaatataatttttttatttttagaaaatttagaaaaaggtaaacaataaatatataactaaaatataggaatcatccctgtcatctactgataatcactatttacatttggttgaatattctttcaggtttctttcttcttcacatccatttcatttca

SEQ ID NO: 248454 - DNA, 452 bp, Homo sapiens
aagaaaagaaaaaccaaaaatacatgatcatcacaatatcacaatagatgcagaaaaagcatttacaaaatcctatgccttttcatgattacaaacaaacaaacaaacaaaacacacacacgcactcaacaaactaggcataaaagggaactcaagattgggtataccgtggctcacacctataatcccaccagtctgggaggctgagacaggaggaacacttcagcccaggactttggcaacatcgcaggactttggcaacatcgcaagaccttgtctctactaaaaataaaaacaaaaaaattaaccaggcatggtggtgcacttgtggtcccagctgaggtgggaggatcacctcagcccaggaggtcgaggttgcaagcaatgagctataattgtgccactgcactgcagcctgggcaacagagtgagaccctgtctcaaaaacaaaa

SEQ ID NO: 248455 - DNA, 432 bp, Homo sapiens
cgaagggctttcacaatgctaggtgtggtctggctggtggcagtcatcgtaggatcacccatgtggcacgtgcaacaacttgagatcaaatatgacttcctatatgaaaaggaacacatctgctgcttagaagagtggaccagccctgtgcaccagaagatctacaccaccttcatccttgtcatcctcttcctcctgcctcttatggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaa

SEQ ID NO: 248456 - DNA, 406 bp, Homo sapiens
agtttacatgaagcttggagttatcaagctgcaatgctataagccccctactatatgctggacaccaggctacgcatgtaaacctagattctctaagtgaagactcatcacaaaggttgtttttattcagatatcagatgcctctcccaaaacgatcttgagaacttttcacaccttcagatacttgtacaagtttaagtctttgacaggtgacaaacagaagttttattttatactccttaaaataaacgtacattctaaaatattactttatttcaggtaattttgaaaaggaatatgatgatgtcacaatcaagatgatttttgctatcgtgcaaattattggattttccaactccatctgtaatcccattgtctatgcatttatgaatgaaaacttcaaaaa

SEQ ID NO: 248457 - DNA, 347 bp, Homo sapiens
acaagaagccctaactgttctaaatatatatgcacccaacattggagcacccagattcataaaataagttcttcttggccaacgaaaaaccttagacaaacacaaaatactagtgggaggcttgaacatcctactgacagcgttagatcatcagggcagaaagttaacaatgaaactctggatttaaacttgacacttgaccaactggatctcagacagctacaggacactacacccaacaaccaaaaaatatacatttttcttgtctgcacacagaatgtattctaagatcaaccacatgcttgatcataaaaagtctcaataaattcaaaatgattgaagtcata

SEQ ID NO: 248458 - DNA, 396 bp, Homo sapiens
tgaaaaaaccataatgagtaacagtgatgtgaaacagactggaggtgcccccaggaatttgcaatagaaggttggaatggttagggaataataatttaaataatagctactatttttgaaggtttaagagtcaagatagacaactaaaaccagtctagaaactccaataaagctaaaaataggatttcctgtataggcttaagcgtgtgctaagcactttgctaagttgttattactaacattattattatttgaggcggaatcttgctctgtcacccaggatggagtgcagtgctgcgatctcggcccaattgcaacctccgcctctgaggttcaggagaatgacgtgaacccgggaggtggagtttgcagtgagccgagatcgcgccactgcac

SEQ ID NO: 248459 - DNA, 335 bp, Homo sapiens
gtaaaaagagactttgcactggcctgctggatcacaggtgccgcattgtttctgtgtgtattacctcatttaaccctgatgaggggatgggcactgactccattccaaaggcgaagacattaaggatgttaaactacatgttaaaacagcacaaggaaaccctgtctttactaaaaataaaaaaaaattatctgggcgcggtggcaggcgcctgtagtcccacctactcgggaggctgaggcaggagaatgacgtgaacccgggaggtggagtttgcagtgagccgagatcgcgccactgcactccagcctgggcgataagtgagactctgtctc

SEQ ID NO: 248460 - DNA, 435 bp, Homo sapiens
agagtctgatccaggcttttccccctgctctgccggctcactggctggggatgtgggcaatgacggcctctgagtttacacttctcatagtgaaatgggtctcacagcaatgccatctgcttcccaaggctaaggattcagtgtgacagtgagggcaaagcactcagcacagggcccgacacacagcaaagcctcagcccttgttcttgctgctcattgatgacagtgatgacaatgatggtgactgagttgtgtggctgagcatttggaccccaagttttatctccaactggcaggtggggagccgggatttgaatttggctctgtctgaccccattctcccaggatgcaagaaatggggcctggggaggatcgcttgagcccaggagttcaagactagtctggacaacatagtgagacccctgtctctacaaa

SEQ ID NO: 248461 - DNA, 614 bp, Homo sapiens
ggcatcgaatgacaaaagaaactgttcattccagaagtcctgatggcactatcgttagatttagactcacctatctgcacagacttccagaggcaaggacagacagcacgtggctcactcgataggtggggcattcattcagagatgctcacttagtgcctactatgcaccaagcattgtgcttgcagtgaggctccaagaaactaatagggatattctagttctccaggaattcccctctgttgtgagtgatggactagaatagaagtaggcacaggctgtaccagaagagcagacacttgctatagaaggaaggccaggaacactgcttgtgatgtggctactgcttcactggacggtgaaggtgcctaacagccattccagagagaaaggccagcagagacaaaggcacagaaacatgaaagggcagagggtgatggagacacaggtgtttccaggtggccagaccagatcacagcaagagtggcaaaaatgaagcctataaatatctgttgaaaatagattataatgggagaaaaattttgcaatctatccatctgacaaagggctaatatccagaatctacaaggaacttaaacaagtttacaggaaaa

SEQ ID NO: 248462 - DNA, 619 bp, Homo sapiens
aaaattgtcaacaatactgttaaagcctattgtgttcgtctcccttcccccattagaaaccattcagaagtagatatttttataatttatttatacttacactatatatgtccatatgcctaaataataatatattttgtatgtttaaaaactatactggccaggcatggtgtctcatgcctgtaattccagtgctttgggaggcagaagcagtaggatcagttgaggctaggagttcgagactaacctgggcaacatagcgagaccctgtctctacagaaagtgaaaaaactatccaggtgtggtggtgcgtgcctgtagtcccagctattctggaggctgaggtgggaggattgcttcagcccaggaggtataggttgcaatgagctgtgatcttgccactgcatttcagcctgggtaacagtgaaaaagcttgtcttaaaaaacaaacaaacaaacaaaaactatacagtatatgtttctgtaatttgcttttttccctcaacattgtaagagtcatccatgttaatacatgtacctctgatttttccattttcactaatcctgtcatcaggtgtgtctaattggccattaaacctatctaccttctattgggtgt

SEQ ID NO: 248463 - DNA, 448 bp, Homo sapiens
cagagtgcactgggccagctctcccatttctccttgtaaagacagaaatctaagaaagttagttaggtaaagtaaaagtaatgtctctgggtttatccaaccaaaggtgtcttttaccctagtgaggagagtatcccagtgaaagcccacagctgtagcttgcaaaggaagctgggttggggatgggcttgggtcaagcctagagatttggccagtgtctccccagatgggggcagactggctaataaacagtgccagagctgtgcgtttgacagaattcctggctgctcctggctttcccatttcgatgatgatgttatgccatagccacaaactattatttaagtgtcttaaatatccttgacgttatatctgaaaatttctataaagtttaccttatattctcatactcaagagcattgggcggtattgaatcaagtaaaaaaca

SEQ ID NO: 248464 - DNA, 305 bp, Homo sapiens
tagtgctaagtgaaaagagacattagaatttcaccatattaaactatctcccaagagtaatatgagtgagggaagtgttccttttaaaagtcatgcttctaggctgagcatggtagttcatgcctgtaattccagcactttggaggccaaagcaggagaattgcttgagcctatgagtttgaggttatagtgcactatgatatcattacccactacaataaaacacgaagttcagatggtcattcactagggtgtgtgatattttggagtatagaccttaagtgattatgacatatcaaaataat

SEQ ID NO: 248465 - DNA, 482 bp, Homo sapiens
actagggctggttttcctcccccattttggcaggctggtccaacctgttacttgacagtgaagtgggcagaggagccctacatgtggttcctgcagtggtctggggaggtaagatgctgagcagttctgccacctctctcttcccccctccccagtagaccccattccagagcccagcacctggggcttgcttggccatactgtcccacaccatggtaagggaacgtttcatccttgtccccttcgcagaaagcggcagcccctacccatagtgccttctttcgactcaaactcagcctcataggaaagatttgagctgtgctttagagaaggagtagggttttaaaaagaaatttctagaccaggcatggtagtttacagctataatcccagtactttgggaggctgaggcagaaggatcacttaagtccaaggagttcaagaccagcctaggcaacatagcgagaccacatctcttaaaa

SEQ ID NO: 248466 - DNA, 504 bp, Homo sapiens
cccatccactttttaaactctcattttcaggatcggagaaatttgctaatcttcctattagcccaaccctgccaccttacttcctcctttttgtctccctcctcatttcccagtcaggtttagtaaatgaagaattatttctttggaatcatatgccattctatctcatttgtttgttgaagatggcaatcaaggctagtacgaacatcttgtcgtattccacaatccctctgcaggcctgagaagactcaccagcaagagagggaaagagagactcgataacatctaccaaatgtggccggcattttgttggacgttttcgggagcaccgtcatctcggacaaaccccgccacttcaagttccacctccctttatagcttcacgcattcaaggaaatcacttccaactacaagcagccagaaacagcagacagtaaaacacagataagactcctggggcacagagggaggtaagggaaaagtctcttgggtaactgccaaact

SEQ ID NO: 248467 - DNA, 247 bp, Homo sapiens
actacccagtcccaggcagttctttaaagcagcagagaatggactagtaaaccctgtatctaccaaaaaatacagaaattagccaggcatggtggcatgcacctgtactcccagctactcagaatgctgaggtgtgaggatcacctgagcccagggaagcaggcagcttgagactgcggtgagccgtgatcatgccaatgcactcgagcctgggtgagaccctgtttcaaaacaaaacaaaacaaaa

SEQ ID NO: 248468 - DNA, 231 bp, Homo sapiens
cagatcttgctatgttgaccaggctgattttgaattcttgggctcaagtgattttcttactttggtctcccaaagtgctgggattacaggcgtgagcaaccgtgcttggcgcaaatataaaatatttataactttgaggaagcaagtgcatttctagaaatttgcttttgaaaaacaggctttcgtgctcaaagtcagaaatgcatgtaccaacagaacattggatccagt

SEQ ID NO: 248469 - DNA, 169 bp, Homo sapiens
gaacatgtattagttacatactttcaaaaaataataacttttgatttaccttaatttcaccctaaacaaagaagaaacttctctttaggctattttaaagaaaacacattggcattttcaaagagaaattgacccagttaaaaggaaaaataaaagaaataaataccca

SEQ ID NO: 248470 - DNA, 782 bp, Homo sapiens
taaggctgttaatttgtcgacataacgggattcttttagaagtaaaaggcataaatctgcgtaaccaccaccaccttttgtttttgtttttttgttctgtcaagcttaatcaagaaagagggaagggagttgtgtcccttcactttgtaggatcggatcctgtccacccagttcccgaatgctctcaacagttacccaaccgcctgtttcaaaggcttccctgttgctcagaatgccacctggacacttctggaaggagactatcagggagataggcttcccctcctcccaggctgtgtacaggtccccactcaatccagcccagggcagagtccaaacggggagggagacgcagacagggtcaaagggaccccaagagtccagcacatctgggaaagagaaaaggaaaaggtgctgtggcttcctgtagctggggcgcacgccagcgcgccccctttcctctgggaggacccccggcccccgttcgtccccgagctcccagcccgcctccgggagccccagtgagaggaaaaacgtgcggggaccccccagcagctccaaacgccgaggcgctccccgcgagcctcagacccgacccaacgccaggactcgcgccgccggcccgggaagaaacccccacagcccgcgccccgggctggctggagggtgggggcggctagccaggcagggcaggggagactgggcccggaggccgggtttggggctgtccagccgggacagagggcccgggcgggggggtccctctgtgggaacaaggagtc

SEQ ID NO: 248471 - DNA, 484 bp, Homo sapiens
gagggacctctacttcacatagtcacccagggacccaagttccttccttcttgtggctctgtcctcttctaagcccttgaaattttttccattcagccagtggatggagaaagaaagaacatgctaaattgccctagatgtttttcatgggactggcctatattactttggctagaacttagtcagatgaccaaacctaactgcaagagaacctgggaaagtaatctaactgtatctacagaaaagaggaactgaatttgattggcatctagtctgtctctgccacaagtaactactagctgggtgagcttaggtcttagttttcttatctgtaaaatggaactaacatgagaattggtgaaagctaaatgaagtaaagtatgtggaaaatgatgaatccagttgggattcatgatcatgactcttttctctcagcttggacctcatcacagctattgagcatcatccctgctgacaaaaaaaa

SEQ ID NO: 248472 - DNA, 431 bp, Homo sapiens
tcccccacttcttccttctcttcattccttctttgctatttttaaatggcacattggaaataaaacaattgtcaatgtattcagccctcccgcagcgggctgccaatcagcacagtccagcctacctccgcttccattccctccaccttagccctcacctccctctttgctcttgcccccgtctccgggcactcaggtctctgttagtttctcaacagctttgcatatgctgttccctctatttggaatgctcttccccatctcccacccctggctggcttttcctggccacccactctgaatgatgcgctcctcttacatatgtgccctgtgtgtttctttactgatacttgtcagcctgctgatcgacttatttgcacaaacatttaataaatcactggaccgtctgctgtaggcgggcagagatcaga

SEQ ID NO: 248473 - DNA, 370 bp, Homo sapiens
agaaaagattggaacaaataagacttagaaacttaatgaagagggcttgtggaactgagctccctggtgctggagtctcttggtagaggcagaggtggggtacgtctgtgataaagctggttctccaaaggctgagaaaagtgccaactgtatttagttgctcttaaggaaagaagtgctgctgcagggatgagaagccttgcaggggtgacagtcacaggaacacaagcaagcccacaggaagcagttagggaggaagcagccatggtgtcttccatccagggccagcaggcaaagctgatgcgtagtgtgcagagtccttggtgcagcatcccaaagcacagtatagaagggtggggttagagatgac

SEQ ID NO: 248474 - DNA, 589 bp, Homo sapiens
acaaagtgagactctgtctcaaaaaaaaagaaaaagaaaaagaaaaaactggtaggtttttaaagggaaaatggttaatgagaaagccaactacaagaaaaacatttagtaagcttcattttaacagatcaaaagaggtgtgtagatttttaaaaggttaagtgatttattttctgttaatctgtaagaaaaatgtactatttgatattataaaataagtgttatcattgatagcactgaatctgaaatcctatgtaagagtctttttttgtttagtagccactccatttacctgtaccaggtaaagctcccaggactctacacacaacgcttcaaaagtggaggagacggggacggtgcctctggtgggggtcagggagggaaatatcatctctagatggatgtgtatagctgaaaaaagccttgatctatagattctagtaaactccttggcttgtatcatctccctcataaggagaatattgtgaggtggaaaaagaaaaatggcaatattccgagcactgaaaacatgacaattacatgtaaacatttcatttccattgcaaaaataatcaactccaaagaaaag

SEQ ID NO: 248475 - DNA, 350 bp, Homo sapiens
agatgtagacagatgcattttgtatttaagttgagaactgaatttctaagttcaggtataaatccccttgacaatatttgcaaaatatagttattttaatttagcagaataggttgtgttaaaaatcagctaaggctggatgcagtggctcatacttgtaatctcagcactttaggaggccaaagcagtagcttgccagagctcaggaattgaagaccagccagggcaatgtagtgggaccccatcgctacaaaacaaaaaactagccaggcatggtagcacacacttcagcaactccagaggctgagatgagaggtcgaggctgcagcaagccatgatcatgccactgc

SEQ ID NO: 248476 - DNA, 634 bp, Homo sapiens
gatagaaaaggaaggaagggatatcagagccttccaggttaccaaaccacttcagtgattttcttgtcagactctgtgaatgtctctaaataaatcagtcagtacttccaagtaccctggggacaggctcttgggaatccagggaatacagagatgaatgctttctgctgcctctctccctacttccagctttaactatccacctagtcatctcactttcatgtccaacaaacatttcaaactctacatgctcaaaactcaactcctgaccaagcgtgatgactcatacctgtaatcccagcactttgggaggccaaggcaggagggtcactttggcccaggggttcgagaccagcctgggcaacatggcaagatgtcatctctactcctgatggtgcccccaaacctgctccatccttcctgttactcaggccacaaacctatgagtcttcttaatgccttcctttcgctctcaagccgcagtcaggaaatccagttagctctagcttcaaaacatacccaaaatccaagcacttcttgccatctccacggccaccacctggaatgaaccactaaacaaaaatataccttttaatccataacaaccttctaactgagctctgctttatcttgc

SEQ ID NO: 248477 - DNA, 91 bp, Homo sapiens
tctctgcctgcaaacatacagaattttagttttaatttacataaaattagctatgcacgtatgttactctaaataaaccttaggtgcaaga

SEQ ID NO: 248478 - DNA, 460 bp, Homo sapiens
agacagatgaattaatgcctttcagggaacttccctatttgtttaatatctaactagccctaaggttaatattcaaaattattgataaaatgcattaggagatctgatgatagatgtcttaagaagaagatcagagtttcggaaggacattctcacacagatctcagtttacctcctattccagagggcataaatatgcaatggcactattcataaactcaaccaatggcacaatcattttaatactgacatgcttcagtacaaataaatataattcagagaaaatcttccatgaatattccttacggagctggaaaaaacgttatctgaagcaagatgttactatgggaggattatattacgtgcactgtgttttggcaatgctttgggatacagtcattaaataggttggctgaaaattcattttactggttaattaaatccaagagtttgcaagaaa

SEQ ID NO: 248479 - DNA, 343 bp, Homo sapiens
tggggtagattaacttaatcaggttgtggaagttgtctttaagcctccttaactaagaagggtttttttagaatcacgtagtcatgttgaattttatcagaagttacatatgcatcttttgggatgatcatatggtttttgcctttaatgccttaaatgaaagatacttatatattttaaaaattaaaccagtcttacatccttgagataaaccctatatagctatgatattttttgtaaataatgatccgtttagtcagctaatgtcatatttaagatttctgtatctatattgatttattaacaaattttattttttattaaccattttaataaatgagtt

SEQ ID NO: 248480 - DNA, 448 bp, Homo sapiens
tcagtaaacttgaagacagctcatttgaaattattaagttagggagtgaaaagaaaaaagaaagaagagaaatgaggagagactaagggtcttataggacaccatcaagccaaccaatatacacattatagtaattccagagggagaagagagagaaaagaggaagagagtctgtttgaagaaataataaccaaaaacttcccaaatttgaggaaataaatggacatacaaattcaagaagctcaaagaacttcaactaggataaaataaaaaagaattacaccaagacatactgtaatcaaactgtcacatcacaatgaaaaaatcctgaaagcagcaaaagagactaatcacttatgagggaaccaactctgtaagataatcagcagatttctcagcagaaaccttgcatgccagagggagtggggtgatatattcaaagcactaa

SEQ ID NO: 248481 - DNA, 434 bp, Homo sapiens
ttttaagtaactggatgtgctttgcgttctccaggctttagcgctttggggaactgccccgtggctgatggcaaggagggaatttggccagttaagtgtcctctgtccctggtcagtcccgacggtcaagcaacacaggatgtgcgggtctcactctcgtgtgcccctcagaggaagtgcactctcgctgctgttcagagacaagcctggtattatttaacagttatagttagttaacagttaacagttctgggtttaacgtgcctatcacctggtgatgatgaaaccagctctgtgggagaatctagtgacctgccagttcttccagcgtcccctcccaggggcgtcgctgaggaagcgctgaggctgacgctgtgtctccaggcccgtcctcgtccctgccaatgttgggggctctgactgtaactcatgac

SEQ ID NO: 248482 - DNA, 434 bp, Homo sapiens
ctgtcatcataggtttaaatttactcagtaacaactctgaagaaatattatagggttaattcaagcatcaagagtagaaattgatccacatgatctctggggtgtttcccaaatcacagaatctaggatctacctttctaaagcagatttggcccaaccactctaatttaccataggttcctgccagacatggccagtcactctcccttgtgtttactttacaccttcccaattcaattcctttgctcagattttgtcctttgcctgaaatgctcacatactccaccagctggtattgtactgattcttgcaagtccaatctaaatgactccttcttactaaatgtctcccaacttaaatatctcctccttattgtccaagctgggtataacatttattaaatggcagagcaggaatgaatacaacagaacacc

SEQ ID NO: 248483 - DNA, 469 bp, Homo sapiens
aatacttgggctgagtttaaacaatgaagataatagttaattgaaagaatgaggtaaaaagagcagaagcatgtatagagcacagtgtgagccaccgcgcctggccaggagagttaagtttttatgcactggctgtgattagaaggggtgtagaatataggagcattgtctcggaaagatgacaggcatggtggggatagaattgtggtgggaagctttggctgcttggagtcctttgggatcctgacagtaaggaatagtgagactgagtgtggccccaagaagaattgtaagaccttaaagacaaatattttaatgaaggtcacaataggccagttgactgtactagggactatgtattttgtgatatccatatgttcctatattattattttattattattattattattatttgagatgaagtcttccagcctgggtaacagagcaagaccctgtctcaaagaaa

SEQ ID NO: 248484 - DNA, 462 bp, Homo sapiens
aatacttgggctgagtttaaacaatgaagataatagttaattgaaagaatgaggtaaaaagagcagaagcatgtatagagcacagtgtgagccaccgcgcctggccaggagagttaagtttttatgcactggctgtgattagaaggggtgtagaatataggagcattgtctcggaaagatgacaggcatggtggggatagaattgtggtgggaagctttggctgcttggagtcctttgggatcctgacagtaaggaatagtgagactgagtgtggccccaagaagaattgtaagaccttaaagacaaatattttaatgaaggtcacaataggccagttgactgtactagggactatgtattttgtaaaaaccaaaagacacaaaaatataagtttattattgttattcctcctgagagggaggaactccccgggcctgggtgactgcgcctcaccctggctc

SEQ ID NO: 248485 - DNA, 373 bp, Homo sapiens
atgttgcatcgacttttttttttttaaatctaatctccttaaagttagcataaaagataaatcaaatttcacagaagactgtaaaaatctaatgttactggccaggcgtgatggcttagcctgtaatcccagcactttgggaggctgagatgggcagatcacgaggtcaagagaacgagaccatcctggccaacatggtgaaaccccgtctctactagaaatacaaaaattagctgggcatggtggcatgcacctgtagtcccagctactcgagaggctgaggcaggagaatcacttgagcccgggagacaggttgcagtgactggagatggtgccactgcactccagcctggcaacagagtgagactccgtc

SEQ ID NO: 248486 - DNA, 586 bp, Homo sapiens
gcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctg

SEQ ID NO: 248487 - DNA, 344 bp, Homo sapiens
gctttgctaagtaagatgtttactggagtacatttctctcctgatatcagagatgcggctgccccaagcacatttagaagttgcactcttggtacaaaagtaaaggtttgttctcttctgcctgcaaaactacagccagcaactagaggtgatacctgaatgtatccggattgacaatcttcatccctggaaaacatgactcccagaatccagcggtgggggacgggggggtcgcatggcgggagaacagctcctcccagtgtgcctcaacacagggcatccaacacccacttgtcactcccaaggctgactgatgaataatgttcccaagtctcgctgcacgc

SEQ ID NO: 248488 - DNA, 712 bp, Homo sapiens
attgcacttatgcaggggcagtgggtccattcctgcggcattcctatgatatccaattatagtaactgtgtttgtgttgctcagttagaagttgaatgagctggagatttaatgatctagttaatcagtttataattggtaatcagaaagactgagggtttaatcagccagtgtgatatcatatgagccattggttcccagatgctggtccaacaaccacaagtattcacagatttctaggcccatctggggagattcttattcagtatgtctcaatatagactctaggaatctatcatttttcgaggttccatggaagtttctggtgcagggatgtcaaagtatgcatggtataatgactatgtcttttagtgataatgtttttcatctctgtgtgtctcagatactgctggaatgccttaactaccttctttaatggaatatgtttatatgggcattctgggctatgtgggagaaggaacctcaggctggccatcggggacctggttctagccttggttctgccactctctcaacctttcatcaggttagagaagtctaatctctgtgtaggtctaattcataaattgagagcatcagattatgcaaaaggcatttttcagctttctaacattcttcgaagagctttgcctccctaggaattgcttttgttgtcactgttcacgaacagctgttgcctcatttagtttag

SEQ ID NO: 248489 - DNA, 391 bp, Homo sapiens
tgggtgacagagcgagattgtcttaaaaaaaaaaaagaaaaagagtgaagaaaatccgctatctatgcattaatctgtgggctcatttccttgcagccttgtgattgcacgagtgttgtctgatatcatttgagcaagttgtcaactctaaggttctgcaacctgtaaatgcagtgcagctcctggggagggcgtctgtccccctggctggaggctctcaaacagaatggagaccctcactgtcagacctattgggaggactcaggcggtggatgggggttcagactagatcatgtccaaggtccttaaaaaccacaaggtgtataagatgcagccaaaatgatttaaggcaaaaccccacaaacaagatggacaaaaaccctcaaggtga

SEQ ID NO: 248490 - DNA, 271 bp, Homo sapiens
caaagaaactggctttgttagaaaatgcttttgtacagtaaaagtgaaccttaggcccaagtttcttgcagcaagtggtggggtagggtggagaggagttaggatgaattgggcagaaaaaggctactctgtgttgtaaaggaagaagggatggggctgaatggtgtgtggacaaagattataagagaagaggtcctgttggctggaaataattgaaagaagaaacagatatactgggagttcttctaataaaagaactgaattttgtact

SEQ ID NO: 248491 - DNA, 299 bp, Homo sapiens
atcactcggctccctccttactattaaaatgtgggcacttgtcagggcctttccatttgtgtgcaggatcccccgcccattccccatccattcaaggacaacgcaccagtaattctccctctcttgaattatcaaatctttcctctgctgtgtaattcccattaccacacaaatgtactataaattttcttacttttatttttttattatactttaaattctgggatacatgtgcagaacgtgcaggtttgttacataggtatacatgtggcatggtggtttgctgcacccatcaacct

SEQ ID NO: 248492 - DNA, 419 bp, Homo sapiens
accagttctccatttattttctcagaaaatcaatcagctattgaacaactatttttcacaaaacacaattcaagctactattttgctttaaccccatactagtttcttgtggctactgtcacaactatcacaaattttgtggttaaaataacataaacttattctttcacagttctaaaggccagatacctgaaattagtatcacttggctgaatcaaggtgttgtgaggactgtgctgcttctggaagctctgagagagaatctacaccttgcctttttgagctgttagtggctgccttcattccttggcttgtggcctcatcactctaacctctgttttcatatcacccctttctctgtgtgagaaaagtctccatctgtgtctttataaagacacatatgattgcatttggatcca

SEQ ID NO: 248493 - DNA, 710 bp, Homo sapiens
cggtggtgtgcactttcatgaggagattcgtaatgtctgcttgtcttcctttggcccattggaacttatttaggtttgttaccaagtcgttttgacacaatgctgctaaactttgatagcttctatgctttgtggtatgataaggtgctcctgatttatcatatacatttcctgccccaaacatagaatcaactatttctccaaggagctctgtgggtgctaggggtggggtaagtaaacttaatggcttgttctatttgtagtctgagttaagtatagcctacatttatttcaagtaaggagagaaaactcctttgtttccattgtaactatcgaggatatgttccgatctgatcagtttaggagatctctaccacttttgagttgaactgatgaaatacctagcactgagtaaacgtatagatacactatcagttctagtgctgttgttaaattgaacctaagagaaagggttgctattaatatattcaatttttttttctttgtggcataacctgtttttgtttctactttatatttatggaaataatactgggggatgtattttttggcagtactttatgagccaagagaattaatgattgataatttctgttcttcaaagattgtataagatcaccagcagtaaaaattttcttttctaacagcaatactacccactctcagtaaccagatctttttgacactag

SEQ ID NO: 248494 - DNA, 630 bp, Homo sapiens
gagaaaaattgtcttggaccacatataaaatattctaacgctaatggtagctgatgaaacttttaaaaaatctcatcatgttttaagaagtttacgaatttgtgctgagccgcattcaaagccgtcctgggcctaagtccttgctatttttcctcttcaatttccttcaatccatagttctctaggttattttcccaccctttcccaagattcggatatcccttcattcttgctgagttcatctcctatgcctattcctacatacttgctgagttcatcttctaatgtcctcatcctggtttcttcctgaacctgaaatccagctaaccttactttttcatcccatcaaacccctgctgttgccagcccagcactcacgaagatctttacatacaccaaatattaaattagggccggtacctagacattgtctctgcactctgctggcatattttcccctggaccacgaacccttcgtacctagtaacttgccacctgtgtttataaataccagcaatttgatttacagggtgaatttgtcactattgtttacttttaaatgaagttactgtatttgttgtttccattaaaggcgacattataaagcctaggcctcatatccaaagcaaa

SEQ ID NO: 248495 - DNA, 430 bp, Homo sapiens
atagaataatatcttcaaagacagtctttttttaaaaaaggacatattgttccccttaggtagatactggcattttattgaaatatagttcaagagacatgcattcaggcaagatgagtgcacaccgtgctacctacttggaacccaaactcagaacagtagaattgaatcttccttggaagactcaggaggaagatcatctctctgtgcctcagggtcctcatgatgaacctattggtaattatactgtaaacatgagggtgtgcggattagtagcgatttcttatcactgaatcattagtgagcaaactatttattttgaggtggtgtcctcaatactaatatgattgtgcttcaatatagaacaaggaatatccctggatgttatagtccttctgaaaaagagtcattgattgcagatattgtttta

SEQ ID NO: 248496 - DNA, 620 bp, Homo sapiens
ctttctcagggagtggggctttaaagttcgtttgtttgtcactccaattttagctgtgcactgcacctttctttgcacccctactctcttcatcttgtctcatagccacagctattgaatttggcctgtgatcataagttgggtttctgatctgatctcttgcattctggtgggtactgggggcagaatcagctttgttaatgattttctgggcagaaggtaaattcagctgcatctgaaggggcttcacagtccaatagccgtccttttgttttacataacagagagtgatggtcaaggccacccacatctttagtggtagagccaggacaaaaagtcaggttttctgcctcttaagtctcatgctgcctcacatagcacctccagagctctagggaaaggaggctcagagagatgaagtgacttgtctgaagtcctgtggctagtggcagagaagttggaattagacctgcattggacctcaattcgctgagcagttgcagggaaatctggaaatccttttttttttttttttgagacagagtcttactctgtcccccaggctggagtgcaatggcgtgatctcagctcactgcaacaccgcctcccgggttcaagcg

SEQ ID NO: 248497 - DNA, 368 bp, Homo sapiens
tataagagttggttattgcaagattgcagaaaatgctttaaaaatgcctagtgtgactaactcgtgagctcaggggatggaggagagactttagcaaaagaaagcaaagtatgaatttattaggaaatgaaatatcaagttaaagaaagttatggaaacaataaaattccctccatgaataagctcttgattaaaagatgtccttaaaactaattttaaaacatttattccaggtgccggtttttatattagtaatacagaattcaaaagcagtaacaggtgctgtttagattatgattctttcatcatttttcatcttatatgctttggggctttcatagcagaaatctttttcatcaagttgcaaa

SEQ ID NO: 248498 - DNA, 397 bp, Homo sapiens
tttttttttgagatggagtttcattcttgttgcccaggctggagtgcaatggcatgatcttggctcactgcaacctctgcctcctgggctcaagcgattctcctgtctcagcctcccaaatagctgggactatagacacacaccaccacacctggctaattctgtatttttggtagaaacgaggtttcaccatgttgtccaggctggtctcaaactcctgacctcaggtgatccacccaccttggcctcccaaagtgttgagattacaggcatgagccacagcgcctagctctcagcagaattttaaaagatttatcttccatctctgctgctctcttatttcctaaccattgaatgtgagatctacactggaatatatctgacaacttccaccagc

SEQ ID NO: 248499 - DNA, 467 bp, Homo sapiens
caggtctggagtttagttaataataatgtaacaatgttggtttcttaattttgacagtgtaccactataatatggtaacatgagggaaaactgaactgggtgagaggtatgtgggaacactgtgtactatctttgcagcttttctgtaaatctaaaattactccacataaaaagtttgttttggctgggcacagtggctcacgcctgtaatcccagcactttaggaagctgaggtgggcggatcacgcggtcaagagatcgagaccagactggccaacatggtgaaaccctgtctctactaaaaatacaaaaattagctgggtgtggtggtgtgcgcctgtaatcccagctacttgggagtctgaggtgggagaatcgctcgcttgaatccgggatgtggaggttatagtgagctgagattgtgccactgcactccagcctggcgacagagtgtgactctgtcttaa

SEQ ID NO: 248500 - DNA, 399 bp, Homo sapiens
cttcctcctggaactctaatccctctcattccctgaatttgtccagcactaaaactaaggaatggtggggatcctgtcttaattcttctctgttttcactatttgggagggagagtgtctgctgaagtaaccttctacctcccagttagttactagacttcatttaggataactacttggatgcttatctatcttagtttaatcttgttttttgactggcagaggggcagtcctaggtaagtgggataagccctctttgggggaggtcaggagattgattctggtgaagtctgttaacctttgtggacctaagttcttcctgtttacagtgagaacgttgacctacagcagtttgtttaagcaacatgaccctttttcaaatgaaatcttatatacaaa

SEQ ID NO: 248501 - DNA, 361 bp, Homo sapiens
aaacatcacactaaataatgttgagctaatatttttaagaaaacctatcacatagtaaacttttaataactgtacagtttggttttttttcccaatcttcctttgctcccaaacttactagccatgccttgttacacaataagtagaaaaaagaaagttatagaaacagatcaatttaaaaaaaaaaaaaaaactctcacaaagatgtggagaaaagatataaactccaaaatcaaaacaaagtagcctcttaagattatccaagccggccgcagtagctgagattacaggcatgtaccaccatgcccggcccacagagttttctcttaaataaatttaagttttaaaaagaagtccattt

SEQ ID NO: 248502 - DNA, 977 bp, Homo sapiens
gctttagagtcttgcaatggactttccagcatatagaggtaagtgaccacccaaacaacctttcaaaaatgaaccaacaggccagccacagtggctcacacctgtaattccagcgctttgggaagctgagacggatggatcacttgaggtcaggattttgagactagcctagcctaacatggcgaaaccccatctttactaaaaatacaaaaattagtcaggtatggtggcgtacacccgtaattccagctactcaggaggctgaggcatgagaatagcttgaactcgggaggctgaggcatgagaatagcttgaactcgggaggtggaagttgcagtgggaagatcttggtcgatgaagtccgctccccaggtcaagccatctcctggtcagctcccgagataactgggacgtacagggcaacactgacagaccacgccaaggcataaaaagaagtaatagtacagtagagaatggagaacaaccgagataagccaggaatagggtccacgaaaaatcctcaacgtaggaagctggcacgccatagagaacgacaacaaagaggctggagacacagcgattgaagacaactgacaccagacaaaaacctgaaaatacaacatgaacagagactcaacaatgagacacaaaaaaaaaaaatagaaaacaacagaagcaagaattacgaggacaaagacaaaaaaaacagacagtaaaccacgacacaaaggaacacaaaacacgggacaaagaaagacagaaccacaccagaaagccaggaaacaagtaagccgaaaagatgacaaagaaacagcaaaagagaaacagacaaagagcagaagacaaaaaacccacaaagcaaaacaagtcagaaagcagcaaaagggaacacacaacaaacaaagagcaacaacagacaaaaaaacaacagacaagaaaaaaaaaagaaagcaagtaagtacaccagataactaggc

SEQ ID NO: 248503 - DNA, 736 bp, Homo sapiens
gctttagagtcttgcaatggactttccagcatatagaggtaagtgaccacccaaacaacctttcaaaaatgaaccaacaggccagccacagtggctcacacctgtaattccagcgctttgggaagctgagacggatggatcacttgaggtcaggattttgagactagcctagcctaacatggcgaaaccccatctttactaaaaatacaaaaattagtcaggtatggtggcgtacacccgtaattccagctactcaggaggctgaggcatgagaatagcttgaactcgggaggctgaggcatgagaatagcttgaactcgggaggtggaagttgcagtgagcaacacggcactccagcctgggtgacagagtgagactctgtcttacaaaaataaaataaaaataaaccagcaagtcacattaaggaaaagagggataagaacagtagactggtacagtggctcatgcctgtatttccagcattttggaaggctgagggctggagaattgcttgaggccaggagtttgagaccagcctgggcaacatatcaagaccccatctctataaacaaattgaaaaattagctaggcatggtggtggtgcacaccggtaatcccagctactcaggaagatgaggcaggaggattgattgagcccaggagtttgagattatagcgagctatgatcatgccactccactctagcctggacagcggagcgagacttgatctctta

SEQ ID NO: 248504 - DNA, 517 bp, Homo sapiens
ctttcccccactgaatgttgtgtttgtcagaaactgaaatcatggatcagagccaagtttgtagtacccttaggaggggcctctgccctcctgtgtgctgcctgggtgaggacagaaccccctaacctgaaatcatggatcagagccaagtttgtagtacccttaggaggggcctctgccctcctgtgtgctgcctgggtgaggacagaaccccctaacctggagctccacttgagtgggcccatacctgtactttcctctgaaaaaagaaaatcctgcaaagaaaatagaagacatctgttctgccattgccatgcccttgttctagcccagacatgagaactgtcagaattggagttactaaatagaacttttagtctttttctgataatgtgtagtaaagtgtattacaacttatagaattctatttagggaactacaggtcagaaactaccatattggtagcagtcaatttttctttgccatcggatgtggaataaaatgttaaattgtacac

SEQ ID NO: 248505 - DNA, 423 bp, Homo sapiens
ttctttgacccaatgattatttgagtgtattgtttaattttcacatatgtgcatatttgtgaattttccagttttccttctgctattgattcctggttttattccattgtggtcaggaaagatacttggtatgatttcagtcttcttaaatttgttaagacttgttttgtgacctaacttgtgacctatcctgtagaaagttctgtgtgtgcttgggaagatcgtgtattccgctgctgttgagtagaatgttctgtatatttctgttagttgttataacagaaatatacagaattataaagttgtttaagactcctatttccttactgatcttctttctgaaagttccatccattactgaatgtgagttaagtctcctactgttactatattgctgtctatctctcccttcagttgtcaatg

SEQ ID NO: 248506 - DNA, 363 bp, Homo sapiens
agagttatagtcaaagttcaggaaattgagagctccatccagataggaatccggaaaacctgtggcattcttaaaggagatgtatagaaatcttttttgagccccacatttggaatatcacttttgcatataatttgtcccacaataaggagaaaatcacgaatgccccagtgtggttactgagcacatgactaggctgtcaccagctaagtgacttgttcacccatgccaaccttcacagcacaggcggttcaaaattgcctctgacacagttgctgtctgtagtagatcttcagggtcactggcaaataggaccctgtatattaaatagatgaatgagcaagaaatcctgtattttaagtg

SEQ ID NO: 248507 - DNA, 310 bp, Homo sapiens
accaatgctattttagttgctgctctggcctgcaatgaagctcagacaacatgaaaccctgcgtttttatttcaaagacataacagaaactctttgggtgctcagcattagagtttgtcttttcactcttggttatatttgtcattctcaattatattactcctttgccccaaggatagagatttcggttagttcgactagttatcctcagcctccactgaggcttatattcaactaaatgcctgtaacagaatgctcaaactataatggaataaatgaggtagggatgtatttttctgccctgttggaa

SEQ ID NO: 248508 - DNA, 547 bp, Homo sapiens
gaattgtgtagattttagtagttggaagaagttggagtgttaatgtgtaattagagaacagtgagaaataaaattctacagattgttttattctggtgtgctgttgtgttctcatatggttgtctttttggtcttgatagtgtatcagtaacagagtacgagtaacaaacagggatctcttctgaacggcgtgacattagaaaagctgtttacggcctcaactttgctgtggtttattaagacacagatatgtgttcattctggggccaagcagtaactggagagtggcacttattgaggccagtatggaggcagtacagagattattgagattaaaagaaagaaacaggtggaacggatctatgtaatggaaagctaaacagaatagttcgtggtacacagtagaaaagcattacatgtttattaagatatggtcatcttccatttattaaagttacatgttttataatttttagagtatatagaaattctctaccctatcatgtttgccaaagtcagaacaataacttcatttattaaatataaa

SEQ ID NO: 248509 - DNA, 624 bp, Homo sapiens
aaagccagacgattcttggaagatgaagcagtctaagcaagcaagaagataagagaaaggttatatcatgttctggttgctaaaaggagggagtggttagagatcagccacaaaggaggacagtgccctgataggaagttttgttctctgtgttaaggtttttggattttgtgctaagactaaagataaaccattcaaaaccagttttaagtatgatctgtaaactttgatctgaatcagaatcatctggtagagatattaaaaatacagctttggctgggtgtgatggctcccactggtgatcacagcatgttgggagatcaaggcaggaggattgcttgatgccaggagttcaagaccagcttgggtaacatggtgggacaccatctctacaaagtaaaaataaaaataaagtaaaaattagccagactttggactgcaggaagactaaagaaaaagaaattgtccagacttagtggcatgtgcctgtagctgtagccacttgggaggcttaggcaggaggattgcttgagcctgggagtttgaggctgcagtgagctgtgatcatgccattgcactatagcctatgcaacagagagagaccctgtctcttaaaaaaaaaaa

SEQ ID NO: 248510 - DNA, 575 bp, Homo sapiens
agagtcgtccatgttaatggagcagagtgctgagttgggagatgacatcaactggtcctgcgctttctgggtgacacacaaagtgcttctttgaactggggttctgtagaaaatagtttggaaagcaatgtgtaatattaatttttttctttcctgagaatgttacatggagtgaaattcaaaagtttcctgatgtctagataacttcctatctgtccacgtggtcttgtaagacccttgcatgagcctgtcccatttgtgctttataaatgcatgctggggctggggcgacgttacttatacctgtagtcccaacactttcggaggccaaagcaggaggattgcttgaagccaggaattcgctagccacctggatggcataacaagaccctgtctctacaaaaaaaaaaaaaaaattagctgggcatggtggttgtgttccttcagtcctagctactcaggaggctgagttgggagaattgcttgagcctaggagtttgaggctgcagagagctctggttgcgccactgtacaccagagcctgggcaacagagtgacaccctgtctcaaaagta

SEQ ID NO: 248511 - DNA, 309 bp, Homo sapiens
gtatttttttctctcgtgtttaaaaaatcagtcttgcaaggtgctttcttgcttcttagtcttcaaagaaggaaatttcggttttcttaagcgttccattattctgcacctgctgaatgtaaagtttatacacagaaatgtaagtgtgagtatcacttatcatcagagaaatgtgaattaaagccacgaggccgagtgcagtggttcgcacctgtaatcccagcactttggaaagctgaggcagtcagatcacatgagctcaggagttcgagaccagcctgggcaacatggcaaaatcccatctctaca

SEQ ID NO: 248512 - DNA, 373 bp, Homo sapiens
ccccgccccgctgcggctgattcgtctagttaaaccctggtgttcctgacacaaacttcaggaaaggattttgcacttgtgcagaccgggcgagcagagtaagaagcaggtcccgcataccaacaaaactaaggacgccaacttgtctggaaggcccaataaaaagctgattcatggaggaatgcaattgtcacatcctaatgatttcatctcccttaccccaacgaatcgataaccccaaattttccagcccctcaccctccacaaatccccttaaaaaactttgcctagaaccccttgatgaaatggattgaagcttgagaactcttcctgtttcctggcttgtaacttgtgattattaaaactttctctg

SEQ ID NO: 248513 - DNA, 337 bp, Homo sapiens
aattttttcctgagtattttctatctgcagttggttaaaaccagagatgcggagcgcatggatacggagggctgactgcgcttggaacatttctgtcaccatgtgaacaagcctgctctagccaggtggatgctgtgaaacacgtggcccagtcctctccaacatcccagtcaacagccggcactgccagagacatggcaatccagctctctgcagctgcctatagattcacacgcaagcccagtcaagaccaatagaatggcccagttgagccctgttcaaactgtaacccatagaactgtgaccaaaataaatggtagtcattttaagccattaa

SEQ ID NO: 248514 - DNA, 416 bp, Homo sapiens
ccccgccccgctgcggctgattcgtctagttaaaccctggtgttcctgacacaaacttcaggaaaggattttgcacttgtgcagaccgggcgagcagagtaagaagcagttggttaaaaccagagatgcggagcgcatggatacggagggctgactgcgcttggaacatttctgtcaccatgtgaacaagcctgctctagccaggtggatgctgtgaaacacgtggcccagtcctctccaacatcccagtcaacagccggcactgccagagacatggcaatccagctctctgcagctgcctatagattcacacgcaagcccagtcaagaccaatagaatggcccagttgagccctgttcaaactgtaacccatagaactgtgaccaaaataaatggtagtcattttaagccattaa

SEQ ID NO: 248515 - DNA, 318 bp, Homo sapiens
gcagggagggaattttgtggtggtctaggtgggtggaaaggaaggagggaacaagctgagtctccgagaggtccctgttgtggaactggatctatggccagtaatcctgccacacttacataccagagacccctgactgccacctagacctgctgtgagagagcagacctaccggcaaatagatcaggacccaaatcgcggccctaccactcactacccaagtacctgaggcaaagctacttgactgctctgagcaaccatttccttctgtattacatgagattgtcattggagttaaatgagtgtgttgcacacaga

SEQ ID NO: 248516 - DNA, 497 bp, Homo sapiens
gaggaagaaactgaggcacatttagcatatgcaaagatcacatggtgagagaggaaaagtgggagagcgtggggagaggtgccaggctctttttaataatcaactgtcatgggaactaatagagtaagaacttactcattaccacaaggatggcatcaagctattcttgaaggacacagattaagtagagagttaatttaagccaaaggtgaggactgcagcctggaaatcagattctagttgccctcaatatatgctctgattaacagcagttacaagtggtctttttcctttttttttaggaaaaaaaaggagggagcagtccctaagttgtttaccaagaatttaaaaaataacagtctatcaattggctgtacattgttctttctatcacaaattccaggaacatgaagatactgggtgagggtcacattgtgcaatgtgtggtaacattttaggtaatttatcagctagtctgaaaccacagggaaggaatg

SEQ ID NO: 248517 - DNA, 447 bp, Homo sapiens
  misc_feature (182)..(182): n is a, c, g, or t
ggtcaatccaaatgcactttgaattaattttcagctagtctttatcaactgtaaaatatactttgctttcaattaaattttaaaattactagaaacttcatggttctttagtagaattaagctaataattttctgatcaacaaaattgctgggattacaggcgtgagccaccgcgcctggcncgtctcttgtttaatctgtaggttacttccctaactttctttgttccttgcaagtcattagttggagaaactgggttattctgtagtttcccatagtctgtatcttgccaattatatcctgtgagatagtttattgtgttcctttgttctttgtgtttccagaaaattggtagtgtgtatttattttaatataaaaatgagattgtactgtacatgctattttgtattcttttcttcacttaataaaatttgtacaatcttgtca

SEQ ID NO: 248518 - DNA, 388 bp, Homo sapiens
cacagctaacatacgtggtgcttttcatgcttataaaagtgactgctttcctggaagggcaaggaatgtcatggaagatagcactaacagagtcatacagaacaggtgcacatcagctgtatgaaggcaagtggccttctaggcacacctgtaaaaacagctggagcaaaggacacagcacaccatcttgttttttaagctatgcctcccattagtggatctttccatgatatgtaaaatatcagagtgcactgtacataataagggtcaacattgttctggaaaatgtagagtgtatgtgaatagtatatgtaagtatgtaaacatatgcacattggatcatgacataaaatatgtctctaaagtgtggattgttgaaaaaaaaaaa

SEQ ID NO: 248519 - DNA, 271 bp, Homo sapiens
gagacgccatctcaaaaataaaaaaataaaaaataaaaattgtgagatttcacatgaaaattggagtttccatcttctcttgaaaaagcagcctatggggccacaccctgaggctggggctgtgaggtggctgccatggagtgggcctgtgctgcccgggctgtcacctgtctctcgctggggacccttcagtgccgggcagcagcattgccatctgtgggtttgcacgtgggggttgtttttcagagaaaattttcttctgcactcaggc

SEQ ID NO: 248520 - DNA, 460 bp, Homo sapiens
gaatagttagttgatctcggtatttggcctgagcattctgacttccacattgacaggtgcttcctggacctctggaatggagaagagtcggcgcgaactggcccaggtctggctgcgtcctggtgcaccccctgtgcctccccactgcacacctggccatccagggcctgctggctgctgcagcgctcactagagtgccctgtgattcttcagggcagagtctggcagctgcacagagcatgctagccccttttgagcttcgtgctgtgtcctggtgacacgtttccctggggtcagccctcctgtgcggtgaggcgtcttgtgggatgagctccatggcctggtggagtccctgttgccgcactttgtctgcagccccttcctggttggctgacttgacagaaatatctggactccggtgatcacttggaaggacagattgtgttgtatcaacataacc

SEQ ID NO: 248521 - DNA, 94 bp, Homo sapiens
ttttttttttcttggttcacagcagtcaaaagaaccacaaaggagcagtagtttctaagcttccatgtaggtgaagacaaaaatttttataaat

SEQ ID NO: 248522 - DNA, 469 bp, Homo sapiens
atggcaccctccttctcactgaagaatgagggagagcagtaggtcccctctgctaatgctggacaaagcaattagtgcatttcttatgactagttaattagctttttatccagctttttaaactctggccacaactctatggcctcgaagtagagtgtgagtcatccaggaagcaagtttctctactgtgtgcctgatgctcctgagtattattcgcacagtgatgtgtctgtggctgcctccatatgcccccacttagatggatgcttgtacagacgtttccaaggatatcatctgctggctcttttgttgtttctaatcaaagaaccgacaccctttgatcacaacagatcacggtattgtactacaaagactttgttagaaagacttaaattttacacgcttgtagctgtcacagaggttctgacagtatttacttttaccccacacagtagcgaaaaaatgcatt

SEQ ID NO: 248523 - DNA, 404 bp, Homo sapiens
gatttcttgatgtagcctgccatctgcccttgttttaagggttccccttccttgaggcatttgcattttaaaaggaatcaaagcctgcaggtgaagggatgatgctggattggtagaatttcaggcattcattgaaaatggatcaagggttttcttttatgttggctccttccctaggttcttgacttcggcgccagccacgaaaccacagaaagcatcccccaggaccttggcgttggactcctttcattcccttcctcccaaagtgtcccactgttgctctgacttgggggagcaggggtctccctggccctcccggctgctcccggctcaggagcgtgggaggtgaggggaggtgaggggacacggccgggggcggctcggtaggggccccgcgcggccgc

SEQ ID NO: 248524 - DNA, 387 bp, Homo sapiens
ctgagttttagtcctagagaggctgccaagccaccaagcagctgtgggcttcttgcccagggtgctacttcacacacaggtgattctgcatgggctgtgttagggtccagcagcagagagattaaggagggctcacgattcttaggagcgatcagctcatatctaataggctattttgaagaggaaaatggaaaaagcaatgccgcacagagtacttttgggccaaatacctttgaatggcagtgtagggctgtccagagatggcgtaccctttcatttctctgatgtggtgtccttcaagaatacaaaactattgctgtttctttctgaaagaatacccaagaaataacaagtaaaaaaataaaaatataatgacttgttcacata

SEQ ID NO: 248525 - DNA, 499 bp, Homo sapiens
ttttttataattcagatttttcatgttacaacatatttttaatacattaaattgtaagtatcaaactgaagaaatggagtgtgttgtgtgtatgtatatattttccttctccaaagtagtaacataagtaagcatattttaatggagagcctactggaatgagagtctgagatcctaggtttaaatcccagttctgttacgttgtagtattaggcaagtccctgggccttaagttctctgtaaaattagggtattgaacttaatgattgtatggtcacatctcctctaatgtgccataaatgtgattgcactgtcctgttaactcgtgcattgggtatcccctaccactcatgagcatcatctttagagggcctatagcgctctaaatggtccttgccatttctggaggtcgggattacttgatatgtgtgccaactgtaccagggttgtctattccagattttgacagtttttacttttttgtcccttctgtatactc

SEQ ID NO: 248526 - DNA, 590 bp, Homo sapiens
ttttactcttaaaaggtaatcaaaatgtcacctatgtcttattcttaccaaaatgtttaaatgtaacctgaatccattcatgagaaatcaaacaagtccaaactgtaggatattctataaaacaactggccatggaagggaaaaaaaaggggatatgggcaaaggaacggttatagatcaaaggagactaaagagacttgacaactaaatgcagggagtaacaggattctgccctgagttgaaaatgaaggacgctgagacaaatgtggagatataaatatgcaccatattagatattattgtggcagtggaatttctctaatgtgatcactgtggttctataggcgaatatcccactttctttggcatgtatctcctaagtacttagcggtaaagtatcattcaggatatctgcaacttcttttcaacacagaaaaaagagaaagcaaatatataacagcaaaatagtaacaattagtgaatctaggtcaaaagtttaagtgttcataatactattctttcaactctgtatttcaaaataaagttcaaaggaaaaaagcaatagcaataaagcctagtttaaaaaaaaa

SEQ ID NO: 248527 - DNA, 486 bp, Homo sapiens
gcggcccatgttacatatggccagggttatcattgggattcaaaggggatatgggcaaaggaacggttatagatcaaaggagactaaagagacttgacaactaaatgcagggagtaacaggattctgccctgagttgaaaatgaaggacgctgagacaaatgtggagatataaatatgcaccatattagatattattgtggcagtggaatttctctaatgtgatcactgtggttctataggcgaatatcccactttctttggcatgtatctcctaagtacttagcggtaaagtatcattcaggatatctgcaacttcttttcaacacagaaaaaagagaaagcaaatatataacagcaaaatagtaacaattagtgaatctaggtcaaaagtttaagtgttcataatactattctttcaactctgtatttcaaaataaagttcaaaggaaaaaagcaatagcaataaagcctagtttaaaaaaaaa

SEQ ID NO: 248528 - DNA, 493 bp, Homo sapiens
agagatctcagtttttttacattcctagattattctaaattctatggaaattaagtttcatcacactaagacaggaagaagaagaatattaaccttccaggtgacaatcctaaagggaaatatttattatttttcattgtacttggagatttcattaaatgattctttgttaagtcaaaattttgttcatgaatatcagcctttagagacataatcgctcatctagttaacatgtcagaaaagatcaacccattagtggattcattctgtaaatacttaggactgcaaatgggaaggggaaaaattgagtccagaaagttaaggccaaaatgattttgagtttaacgatccagttcatgttctcaatgtgctctatgagaataggctttgtaaccttctttagctgatgcagattaattgaagctcaaaaaacaaaacaaaagaaaaccctgcactacttaacaatgcaaagctgtgcaaggatggaagattc

SEQ ID NO: 248529 - DNA, 396 bp, Homo sapiens
cttctgcagagggagggcatagttgtttggtgagtgacagtcctgaaatggctcctgaacattattttcttcctgggagaggctgatggagaactgtcctctcctcttgagtgataactttctccaagccacatagttcaagaggtagctacactgtgcagcagtagcctggagcaggagcatcaggatgaccccagggatacctagatgagttcttgggctgttgcttatgctcatcctaagagttacctgagttaccgttccacaactttttattacataaacagggacttaatgtaccagcagcatgggcattataggaaaaaaaaaccatacagctctcattcataaggaacttatagccaaatggggcaacaaaaataactacttgtggac

SEQ ID NO: 248530 - DNA, 196 bp, Homo sapiens
gttcaggtattttcagctgattcattccatatatgttttcttctgaaacagttattcgtcattttagcttctattggttgttatcttaggcccattaattcattgggttccaaatgaatttgtctgtatgttagtgtcccatgaaacaattcttttctccgatgttttataacttaattaaaatgccagatcttga

SEQ ID NO: 248531 - DNA, 370 bp, Homo sapiens
ggtcatgttggtcctgacgtcacgttgagtctagtgccatgggggatagagtacaactgtggtgggaaccccctgttggatatagcaccatattagtggtggcaccatgttggaggaacaccatgttggctagagcaccacgttggcaggggtgacaagttggaagggggatgttagtcggctattactgaatgctccacaggctctctaatggcagctccagggaatctaggacgagctgcccactctggcacttctgacaccaccgccaaaactgtggacctttattgcatacaccatcctctgaagttcaaccctaaaagagagtatgactagagcctctgacttcttttctcctccttcttccaaa

SEQ ID NO: 248532 - DNA, 368 bp, Homo sapiens
caagctaccagagctgactggctttgttctgattgcttctttctgctttgagatctttttgagaaaaggcaggaatgcagatggaataggtagagtcttacggtgcttggctttctgctgctagttactcacctaacttcttttccaaatcttaacccatttcccatgctatagattgttccacagttaaaaagaaagaggggtctgcttgcctcaagcagctgggttaggttcatgactacaggttaagatacagcactgttatgattagtagttgcattgttcattgaacaatattctctatttgcttttctgtccactggtaaagaatgtcttgttagaatcctctagtagtggttcagattgcc

SEQ ID NO: 248533 - DNA, 529 bp, Homo sapiens
agaaaccaggctgcagcctgggctcagcctcttatccattgtggggctaaggaagagtccctgtcccccagtattctccaatcccatctgatgttaaaacctcttaatgaccctgatctaagcatttccagaaaaaggttctcagggcctttctgggggtggcgggggcaatcctttgtgacagcatgaaaagccggatggggctggcctggttgcaatggcacacgctaggttccaggcactccacacgtttctcatgataacctcgtggttgatactcacacagatgaggagctgaaaggctgcaggagctgcccaccatcctcacacagcgtggaagtggtagcaccaagactgaggcccaggaggggggtccaaagggccatcctgcattttccattgcagcagggtgggaaggagagggagatagagactttacctctactctaaatcacctccttaggttgccatattttccttacttcaatgaattatgtggaacaaaatacactcaattggtagcagaaat

SEQ ID NO: 248534 - DNA, 728 bp, Homo sapiens
agaacacatgccaataaatatcaatgttttcccttgtcctagtttatatatcatgacttactacaacacaatgaaatgggcacaagacgctactatctctattggtaactgtattcgtccgttttcacactgctgtaaagaactacctgacattgggtaatttgtgaagaaaagaggtttaattgacttacagttccacaggctgtacaggaagcatggctgggaggcctcaggaaacttacaatcacagcagaaggcaaaggggaagcaagcatgtgttaccatggaggagcaagagagagagagcaaagggtgaagtgctacacacttttaaacaaccagatcttgtaagaactcactcactatcacaagaacagcaagggggaaatccgcccccatgatccaaacacttcccaccacgtccctccccaacactgggtattacaatttgacatgagatttgggtggggacccagagccaaaccatatcactaagtctctatgccttgaaaattttcctctttttttgtttatatatatttgaaaactcatctggactaaaagttaattatttgacaaccaaaaattaattcccaactcatgaagccaaaattctcattttttaataaagttcaacttattggtttttctctcatagattgtgctttgggggttgtactaaaaactgagaaccaaatccaaggtcacctggattgcctcctatgctt

SEQ ID NO: 248535 - DNA, 461 bp, Homo sapiens
agaagaaacattctaagcgcatcaagaattctggccgactccccacagccccgggttcccatggcaaccgcctggcgcttgatggttacatctttcagcacaagcgtggaaagatttgtgtattcggctattttgtcatccgcatatgatagcacaggacatgctctgcactgtaaactctcagaccttcccgatatttgtaactttggctgctgccactggccccggctccaaaccttcagtgtcctgtattttgacatttctttgtgtccgtctctacccacttcattctcccactcctacccctttacacacaccacatcagagcttttttgtggggactgagtaaaagacctttaggaaatttcaggtatcgattccttctatgcatgcagagtagatatgaacagcaaaaataaaaaataaaaaaattgaagcagaaatagtctgcctgaaaaaaa

SEQ ID NO: 248536 - DNA, 451 bp, Homo sapiens
ctaagcatcctaagatgcaggacaatgtgcttttcccagctctgaactcccttggcctggcaaagagttgcacaaagtcaggaagccgctctgaggaagttctatactgacttctcaaaaataatgaggtaagcagaatgagctttgaggaatgggcctggcaacttgtttgaactgcaggtaacatctgaaaagcagtgttaagatcatgaacggtttagacttttgcgtaagataatggcgttatatcccagctctgtggttataggccaagtaactttagtaaaacttactttagtaaaacttacttgtttgtaaaaggcttaacttagaataggtgcccattaaggttagttgtctttctttccttagttctttttcaaattctcatctgtgtcctaaaaatttaatctgatataataatgagtatagttgtgacacactatttcct

SEQ ID NO: 248537 - DNA, 397 bp, Homo sapiens
tttgatctcactaacagggctgcttacaagctctagtcttcctggatgttttatggcaaagaaatcttgttatctttaaattccaaaacatcttcttttttgtttaatatactttgtttttcagagcagttttagatttacagcaaaattgaatggaaattacagtttctatatgcccctcaccccacacatgcactacctccctcatcatcaacataccccaccagaggggtacatttgttacaatcaatgaacatgtgtccaatactgacacacttttactacccagtctgcaatttatattaaggttcactcttgctatcacacattcaatacatttacacaaatgaaaaatgacatgtatccaccattatagtatcatatagagtagtttcgc

SEQ ID NO: 248538 - DNA, 594 bp, Homo sapiens
ggatgattaaatcaaatttgatattgctaaaatccactacatttgtcctaagctattatttaataaaacacagatggctttaaaaaattaagttgtcataacaatacataatttgagattcagatatgttcagatttaagtcaaattgacataaatgaaaataaaattctaccaactaaaatatacaaaaagttactgaaaaagtagtattacaagatgcagaaatgtacacttcaaaatatacttcaaatacacttcagttcctctggaaaatttagaattaactgtcaaagtaaattgttgaatcaatttcaaaatactcattgctgatatgggcattcccatttatctgtttcatcgtggtcataaaatgtggccacaaagagatattaaaacctttattggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcagga

SEQ ID NO: 248539 - DNA, 429 bp, Homo sapiens
cttttttttataatttttatttttctgctgagatcccctatctgttcacacattaaagaccatgtgttcctttaagattttgaaaataattctaattctttgaatgtataaaatagctgctttaaaatctttgctgctaaatttaacatctgttctaacatggggttggtgttttactgactcctttttcccccttattggatcacatttttctgtttctttgctgcctactaattatttttgtattaaaaaacaacaacagaggcaaggtcttgttctgtcacccagtctggagtgcagtggtgcagtggtgcagtggtgcagtcatagttcactgctacctcacactgctgggctcaagtggtcctcccacttcagcctcctgaataactgggactacaggtgtgccccactatgctcagctaatta

SEQ ID NO: 248540 - DNA, 603 bp, Homo sapiens
caccctggccttcctccatccccctcgcacccacacattatatagctgtaaaatacctgcaaaaaataggaagttatgagagcaaatagttatctgagttgaatttttgaatctttgtacttgttatggcaacaggttttccttcctaatttcttttctcttggtctaatattaaaatgtttttgcattaccttagcatgcttactggatgggcagtgaagggagaataaagtcaccctggcacatgtgagtgtgaaagaaagctaacttaaaaaaaggaggccgggcacggtggctcatgcctgtaatcccagcactttgtgaggccgaggcgggtggatcacgaggtcaggagttcaagaccagcctggccagcatggtgaaaccccatctctactaaaactacaaagaattagccaggtgtgcggcaggcgcctgtggtcccagctactcgggaggctgaggcagagaattgcttgaacccgggaggcggaggttgcagtgagctaagatcgcaccactttactccagcctgagcgacagagcgagactctgtctcataattaatatagtcgagctggctcgcgaatttagtagtagtat

SEQ ID NO: 248541 - DNA, 515 bp, Homo sapiens
taaaactcacaaataatgatttaatgtgtatttttcagattcagtttgttattcagtacattttatcgccaactctcatcatattcatctcataccagacttaacattttctatgtcctgctaacctcgtataaatttccaaacacatcatgaaaaattttaatgtcagcttaaaaatcttccagaggatacatgggtttcaaagccttttgggagtacacaagcaaaaagtctgaacacccattattcaaaagctgttctggccaacaaaacagtcactagccacaggtgactatttaaatgtaaattagataaaattaaaaattcaattttgcagtcacgctagccacatttcaggtcctcaagagccacctgtggctagtaatgccgtactggacagtgcaaattcagaacacttccatcatcacaataaattctattggacagggctgtcctagggaacctagaatatgcactgtttgccccagtgagttgaagttataagacttttattc

SEQ ID NO: 248542 - DNA, 238 bp, Homo sapiens
aaaaaaaaaaaaaaaaagtcttttttcagttgttttgtttaatcaggttccaagtgagatccatgcactatatttggttggtgtggttcttaagggtcttttaatctataacaattcacagtttttttttaatgccacttatttgttaaagcaattggattagttgtcttgctttctggatttggatgattgtatcttctttatattatttaacatgttccattatcattcattgtct

SEQ ID NO: 248543 - DNA, 526 bp, Homo sapiens
atccagtcttcaaatctgtcagcatgtcacaacctggatcccctgaccacagcacacagtggagttccaggctgagacatgacaggctgatcacaaggagcagccacttcctttttctcaaatcacaagcagacaagcagccagagccgggtgaaggattttttactttggtttggtttttcaaccaagacattctcaaagtttattgttctatgaagtggaaacatttagttttctaacaaacaattagaagcacaggagtagagaacatgaaactgagaacgaagctcaggatacacaaaaataagaggctgggaggcagctgagatcaggaatgtccagggatcctcggccacacaagccggccaggcactctctttccagggtgtctcaaggggaaatcacccatcgatcctgggacacacgagttctaggaccaatcccttacctcagaacagcctcggcctcaaattcctgcttgcgctttaatgtttaaattattaaatgcattaatgtatttacatta

SEQ ID NO: 248544 - DNA, 341 bp, Homo sapiens
cagttcagggtggaggaggagctttgacatgctccagaagctatggagccctgactcaacacgcccaccctcgaggagcaagcctggaaggctgcagaggtggccactggcctggctgactcagccttctttgtaacagcagaacatcccgtgaaagggaactgttaagtacgtgaccctatctccatgtgacaaatccacacagccttgaaagggcggcattccctgacctatccaggtggggtggggggtgagggctgcagatctctatatcattatgtaaaacaatctcaaagacagagttaaattaaacagcaggtgctgagagcgtgctggacact

SEQ ID NO: 248545 - DNA, 754 bp, Homo sapiens
  misc_feature (225)..(225): n is a, c, g, or t
aagggaccaggcagcggggcttgaggagtctcagcgccgccaggctcagagtaggcgtgcctcccctattggtggccacatccggagagcgagctggagacggaaggggagttggtgtcaggggtcgggcggctcagggctccgggagcgagatgaagaggaagaggcagggccggggtcggggcggcgccagcgggaattaaatcgcagaaagtaccaggcacnaggtcggcgctgccggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgagcaacactttgtctttcaaacagacaaggccctggatcccagttcggttccaccggcaccagacaaacttgtgccctaatcgacttggaacagagtcagcctctgatcttcgtcatgccccaccatctccc

SEQ ID NO: 248546 - DNA, 410 bp, Homo sapiens
aataatggagagttggcatattactgaattggaagacaaaaaaatattattctacccacatttatgatagattcaatgcattctcaatatcctaacaggttcttaaaaatagaaattgacagggtggttccaatatttatatagaaatcaaaaagaatagtcaaaatattttttaaaatttattaaaatttttatattttttactttttgtttttggaaacaggcgcccactctgtcacccaggttggtacgcagcggtgcaatcatagttcactgcaaccttgaactcttgggctcaagtgatccttctgcctccctgtagagatggggtagagcctcctgagtagctaggattataggtgtgcaccacaccatctggatacttaaatttttttgtttttgtttttgga

SEQ ID NO: 248547 - DNA, 481 bp, Homo sapiens
cgtttcctcacctataaagtggcttgtgtacttgtttcacttatctcacaaagttgttgagaagataaaatatattatgagaaatacttagagtaatgtaaaatacattatgtgattaagaatgtggtaagacctgaaagacttaagagttgactaatttgaagttcatgaaaattctcacaggactttgaaaaaagaaaaaactggctgggtgaggtggctcatgcctataatcccaacacttcgggaggccaggccaggaggaacgtttgagtcatgagtttgagaccagccagggcaacataatgggaccccatttctacaaaaagtttaaaaattagccgagcatggtggcaaatgcctgcagtcccagctactcaggaggcagaggtggggggattacttgagcctgggaagtcaaggctgcagtgagacatgactgcaccactgcacacaagcctgggtaacagagaacctgtct

SEQ ID NO: 248548 - DNA, 404 bp, Homo sapiens
atcataatctttctacttaatagaaaccttgaatggccccttttaaaagtaaggcagtcttactttgcaatagaaattgattgtagtaattcaaggtgaattgcaatcgagtcccaaatacttagctgacacaaacaactcaacagggtaaggcaaggaaaatacagcattctgaaaggtaatccctttggtttgaagattgaagtttccaaggcaataaatgcctataagcataaaaccaagtcttctctcatcatagcctttggcatatagaagtgtccacatgctgaaatctttccaaatgtaatatcacaaaaaacaaaattgcaatggacttgtatagaatagaaatggttcatatcagtgtcagggcttagtaagagcaagaatcaaatcttttgaaa

SEQ ID NO: 248549 - DNA, 974 bp, Homo sapiens
ctgtggggaaacagaaaggttttgactccagtctctgtcttctgaagagctggcagtcacaactgtggcagagcctggtgtgtggcagctgcgtgaggctctcctggactgctgtggaggaaggggccctctggcaccccaggagcagcctgcccctctgtctgcctctgcatttagacccttagcctccttgcagagccacctcctggtcattagcgttaaagctcttctctcctgatgtagttttcctcaccgttcagtaaatgggcctgctgcttgtgtttggaacagagatagaagctgtagctcccacgtgtgtgtggagctggtttgacttttaaaaaattgtagtaccaaaaactatgattttttgtgtgttatccacaccatcaaggctgtatcaccgagtatctgctcattctgaaagtgtccatcctttctgaattgaaatgaaagagcaggagaaaccgtctgtgtccagcctgttagaggtgttacatttgccctaggtgggctgggcagaaggctgttctgctcgggagcaacagtgtccacacgtcagtttccagagcccgggtcgccaggatccggctcagagtgtgagtttgctcaggtgtgtgctgagcacccctgggtgccagactccgggcaggtccccgccgcagccgcgtcagcagagcaatgtgatcgttgctgggactgttcccctagtctcagtcagttcactagggccatgcatgcagtgttcagacaggagattctcatgaaaaatagaattgttatcctaaaattacatgagagggaatgcttataagtttatcaaatagtaaaacatcacaacacaggaccgggtgcggtggtgcacgcctataatcccagctacttgggaagtcaaggcaggcgatcccctgaggccgggggttcagactaggcaacgtagcaaggccctatccctgcaaaaaaaagtaaaaaaa

SEQ ID NO: 248550 - DNA, 1178 bp, Homo sapiens
aaatagctgaacacaaccatcaaggcatttttttcccaaaaagcacagaaggagattcaatcatcaaatgagaggcctcactcacctctgcatattggcccttatcctttgaaagagaataaagtaacagctgctattctttcagccaagaaagggccactggaacaggtccagaaggaaagaaaagagtgatggcaactgctgattcaagaagattgttctgtttcagtttttattttattttagatgtaccccttctccacaatgagtttctcatacacgcatctaatgaaagacgcctgttctcaaccctcctagaatttcaagatgggcaaacttacaaggaaagcaaggatgagtgctaatatgtaccatattcatgtgaatataagtttttttaataagaaaatcaaactctaaaaatacaatatacttcataattacagattgaaaaatggggccgtgtgtcctaggcagctgcccactgctgagtccagggtacactgccatcctaggaagagagtgaggaggagggtgaaaaaactcacccaggaaaggcagtgaggggtggggagggagcacaaagaaagtcacttcaaatctctctctagaactatattgtttttctgtgcaaaaatattttcttctggcccctttatagactagcttataaaaacactgcaaagtgctatgattctaagggttctggaaccgaagacaaatcattaaaagttagattcaaatcgttggtaaagaatgattatgtcacaattttgcatcacagttagtaagccagtgatagcctcggaatgtaatctaagagacagtggcacagtggttaagagttcagactctgacgttagaatacctggattctacttttggctctggtaccatgtggcttctccaagcctcagtttcctcctctgtggaatgtgaaaaatagaagctccctcatagggttttcactggcattaaaggggcttccatatagaaagcacttaaagtagtgttcagcacgtggtaagcattcaacaaatgttaggtgttattattacttattaaacaggtacataataaacaagctgttcacaaagcattatttcacctctaagccttacttctgatgtagaaaatacactaacaatatctacattgcaagattagagaaaacatat

SEQ ID NO: 248551 - DNA, 418 bp, Homo sapiens
aaatagctgaacacaaccatcaaggcatttttttcccaaaaagcacagaaggagattcaatcatcaaatgagaggcctcactcacctctgcatattggcccttatcctttgaaagagaataaagtaacagctgctattctttcagccaagaaagggccactggaacaggtccagaaggaaagaaaagagtgatggcaactgctgattcaagaagattgttctgtttcagtttttattttattttagatgtaccccttctccacaatgagtttctcatacacgcatctaatgaaagacgcctgttctcaaccctcctagaatttcaagatgggcaaacttacaaggaaagcaaggatgagtgctaatatgtaccatattcatgtgaatataagtttttttaataagaaaatcaaactct

SEQ ID NO: 248552 - DNA, 423 bp, Homo sapiens
ggccagttaaccaagttttgttagcattcctaactatccttagctgtatttctcttcagcctggcctcatttctttcaggcccagcccccgggcaggttaagatggttgctgtaattaatcatgccgtgggccctaattcagactcaccacattcaaatttcaatttaaaaaaaaaaaggcggggtgtctacttaagaaatgctccgcttatgaaatgctctttgttgccgaagcagccccctttcagcctaaaggagaaagtctaggaagtgcaggaaagaagaaaggtttccagggccctcttcaaagtacttgcacatatgtgaggggactgaggatgatctgtgctccaaagcccctccagtatttcccaatcagaacaaactgaatttttaaaaatatatattaaataccatcataat

SEQ ID NO: 248553 - DNA, 939 bp, Homo sapiens
cctagtgttggaggtagagcctggcgggaggtgatttgatgatggggcggatttctcatgaatagtttggcaccatcccctcgatactgtcctcaccagagcgagtccgtttgtgagatctgcttgtttaaaagggtgtagcacctacccctccatctcttgctcctgctctgggcctgtgcctgcttcccctttgccttctaacatgattctgagcttcctgaggccactccagaagccgagcagatgccagcatcacgtttcctgtacagcctgcagaaccgtgagccaattaaacctcttttctttacaaattacccagtctcaggtatttctttataacaatgcaagaatggcctaacacaggtgtccaggggcagagggaggctgagtgtcaggtgaatggatgtcctgactcatagaaggaaagatcaggaataggaagaaaagctttcccacaaaactgccacttaccccagaacaactcacccagcatagtcaggtgttaggtctttactgaaggtttggaaggacagagggtgggctcacactgcttgacactgatggcttaaccttgagtattagccattggcctccttgtcttggaagtcctttggccctgccaccaagaactgttccctggctgcctccttcccagctgcagcttcctctggtgttgctagagccttccctcctggaaggtgcttctcctgaattcctcttataatgcagagaattttgactcttcgtccctctgttggacatctaagtaacattaaagggctcagcttcacacacgatcacatatctatttcggcatcttggaagagcgagcagggaatgtagacatcaaggctggttcttcggctctcccaaaggccaaagatatctatttaaatatcatttaaataaacccctttattgcttaaatcatcataa

SEQ ID NO: 248554 - DNA, 439 bp, Homo sapiens
tggagaaaacagctctgtgtctggaatgagccctcctagaattcagtaccataaaactgaagacatgtaaatctgctcatgtaaatcctccactgcatagccttttgtgtggagcatttatccggactgatggcaaaaactactgatatcatatggaaatgccagctcagaagatgtggtgagctttgataattcaggaattgactgacagaaggaggacctcatttgggcagaatggctcccaaaacccagttgtgtctctgggtgtgtaagcccagcagcaggcagtgtgtcatcgctgtgtcagttctatggtgtgatgtgcggaactggtactggaatgtagacatcaaggctggttcttcggctctcccaaaggccaaagatatctatttaaatatcatttaaataaacccctttattgcttaaatcatcataa

SEQ ID NO: 248555 - DNA, 239 bp, Homo sapiens
gacatgccagtagttcacaagcccagattaggtcacagatttaaatctcttctatttatttttctgaagccaatacatggatggatttgggtctgtgtttatttccctgcccacaccgttatggctgacggggcagtgagtaggtggggagggtggagaggtccacaggaggaaggggaaggaagtgaggcccaccctaaatgagtgaatgcaggggcaccttgctgcacccacccttg

SEQ ID NO: 248556 - DNA, 539 bp, Homo sapiens
tgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtg

SEQ ID NO: 248557 - DNA, 137 bp, Homo sapiens
actaatgcttcagaagaattgtaatattaggtgaggacacagcaagaaggctcccatcagacactgattgctggtcccttgaccttggtcttagcctctggaactatgagaaaataaatttctgttattcataaatt

SEQ ID NO: 248558 - DNA, 252 bp, Homo sapiens
aataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaa

SEQ ID NO: 248559 - DNA, 447 bp, Homo sapiens
gatatggaaatccagctctgtcatccagccgggagtgtagtggcatgatctcggctcaccgcaacctctcccccctgggttcaagcaattctctgcctcagcctcctgagtagctgagattacagtgagctactatcacatagttgcacgccagcctgggtgacagggtgaaaccctatccaaataataataataataatttgacaaataaagtctcttttaatgtagctggaattgtgtaagaaagtctttcctcagcaaataagaaatggactatgaaatctcccagaatcttttttagcccctaattagctataaatctcctgacagtttagccatgggaggcccaagacatgaattggtggcatggcacatggtctaatgtgcatattgtataaagttatctaaatacatcttgagagagtccacgctttctccattcttttg

SEQ ID NO: 248560 - DNA, 489 bp, Homo sapiens
aaaagctgcccttttgtgtctagaacatggatgtgttcattagggcctcctggcaccccccagaaggttaccaagagccttgaaatttgaccaaagggcctgggatagactagagggggagggtctactctacctagccgtgaaaaaatccagtgaatgatcccattctcccaaaacagtcagcaaacctccctcttatcagaaatactagtgtccaccagatatagtccataagtcattaggagttaggtcaatgaaagctcatgcacagctagtctcatcctaattggacactccagttgtcattcccatgactttggttaatataaatgcaaaaatgaatttttaaaaaatctttcagcccgggcgcagtggctcatgcctgtaatcccagcactttgggaaggcgaggtgggcagatcacttgaggtcaggagttcaagaccagcctggacaacatggtgaaaccctgtctctcctaaaaataca

SEQ ID NO: 248561 - DNA, 361 bp, Homo sapiens
aaattactcatgactttccataatcaagttttagttataacagtgtacttaagctgggctctggggtgagcagtgcccactagcaatctctgcctacttctttgctttccaggatcaggctcctgtgaatggaggaaagaagctaaagccttagggaagaaaaagagatcctatgccaaagccatcagggaatgcagggggaccctcaggtcagcagcaaactggcatttgggcgtttgggcaaattaaaatttccaatgtgcaactacccatttgaatcatttccttaatttttttttttttgcattttatcatcaagactatctggaaataaaagattatggttatcttatctaaatta

SEQ ID NO: 248562 - DNA, 492 bp, Homo sapiens
ccccgcaccccccaaaaaaagccttaattgaagacacagaaaccggttttgaaaataaaagaatcctcagatgttatgtttcagcaattcgttcatcattcttcccttctgtgacccttaatcacgtttggtctttagccctagcagataacacacagtgccactactgagcacagttgctcatgtgtgtgctctttaataggaatttggaagtcatattctgcagaatgttttaattccatactgggtggattgagattattcctgtttgtggatcacccacattgtcagtcctcactgatgacatagatgatgattcaaccaccatttcaatttggaacagcatacagggaacactactgatttcaaatgtaggattataatttctaatttaatttctaattcttgttctctggtcccccttcttctcaacaattttttgctataagtacctgatgatggccttaaactggaaacacactcgatttatta

SEQ ID NO: 248563 - DNA, 840 bp, Homo sapiens
gctcagtttgttttttttttctttgtaaatgggaaataagtgaaagttttaccatttctttcttattaatcttcactattaagagtctttaagttgttactgagtgaatgctcattctggctattttgttaaacctaaccttcaactggttatgtttttctctcctttcttgtctctctctaaaattttcatattaaacaataaagcttctgaaactactcattgtaaatattttcaagctgttcaagtaaagatttcattatctatggggcagatcttgctattgaatcttattccactccataaattatattttattggtttggaagtatatatgttttaagtagttgtgaacgtgttttttcacccaggaagctctggcccagcttggtcagcatgtaaaataattttccaacccacaaaacagatttagcagtaactgttcaggtcttgctgaaatggcttccttgatggatatttgggagggggggttttgtttgtttttaaaaaaacactgttagcatgaccaaattctacaaaattagttctttaatattaatccttccttccataccccctcacaccaccttaaaattttcaaggcttacgttttaactctcttccacttactctaattttaggggccctctggtggttaaactttacaattctttcttttccgctttaaacttttcttccatatctttacctgaacacctttcggaatccccttatttttcaggtttacccttttcatttcactccaaatttggattctatctcttaagcgtgcgtcccttattaacaccggttactatactcgttcccccctttggttcg

SEQ ID NO: 248564 - DNA, 640 bp, Homo sapiens
gctcagtttgttttttttttctttgtaaatgggaaataagtgaaagttttaccatttctttcttattaatcttcactattaagagtctttaagttgttactgagtgaatgctcattctggctattttgttaaacctaaccttcaactggttatgtttttctctcctttcttgtctctctctaaaattttcatattaaacaataaagcttctgaaactactcattgtaaatattttcaagctgttcaagtaaagatttcattatctatggggcagatcttgctattgaatcttattccactccataaattatattttattggtttggaagtatatatgttttaagtagttgtgaacgtgttttttcacccaggaagctctggcccagcttggtcagcatgtaaaataattttccaacccacaaaacagatttagcagtaactgttcaggtcttgctgaaatggcttccttgatggatatttgggagggggggttttatattaatccttccttccatacccccaccacctaaatttcaggctagtctacttttcactactaattaggtccttgtgtaacttagttttctccgctaaaaaactactcatatttactaaccctcagatacatattttagttaca

SEQ ID NO: 248565 - DNA, 353 bp, Homo sapiens
acataaactcgtagactgattttaaccaatacaactatttcacttctgtttgaggaagtattcaaactcagaatttattttgactgttttaagactttgtaacttgagatgtctccaaagagaatggtctaaagaaaggtaccacttggcaatgcaatgatagcatatgtaattgacacactcttagggaatcactctgcaaacccctgaacttataagggtataggtactattaagtagacatctctgctacaaagctaacaggtttgtgaaagtattcctcttcttaaattattgccaattctacccactttggttaatctataaaatattgatacggtgggcccccatcc

SEQ ID NO: 248566 - DNA, 663 bp, Homo sapiens
catttttttgcataaaactttccaacttctaacacaatatataaattacatatttaataagataatttttcattgcttatctcttcccctagcatgtaaactccacaagggcaaagatctttgattctttggtttgctaatgtattacaccctaggagtgtgcctgtcttttagtagctattaaatgagattaatattgcaaagaagaaatctaaccatttcattctgagagttgagcctggccagagatccataacttctgcagttttctcagccattgatccacgttgtttcatgttcagattgaaagaagcaattattattgattcagttccagccttgtggacacatagtcaaattttctaggcatgtcttgtttctaaggtgccttggaattccaactgaaattaacaggtaatagagaaaaagaataaagaaagtatcaaagaaagaaagagtgagcttcagagtaaaatattattatatagctcagactaataaaatgtgttttacttacatattcaatttgaatgacttaactttaaacatcaattcaaaaaaattgaatatcgagaagagaacatgaaaggaataagcactggagaatgagagctatgaaaaatttaaaaactcaataacaaacttccagaaattcagtatctt

SEQ ID NO: 248567 - DNA, 494 bp, Homo sapiens
aaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccctcccggggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgcagttcgctttcctgttggtggggggaacgccgatcgtgcgcatccgtcacccctcgccggcaatgggggcttgtgaacccccaaacctga

SEQ ID NO: 248568 - DNA, 945 bp, Homo sapiens
  misc_feature (662)..(662): n is a, c, g, or t
caggaacatgattgtaaagaaaatgtctagttcctagagagagccagtaaaagaacatcattccacaagttactgcctccaatttaaaaacatcaaaacaggataaagagtgtctcctactgagcggaaagtagagaccagaaggtttgttgaaaccccagagtgaaaaccacttagagaatcggaatcgtcaagtataaggttgtgagatggattcagagaccagactgaaatatgtctctgccaatctgtgcagtgaaagtggatgacaagggagatgggagacaggagtcagaggtggcagaacaggcattggcctccctgagagatgtccagggcgtgagagtgaatttgtgagtaggtgacagaggcatgtcacaaaaagcaggcacagagagcaatacagaatgagaggtcattttacggtagcccaaaagttagtatggtccacggataccagagcctataaaataatatcatggatttatgaaatatgagaattctattgtgtgctgtgtgtgtagataaaaaaagtaagtgcctacaaattagatgtgcagcaaaatagaatcttttaagttttctataattgatgtgtttacttttgaatcccccgccgagccctatgcagtctcaaaagcacagagaccgtcgtaataagngctcgagctattcatgagtcgaggtatttggctgcatggcgacgtttaacagcgtggctggaagctggcggtccactaatgcctcgagatcccgttgcagtgcgatgcgaagccgacgttctttctagattcctaaagcagtgtgccggggcgggtgtcgcggggtggtggcccattcccgggtatttctcttggggggccaacaaagctgttgtgttctccgataatgcgttcctgaactttgcctatgtaacacctcttccgggacacaatcgcgcctacc

SEQ ID NO: 248569 - DNA, 993 bp, Homo sapiens
ggtaattgcgtgcttttaactacatcaagggattaagggcccaaagaagattcttggcaagtgagttgaatagaaacttgaacaattgctaaaggaaactcccctgggagtgaaggggactaagaaattcattatcttctctttttattgttatataccatagcagtgtccacatccttacagtctagtactacaacagttattctttccagaatctaatatatcagctctgaactatacttttttttaatgtttcaaaaaggtcttgatcctttagcttccagaaagatgactttaacctatctatgcttctgttagattggactatgtactaactttcatttcctaaaacaacatcttcaataatgttttatttgctccaacaataggatactttgctatttaattgtaagattttcttcccctacctctggtagttctatagaaatatgtgagcagtgttcatgctgtaccccaaacatttaacctcaggggactgtttactaagttgagcattaaaccatcccacatgtcaccacatggtgacaaatgtaagctccagagatattcatctccatggatcaatattatatgttatcaaggtgggcaattttaaaacttccaactactgtttccaatcacaaaattcttctaactacaaggcatataacaggtacttcatataatccccattatagcccaaggcatctatgtagttgccccattataaacagattcctgatattcagagaagttacctttttacacaagattacacagctattaattggcagaagtgggacttgaactgttctttccactatcgaaatctctctaaggattaattaataaagcattaatcaattattggggtataggccgggcgcggtgccttacgcctgtaatcccaacactttgggaggccgaggcgggcagatcagaaggtcaggagatcgagaccatcctggctaacacggtgaaaccccgtctcta

SEQ ID NO: 248570 - DNA, 439 bp, Homo sapiens
agccacctatcatcaaatggaaatggtgtattagaaacagcccaggcaggttcagaaggtataagtaaattgtatgagcaggcggctcagactcttccaacatcaactcctgttgctttgcctcctctccctcattctacaactatggcttcttgggatgctgcctatgtccagttgactgagggagaaaaacctccagcctggattatagatgggtctgtatgatgtgctggtaccacatgaaagagaacagctgcagtattcactcacactcactcaggggtgactgtgaagggcagtggtgaaggagaatccttccagtgagcagaaactcaaggctgtccactatgtctggagtgagagatggccagaatacagacctaaattgattcatggacagtcgctgatggtttagctggatggtcagggccttaaaaag

SEQ ID NO: 248571 - DNA, 151 bp, Homo sapiens
ccaccaacagatacagcatactgaccaaccaaggcagagctacaattaaaaaaccaagaagacaacaagtggaatttgcttttctatcccttcctcaaaatctccatcagcttttccgaggcattataaataaaactaaaatctaagttaa

SEQ ID NO: 248572 - DNA, 550 bp, Homo sapiens
ataaaatatagctctgagacaccctaggagggcccacacttctagtacaacaaggctgtcttctcacagcctgtggaaactcctgaagaacagcattaagtgatactccgaagagatgatgagaagcaattggccctccaagaccatggtgcgggagtttgttggaaccagctccagctgactcctcttcccctcccaagcctcctagctcatcccaaaaggagctcctcccacaagtaccttaatagtcccactccatttgattctcacagtcctgaaggggcaggctcctgttgccattgtagagatgaaaaaactgaggctcaaaaagaaaattgccttcctcaacgtcatacagcttgtcaatggcagggctgggattcaaacccaggccaggtatggtggctcacacctttaattctagcactttgggaggccaagatgggacgccaggagttgcttgactccaggagttcaagacctgtctgggcaacatagcaagaccctgtgtcttttttgttaaaataaataaatatatacgtgaaaatgt
